United States Patent 9,328,346 (POLYCOMB-ASSOCIATED NON-CODING RNAS) - sequence listing, part 157

SEQ ID NO: 192849 - RNA, 281364 nt, Homo sapiens
aauucuccugccugagccucggcccaacaaaauggcggcggcagcggugucgcuuuguuuccgcggcuccugcggcgguggcagugguagcggccuuugagcuguggggagguuccagcagcagcuacagugacgacuaagacuccagugcauuucuaucguaaccgggcgcgggggagcgcagaucggcgcccagcaaucacagaagccgacaaggcguucaagcgaaaacaugaccgcugagcccaugagguaaaacgcaaccccgucucaugggccccagcggucugggcccaggcaccgucugagucggguguuugggaaggcguucgcuugguggguuaggccuguguguugcuuagccgaaagaggcaucguuuucucuuuaggugagaaggguuucgggguaucggcgcaaggcuccgacggggguggggguggggaugggguggggggagguggggggggcgcggccuaggguauggggcgcuucuugcaaucuccccuaaacggugacgcuuggucgggcuccucuguuuauucuuuggugccugugggauugagaccucgaagucggaggcggucuuugguaucccggucauuuuugcuaaucuuugggccuagaaacugcguggggaagaagcggggggagggugagaagagggggaggggugggcgggcgcgaggaugugagaucccaggacgacuuagaggcguuuagguugcuggagaugggaagcacccgggcccugcgggauuuuuucucugcagccccaggagacaagccuuuuuuugauuggguuguggugcaguuccagguauuuagguaucuuuucuacuccauauccugaaggauauccuuggguuuauuucuaggcgaggggggacuuaacacaggguuuugcuuccagaggacccuaguauacuacuuuuugugauguccagccuuaaugggaccucaaguguuuccccacuuucugggcaaauuucgaggaguaauuaggcccuaucuuuauuuacuuauuuauuccaugaaggaugaagggcagguuaacgugggcugaugcgaaguaagauuuauugcaagggaaaaugccuggcaggccuccucuuaaccaaucaagcacguuuauuagguugaagcuguuuuucugugugcuucugauuugccucuugacgggucugaaaauuuggguagucaauaugaaauguauacacuuuuacccagguggcuggcuggcguuucaguuugacauuugaauuuucaucccacaaugugaauuaaguaauuuuuuuacucggagaugcauccuuggcguccaguggcaaaauaaaauuacaaggagcaugggucagaauugcauuucaaguuggcgaaaugugccuuugaguaacucuuagauuggcauauguuuuuagagcaauuuagcuagaauguagaauugggcaaugagccuaugauacguaugucuguauuucugcaugaacaagcaguagauuauauuuucuuuaccuuggggaaagauaugcuucaguucuuagauuguagaucucuaguuguguacacgauuguggccuugguuucugaauuugucaguaggcucaaauacaacaaaucuuuaucugugggguauuaggcacguaagugguacccaguauaacuuguuggccuguaauuaccaggcacucauguucauaugcauggaugguguaccuuacaguuaaauuaugaccucuagauuuuacuaaguuucacaaagucuacauuugaaacuauaguuugaagucggaucuucucaguuucuuuagaaugaacaaauuacguauauagaauuucugaauagaauaauuaauuuuacacaagggucaguuuuucuuacuagucuuggauuuuuguagaucuugaugauaagaguaauaaucauaacuaaguugagugcuuauugucguucuuuauaaucuugaugaauucucaaaccugugagguaaguacuugguuuugcccauuuuaccgaugaggaggaaagugagacauagaucaagaacuugaccgaaguuauacagcuuguaauugguggagcuggaauugaaccccaucuugacuucacagcuuauguucuuaaccacaaggcauuaaugcccccuucagcugccaggucuaaccugauuaugaccauuuaaauuuagcccaaguguuacaaugaaagaaguucauauuaccuacucugauuuguugcaggucuaugauuuuguagcuguuuauaauguuacauuuuuuguguccagguguacuauguagugagauaacugaaauauuuaaugcuaggagagucuuaagcuacaugaaaaaccucuaguaaagaacugcauauaugcauguagggaauuaauuaaaaagugugacacucccugaugauuuacuaugaaagagcuccaaguagguguucagaacugucucaggcugaagugucaucgaucuccuaaaccauaaucaugguuaaaggagaaucugacagguaaugcuugaguugaacccacaguaccaaaucccucuugagucuuuucuaaugugaggcagaaauaauauaagcauuauuguuaauauuauuuuacacaguaguuccagauuuucucuuuaucaaauauuuugucaagcacuuaaaaagcaggaacaaagacuaguucuaauuuuuacuuguguuuauaaaaaaaaguaauauucuaggauucugugguggaaaaauggccagaagacaagaggaaggaaaauaaaccgaugaccuggcuaaaacauacacugacuaaucaguggcucagucuuuaaagguuuuguuguuuuuaaaggauuuuuuugguuguuuguguuguuugaaauaagauugacuugcuucuggcauuauaaaagauaaggucuuuuauaaucaccaagcucucaauguaguacuuggguaccugggugucacugcugauuauuuuuuaauuuuuaaauuuauuuuuuugagacagagucucacuuuguugcccaggcuggagugaaggggcgugaucuuggcuuacugccgccuccgccucccagguucaagugauucucaugccucagccucccaaguaacugggauuaacaggugugugccaccacgccuggcuaauuuuuguauuuuuaguagagagggaguuucaccauauuggcuaggcugguccugaacuccuggacucaagugaucuaccugccuuggccucccaaagugcugggauuacaggugugauccaccgcgccuggcucucugcugguuauucagggcccaagggcucuucaguuaucaggugauguaugcugcuaggacugggaccuucccuucagggcagcagauucccuucuggcccaggaugugucuagaauugucauccuggagcuagggccuggaauggaggcuucaugacugaugaacuuuaauuuguuuucuuuauuuuuauuuuuuuugagauggagucucacucuguugcccaggcuggagugcaauggcaccaucuuggcucacuacaaccuuugccuccuggguucaagcgauucuccugccucagccucccaaguagcugggauuacaggcaagugccaccacaccuggccaauuuuuguauuuuuaguagagacgggguuucaccauguuggccagccaggcuggucucaaacuccugaccucaggugaucugcccgccucugccucccaaagugcugggauuacaggugugagccacugcgcuuggccuuaauuuauuugcauauaaagauuucaguauugggagauuuggugaaauuugucauucuaauccuuauggcaauugauuacuugaaaagcugacagcuauauuaccuuguuauugaucuuaaauauaaaaaggcagaaguugucuaaauugagagauuuugaaugucuuagaaaguaucuguuaaggugguaguuuacaagcaguuacauuguaaccuaauuguugaaaaauguuaucugugaaauacuugcauuuccacuaugaaaagcaugaaaccaggcccuuggagggggaggagaugcaaauuuuauaaagguuuuuaaaaagcauuuaaauaucaauggcuugguuauguaauggguuggggugaaaagaaagacauuugugaccuuaauuuuuaucaggcccaguuuuauuauuggccacccuuggcauaguuggccuugagcuuucaguuauguauuguauuucuagagauaagauaaauguaguacuuaaaauaauauuuaaguauugauguaggugugugaaauaauuguuucauaaguaauuguaugugucuuuuucacuuuuggggucugaauaaacuuauggguuggguaauaggauacgggcaauucuugaauuuacaugaagugcuuucccccagaccgugaauguucuuuuggauaucagaaacuauuuaaauaguugaagccagugaaaacugaugcauagaucuuccuuuagaaauguugaauauaacagggcagugaaaggagggucuaagcagucugucucuaauuuuauccuaaugcuugucuuaugaucagcuuggaagcugacaugcaagauguuuaacuucuauuuuuccaucuguaaaaugggaauaagcucaaaugggaguaaauaucaauauuuaucaauaauagauauugauaaagucuaaagguauucugaaggagguaacauguuuguaacaaugguucuuaaaagagaaacuaaagcucugggguccuaguuuuuuuuuuuuuuuuuuuuuuuugagacagagucucacuauguugcccaggcuggaguacaguggcacgaucucaggucacugcaaacuccgcccuccggguucacgccauucuccugccucagccucccgaguagccgggacuacaggcaccugccaccaugugcggcuaauuguuuguauuuuuaguacagacaggguuucaccguguuggccaggauggucucgaucuccugaccucgugauuuccacccgcuucggccuccaaagugcuaggauuacaggugugagccaccgcgcccggcuguuaauuuuuaagagugaaaagaggugcugcgacuaaaugguuugagaacugcuuguauagaggaaugaacacugaacugugagccaagccuugguuuuucaguuauagcucuguugcuugauuguaugacuguggacaaaucauuuaucuguuccaggcuucugcuuugucauuugcagaacgaacaagacuagauggucuguagcauuaauuuuuuuuugggacaaggucucacugucacccaagcuguagugcagugacacugaacauggcucacuguagccuugaccuccuggcucaagcaauccuccugcuucagccucccauguagcugggaccacaggugugucaucaugccccgcuaauuuuuugauuuuuuuguagaaacaguggucucacuuuguugcccagucuggucuugaacuccuggacuuaagcgauccuccugccuuggccucccaaagugcugggauuacagguguaaaccaccauacccugccuaaaguuaguuuuuaaaaaauucugcuuacaggccacgugcaguggcucacgccuguaaucccagcacuuugggaggccgaggcagguggaucaugaggucaggaguucaagaccagccuggccaagauggugaaaccccaucucuacuaaaaauacaaaaaaaaaucaucucggugugguggugggcaccuguaaucucagcuacuagggaggcugagacagagaauugcuugaacccaggaggcggagguugcagugagcugagauugcgccacugcagccugggcgacagggugagagucugucucaaaaacaaaaacaaaaacaaauaagcaaaaaauucugcuuauaugaguguuuaucauuuucucuuaucugccuuuuguggguuagggagaaggguaguggugagauaaaguuucuuuauucaguguauuuauaucuuuuugccuuaaaacuuacaugguuagguuacagguguuuuguugcugauacuugucauaguaucauguauaccugguuguauaaacauuuauuggaaaggaaaaaacauuuuuguuggaaaguuugguaauuauuguggcuuaggauauguucuauuuugaaagauugcuauauccaguauauuucugcccuuuuaugauugaagauguacgucugaaaauaccuauguuaguucuagccgguuguucuuuuugcgcugggaagucuuugaauuuugcacuguagcugcuauuuucagauccugucucugaaacuuugucucucaguuuuagcuugaaguagccauuuccuguaucuguaguccagcacucuuguuaacugucccauacaauauuuguuaagaaauuauuguucuggcaguaguauucacauguauauauccugcacuccauauuuugggggaaugcuuuauuaguugaucaaauacuuaaguaucaauuuggggccaggcauggcacuguguuaggguuaugccaaagguaauaaaauuccugccaucuuaaggcauucuuagucaagugagggagauugguaaguaaaugagcaauuagaaagcagugcuaaaauauggaaauauauugauugcgcuagggaucagaaaugaaagaaagccuaauuugggggaugucuaggaaaguuuugcaaaggagauguuaacuguauugagucuugaaugaguuagcaguuaaggguugacugugagagggcaguccagacagcuauuaguaugguuaaagauuagucuuauuuuccauauaucagaggaaauaagacauguacacgauuaguuuuggugcaagauauaaagugauaaaugcugcaugaaguaaaaguaaguuguugugugaguucaaaguagaaagacauuucugguggggaccaaggaaagcuuuauagagagauagcauuugagccgggcgccguggcucacaccuguaauccuagcacuuugggaggcugaggcggguggaucacgaggucaggagaucgagaccauccuggcuaacauggugaaaacccgucucuacuaaaaauacaaaaaaaaaaaaaaaaaaaaaaaaauccgggcaugguggcgggcgccuguagugccagcugcucgggaaguugaggcaggagaacuucgugaaccugggaggcggagcuugcagugggccgagaucgcgccacugcacucuagucugggcaacagagcgagacuccguuucaaaaaaaagaaaaaagagagauagcauuugaaucuaguccuuggaauauagguacaguuuugacaaaggagacugugggagaauuccagaugugaggaguagcagcuugagcaaaggaauguuguguauauuagcauuuucuauuuggaagaaggucaacaucgaauuuuaaacuuaauuucuggacaaauacuguauaacuauugugccuuuuuuuuuuuuuuugagacguagucucgcucugucacccaggcuggagugcaguggcaugaucuuggcucacugcaaccuccgcuucccggguucaagcgauucuccugccucagcuucccgaguagcuuggacuacaggcgugugccaccaugccuagcuaauuuuuguauuuuuaguagagaugggauuucaccguguuggccaggauggucuugaucuccugaccucaugauccgcccgccuuggccucccaaagugcugggauuacaggcgugagccaccgcgcccugccuauugugcuuuuuuuuuuuuuuuuaagagacagggacuuccucugucacccagccuggagugcaguggggugaucauagcucauagcuuacugcauccuagaacucccgggcucaagugauccucccaccugagccuccugaguagcugggaccacaggcaugugccacuaugcccagcuacuauugugcauuuuguaugguagcuuuuguggcuugaugaucuuguaaaagguacaugugccuuugugaaugggccugauaauuuuaguucagaauugucaaaaguauuaucuacuuuuuuuuuuuuuuuugagacagagucucacucugucacccgggcucaguggcaccaucucagcuuacugcaaccuccaccuccuggguucaagcgauucuucugccucagccuccgaguagcugggacuacaggugugagccaccaugccuggcuaguuuuuguauuuuuaguagagacggggugucaccauauuggccaggcuggucucgaacuccuagaccucgugaucugcccaccucggccucccaaagugcugggauuacaggcaugagccaccgcgccuggccaguauuaccuacuuuuaaauaagauuguguaggauuuaaugcacagauuuugaaucacugugauaaaaaugcauccuuaguugucuucauuuugcucauuugaagugcucaguugacuuuuggguggguaacauuugacuuauagaaucuaagauaaaaaauuauuucugaguaauacuggauuuguuauuuugcuuauuuggauuauauuaguuauuuuuugguuuauuugauagcauuccagauuuaguuuugcuauaaugcuuguuuugaaaauguggauuuuuuccaaaaggguugauauuucagggaacaauuugaagcauacgacaaaauuugcauuugcuuaugggggauuuugucugcagggucagggaucagcauacuguggccuaccaaccaguggccuguuuuuuguaaauaaaguucuuuuuuuuuguuuuugaucuuuguuuuguuuuguuuuguuuuguugagacggagucuugcucugucgcccaggcuggagugcgguggugugauguccgcucacugcaaccuccgccucuuggguucaagcgauucucaugccucagccucacgaguaggugggauuucaggcauuugccaccacgccuggcugauuuuuguauuuuuuuuuuuuuuuuuuuuuuuuuuuuuuuuaguagagacaggguuuuaccacauuggccuggcuggucuugaacuccugaccucaggugauccgccugccuuggccucccaaagugcagggauuauagaugugagccauguaaauaaaguucuauuggaauacaccuauguccauuuauuuacauugucuguggcugcuuuugcacuguaguugcagaguugaauagcugcagcagagaccuaguagcccacaaagccuaaaauguuuacugucuggcccuguauugaaagaguuugcugauuauugugcuagaugaaugcaggauacuacaccccucuaaaaagagcugcauagaaauacaugcauauagaugcacacacgucugacaucuaccagcuaccucauuucaccacuuggguuauaaaccacacauauuuacaucuguuguacaauuuucaauccgauuucagauaaccuuccuucuaccacuucacaauaauucaugagcugcaacccuuuugaugcccacuucacaagcaaacuucaggucuuuuucaaaguaaagugccacauuuauuguuauauuugagcauuuauuauuuaacaugucaaacugugcuaccauuuuucuuugguuucuuuguuuuaaaaaaagucacugaugaaauuuuugaauguugugcuucuaaccucauuuuuccuaugaguucuaugguguuaauugcacaauuuuacauaguuuggugguuuuuaggaacccauauguuacauuauugaggaacugacuaauuaucauccuguaaaaaguacuaauucauucaccaaacauuucuggggugauguaaauauuaagugaguuaaaugggcauaaagcacuuaugucuuuauuguuacucaaauauuaguuauuacugauuacuauuaccaugugucaggaacuguaauaaguagugcauugaugaacaagacagauaagggaccugucuccaugaagcuuacauuguauuuuuaaaaaucuauuaauauacauuuuggcuaguaaccgagcccuugccccacagaaaaguugugcuguuacacaaaauaauauuuuaagauccauccacaagucaaagacauuucacuuaaaacagcuuucucagcagugucuccuugauaggguauaauauuuuauugaauuauuguuuuuggcugggugcaguggcucaugccuguaaucccaccacuuuggguggccaaggcaggugguucuccugaggucaggaguucaagaccagccuggccaacauggugaaaccccgucucuacuaaaaauacaaaaauuagccgggcgugguggcgcaugccuguaaucccagcuacucaggaggcugaggcaaaauugcuugaagccgggaggcagagguuggagugagccgagauaucaccaccgcacuccggccugggcgacagaaugagauuccguuucaaaaauaaauaaauaaauaaauaaauaaauaaauaaauaaagaauuauuguuuuuaauuuuuguuuuuuucugagauaggcuguuacucugucacucaggcuggagugcauuggugcagucauggcucacugcagccuccgccucccugguugcaggugauacucccaccucagccucccgaauaucugggacuauaggugcaugccaccaugcugaguuaauuuuuguauuuuuuuguggagaugaguuuuugccauguugcccaggcugguaucgaacuccuggacucaagcuaucugcccucuuuggccucccaaagugcugggauuauaggcaugagccaccaaaccuggccaugugauuguuuuuuuguaacuguaaccucaggagaugaauccgaucuaucuuuagggagauaaagaguaaucaucccuuccuuuuuuuacuguauaaaagguuacaaaauauaauuucagacuuguagaaaauuuguaaaaauagcacaaagauucucagaugugcuucauccagaugcagcaagggguaacauuuuaccauguuuacuuuaucauccucuauuauuauuuuucugaauuguuucagaguaaauugcagacaugaugucccuuuacucccaaauacuuuaauacauauuucucgaaacuaggaauagucuguuacaugaucccaguauaguuagcaaaauuaaaaauuagcauuaaggcugagugcggccucccacaccuguuaucccagcacuuugggaggcugaggugggaggauuguuugaggccaggaauucaagaccagucuucucaacauagacccugucucuacaaaacaaacaaacaaacaaacaaacaaacaaacaaaaguacuaaauuagccgguguggagcaugccuggagucccagcuacucagaaagcuagagucaggaggaucacuugagccuagaaguuccaggcugccaugaacuaugaucaugccacugcagucuagugugaaugacagagugagacccccaucucuuaaaauaaaagagagauuagcauugauacaauaccauuuuuuuuuuuuugagacagagucucacacugucgcccaggcuggagugcgguggcgcgaucuuggcucacugcaagcuccgccugcuggguucacgccauucuccugccucagccucccgaguagcugggucuacagguucccgccaucacgcccagcuaauuuuuuguauuuuuagucgagacggguuuucaccguguuagccaggauggucucgaucuccugaccucaugauccgccugccucggccucccaaagugcugggauuacaggcgugagccacugcacccggccgauacaauaccauuuuuaaucuacagaccuuauucacauuuuaccaauugcuucaugacauccuucaugaugaaagacaaaaaguucuuguuuucugaucuaccaucuaauucuagaacacucauuauauuucauugucaucuggaacagcucaccuugccauuuuuuuuuuuuugagacaguuuugcucuuguugcccaggcuggagugcaauggcauagucuuggcucacugcaaccuccaucucccagguucaagugauucuccuaccucagccacccgaguaacugggacuacagacaugccccaccacgcacggcuaauuuuguauuuuuaguagagaugggguugcaccauauuggucaggcuggucuugaacuccugaccucagguggucugcccgccucggacucccaaagugcugggauuacagaugugagccacugcgcccggccucuucuccauuuuuaaaagaacacaggccaguugauuugaauuugucugauguuucccuuugauuauauauuuugguaggaacacuaugaagugauguuuuguccuucacagcacauuuuaucaggagguguauaaugccuuugcuuuuacuauguuuuagaaugauuuugcuuuguuuuuuuuuuucugagacagagucuugcucugucgcccaggcuggugugcagacgugcgaucucggcucacugcagccuccgccuccuggguccaggcgauucuccugccucagccuccugaguagcugggacuacaggcgugcaccaccaugcccagcuaauuuuuauauuuuuaguagagacgggguuucacuguguugaucaggauggucucgauauccugacuucgugauccgcccgccuuggccuuucaaagugcugggauuacaggcgugagccaucgugccuggccgauuuugcuucucaugcuaaaauuauuaaucagcucauucucugccauuuuauuuagagguuugaaguuuggcuugauuaauuucuacagaauuggggagaguuuucccaccucccauuuuucuugcuuuuuccauuuccuccuuccucagauacccccaaaguucaaaaccaaccaccccgauuaugaauuuucauuuuguauucugaacauauagcuaaaagcagagaauuaagggugaauguuucauguuaaagugauuggaccuguuguuaagcauaugaaauaauauauuuccuucaaaggcugacuauacuauagugcauccaacauagcuuguugaauaucucaguucuuuuuuuuuuuuuuuuuuuuuuuuuagcugaaauuugccacagggaaauaucucuccagccugggcaacauagugagacucugucucaaaaaaaaaaaaaaaauuagccaggugugguggugcacaacuguaguccuaaauacuugggaggcugaggagggaggauccuuugagcacaggagucugaggcugcagugagcuaugauuauaccacuguacucuagccugggagacagagcaagaccccgucucucaaaaaaaaaaaaaaauugguggugaaauacacauaccacaagauuuagcauuuuaaccauuaaaaaaguuuguuuuuggcuggguguggugacucacgccuuugggagugaucccagcacuuugggaggccgaggcggauggaucacgaggucaagagauggagaccauccuguccaaaauggugaaacccugucucuacuaaaaauacaaaaaaaaaaacuagcugggcauggugguguaugccugaagucccagcuacucgggaggcugaggcaggagaauugcuugaacccagggggcagagguugcagugagccgagauggcgccacugcccgccagccuggagacagaacgagacucugucucaaaaaaaagcuuuuuuuuuuuuuuuuuugagagaagggaucucgcuauguuucccaggcuggucucaaacuucuggccucaagcaauccuucugcuucggccucccaaaguacugggauuacaagagugagccacuguaccuggccucauuuuucuauuuugauaaacacuuuuuuuuuuuuuuuugagacggauucuugcuguguugcccaggcuggagugcaguggcaugaucuuggcucacugcaccucugccucccggguucucugccucccggguucaagcaauucugccucagccuccugaguagccgggacuacaggcguaugccaccgugcccagcuaauuuuuuuuguaguuuuaguagagacggguuuuccccauguuggucaggauggucucgaacuccugaccucaggugauccgcccgccucggccucccacagugcugggauuacaggcgugagccaccaugccuggcugauaaacacuuuuaaggcuuaacaugagcuaaguauuauuuuagaacagauugucucaaccuuggcacuauagacauuuuguccagaaaauuuuuuguuagaggcuguccugugaaugcauuuuaucccugaccucuacccacuagauaccaguaacaccccuacccugaguugugacaagcaaaaauauuuccagaaauugccagauguucccugugggcgguauggguuugagaaccacuuuucuagauaauaggcauuuguagauaaugaauacugagcuaaguggaggaguaaaugguugaaauagacuaugugguuaaguacaguuacagagauauaaaccaagagauguggaagaauagcaaaaaauuuccuuagagaguugauagcaaguauuuucccaagagagacagcaauucugaguugggucauuggggaugguggggggaaaugugcugaggagggggaaauauucuaggugguggaacggguuaugucuagagauacgguagaggagcccuugggugccuugagaaaaaugagauaauaaguaugauuggagagaauaugggagguagaauuggaaagaaggaugcuaguuggggucagguuugagaaaggcuuuuuuuuuuuuuugagacggagucuugcccugucacccaggcuggagugcagugccucacucggcucacugcaaccuccgccuucuggguuuaagugauucuucugccucagccucuugaguagcuggcauuacaggugcgugccaccacuuccggcuaauuuuguauuuuuaguagagaccggguuucaccauguuggccagacuagucucagaacuccugaccuugugauccgccagccucggccucccaaagugcugggauuacaggcaugaaccaccacgcccggccgagaaaggcuuuuuaugcuaugcuaaaauguuucauuuucccccuuucauuauagaaaaucaacaaauacuuuuaaagucuguagaguuauaugaucagcuuuuuaaaagaauagugauacagugaaaugguaaaaauggucaauggugaauauuaaacucaagaagauaacucuagccuguaaaguaggaaaauaggaagggauggagauuuauauaaaacuaaaacuagaugucauauguugcccuuaaaucacaucacccuguguguagacuucuucauccucauuugucaaaauucugacauauugucaauacugaugaagauucuugauauucaaagcaggagugaagugggcaaaaaucuguauucuaauuuucauuacccuaauaauguccuuuuaauuuggagcaguucuguggccucucuuugucuguccugaucuugacauuuuugaagaguauagaacaauuauuuuuuagaauguaucucuauuuggguuugugugaugcuucuuuaugauuagaugaaggguaugcauuuuuggaagaaauaacagaagugaugguauguuguuuucagugccucuguaacaggagaugcaugacauugguuggucccauuacugaugaugguaauuuuaaucacuugggugguuuccaguagauuuuucuauguaaaguuuaucauuuuuggccgggcaugguggcucacgccuguaaugccagcacuuugggaggcugaggcaagcagauuacuugaggucaggaguuugagaccagucugaccaauguggugaaaccccaucucuaaaaaaauacauaaauuagccaggcaugguggcaugcgucuguaaucccagcugcucaggaggcugaggcaggagaaucacuugaacccuggagguggagguugcagugagccgagauugugccacugcacuucagccugggugacagagugagacuccgugucaaaaaaaaaaaaaaguuuaucauuucccauuuuuauuuugaaacagucuugcucuguugccuaggcuggagugcauuggcacaaucucagcucacugcagccucaaccuccugggcucaagugauccucccaccucagucuccucaguagcguguuccaccacacccggcugcuuuuuguauuuuuugguagagguggaguuucaccauguugcucaggcuggucuggaaccccugagcucaagggcacugaucaccucagccucccaaaguguugggauuacaggugugagccaccacgccuggcccugaaaaauauuuuuaacgguuacauuaucauggagaauuggaugguauaaaacaauagcaguucucauauuugaaaauaaauugauguaaugaaacaaaugagaggaucaaauaauauuguaaaaagaauaaaaacccacauauggacaggucuguggaaauuguauuaaagacuaccucucccagauuguuuccguuuguugcaauccauuuaagaacaguuuuugggcugggcacgguggcucacgccugucaucccagcacuuugggaggcccaggcagguguaucaugaggucagauuucaagaccagccuggccaacauggugaaacccugucucuacuaaaaauauaaaaauuagcugggcaugguggcaugcacuuguaaucccagguacucgggaggcugaggcaggagaauugcuugaaccaggacucgggagguggagguugcagugagccaagauagcaccacugcacuccagccuggccugggcuacagggugagacucagucucaaaaaaaaaaaaaacaaacaaaaaacaguuugugggaaaaaacaauccuuguguaugacauaauuugcugcuuuucccauuuagaaaauuuaaaaaauacuuauuugagauggggucucacuauguuguccaggcuagggugcaguggcuauucacaggugugaacauaguacacuacagccucguacuccuggccuuagcaucuugaguagcugggacugcaggugcacaucacagugccucgcuuacuuuuuccauuuuugucuguugauccucucucucuuccuuugggguaaaaauuguggcuugugauggugguuuguggggaaagaaaaaguugguaagcuacaagcucugagccuuuaauguguuuuuguuaaccaugcagacagacauuagauacauagauacaacauagaugaguuaaauuugaaagaaggcaccaaacuuuguuacuuuaaagcaggauuucucaaagggacacuguugacauugauuucagaagugagauuuucaugguuuuuaauguuauuauuauaaugguauggauaguguuuugcccucuaagaaguagcuaggaguguuuccauagaugcauuuaguuuauaucacuuauguauucugucucuauuuuguaagaaaauugccuaugaacagaauuuuuucuguauguggauuuaaugucuucuucuaaaggaaacaugggugugguucacauuuccuuaguuuugaguagcauggcuuaaguugugauccaauuuuaaaaaaucaguugaauaaauaaauagaaaauaaaaggauaauuucuguacuaaaaaagucagcuggacaguuaaaacaucuccuuuuauucguaaguuuuucaauaaaaauuguuaaaagcaguauucauuuguguaaugauauaaucuuuguuauuguuuuaugugcuuuucuaaaaugcaggaaacauaagguaaggagaagucuuuccuuacccugggaccagaugucuaugaggacuguugacuuuucugcuauaaacaggaugauaaauuaacaguggugugauagguaaaguagauuuguuaugacauaucuuccauuaagcgauaauaacuugauuuuuacuuaguugaugaaauaaaauaacuuugaaaccuuggguaacaugaaauugaaucaaaauauuuucaaguuauggaacauaguguuauuaauagaauggaguguugaaaaagcacuggauuaugcuuucuguaacuuuuaguucugggucuuaugauaacugugacccugagccucaguguuuuccuuuuaaucuguagugauauuuuuuaguucagucucucauuuuaaacugcuuuuagcucuaaaauuuuaucucagugaccuguugaguuauauaacaaucguaucagguaaccuagauaagaagaggaaggcaguaacauuucagaaauacaguuugggguugggaauccuuaagugauccagacuucuccuuugguccgaagauagugugaauaaaacagcugagggaugugggcaucaauauauugcagaggaaaagguuauuuccaggaguggauuugcagcuacucuuaaaucuauuauguuggggcugggcacuggggcucauggcuguaaucccagcacuuugggaggcugaggcgggcggaucaccugaggucaggaguucaagaccagccuggccaacguggugaaacccugucucuacaaaaauacaaaauuuugccgagcaugauggcgggugccuauaauuccagcuacuugggaggcugaggugagagaauugcuugaacccaggagucggagguugcagugagcugagauugugccauugcacuccugccugggugacagagcgagacucugucucaaaaagaaaaaaaaaaucuauuauguuggauagauggucuuuuccagaagcaaauuuuauagauggaaagcauuuuaauuaaucuaguaaaauucucucauuuuacaaaugaggcucccucuaccucucucccccucucccccucucccucucucccucucucccucucucccucuccccacggucucccucucccucucuuuccacggucucccucugaugccgagccgaagcuggacuguacugcugccaucucggcucacugcaaccucccugccugauucuccugccucagccugccgagugccugcgauugcaggcgcgcgccaccacaccugacugguuuucguauuuuuuugguggagaugggguuucgcuguguuggccgggcuggucuccagcuccuaaccgcgagugauccgccagccucggccucccgaggugccgggauugcagacggagucucguucacucagugcucaauggugcccaggcuggagugcaguggcgugaucucggcucgcuacaaccucaccucccagccaccugccuuggccucccaaagugccgagauugcagccucugcccggccgccaccccgucugggaagugaggagcgucucugccuggccgcccaucgucugggaugugaggagccccucugccuggcugcccagucuggaaagugaggagcgucucugcccggccgccaucccaucuaggaagugaggagcgccuuuucccggccgccaucccaucuaggaagugaggagcgucucugcccggccgcucaucgucugagauguggggagcgccucugccccgccgccccgucugggaugugaggagcgccucugcccggcugcgaccccgucugggaggugaggagcgucucugccuggccgccccgucugagaagugaggagacccucugcguggcaaccgccucgucugagaauugaggagccccuccgccuggcagccgccccgucugagaagugaggagccccucugccccgcugccaccccgucugggaagugaggagcgucuccgcccggcagccaccccguccaggagggaggugggggggucagccccccgcccggccagccgccccgucggggaggugaggggcgccucugcccggccgccccugcugggaagugaggagccccucugcccggccaccaccccgucugggaggugugcccagcggcucauugagaacgggccaugaugacaguggcgguuuuguggaauagaaaggggggaaagguggggaaaagauugagaaaucggaugguugccgugucuguguagaaagagguagacaugggagacuucauuuuguucuguacuaagaaaaauucuucugccuugggauccuguugaucugugaccuuacccccaacccugugcucucugaaacaugugcuguguccacucaggguuaaauggauuaagggcggugcaagaugugcuuuguuaaacagaugcuugaaggcagcaugcucguuaagaaucaucaccacucccuaaucucaaguacccagggacacaaacacuguggaaggccgcaggguccucugccuaggaaaaccagagaccuuuguucacuuguuuaucugcugaccuucccuccacuauuguccuaugacccugccaaaucccccucugcgagaaacacccaagaaugaucaauaaaaaaaauaaaaauaaaaauaaaaaaaauuaaaaaaaaaugagaaaauugagcucuccugagguugcaguuugcuuaacagcauagaucuaauuaguaauuaggacuagaaccaagguuaucugacucccaguucaagguucuugguacaguaccguguuuuuaacuaguccauuagguuguuuucuguguauuuuauaacacuucuguaagaaaguggaauauuuuucucuaagguauguuaaaacucuuguucgagaaaauacaguaaaggauaccuguuguaucuuaaagugauuuuuauguuuuucugucaaugccacaaucugaagaaaguaaauuagcuacacuucuauugcugugacaauagauuauuuagaaucuucuugauuacuuguauuauuguucccgugcuucagagcuguuuccuugcuauuuaaaaucauuaugguauagcccagaggcuaaggggguuuucuaagaguaugcaauuugucauugacauaguuuuuuuguuuguuuuuguuuguuuuguuuguuuuugagacagaguuuuugcucuguugcccaggcuggagugcaauggugugaucucggcucacugcaaccuccaccuccuggguuaaagcaauucuccugccucagccucccgaguagcugggauuacaggcacccaccaccacaccugacuaauuuuuguagaggcaggguuucaccaugucggcgaggcuggucuugaacucuugaccucaugugauccaccugccucggccugugaggauuacaggcaugagccaccgcacccugccaacacaguuguuuuugauuggaaaaguuuauuuuccuaaucucaaaguagcuuguaucuguucuuuauugugaaaugcaguuucuacauugaauuuguguagucuguaguuuugacuguuuuaaguucaauaacuagcuuaguaguauacuuguuagaggucagaguagguuaacuacuagaaagaacaguccuucugcuuacuguacuaggaggaagucugugguggagggaaaaaaggaguaaaacaauuccagucuucuguaaaauuugaguaauuucuuucucuacuccuucuacaugaaaaauacaucuuauuugauuuuugcaucacaugccuucuauauguguuggaaucuggaucaccauuucuucauuacuuguggguuuuuguugugaaaaauguggaguaaguuagaaguugacuguagaauagguaacauucucuuaaauucuuugaucagagugagcagaguccagaagcuuggcucagacuuagggaacucaugacacuucucuuaauauccuaaguucaugacaugucucuuaauacccuaaguguacaauacaauaguagaucaaggaaggcagagguaucuggcagacuuagaaguaacuguucauaaaaacaaggaucaguauguuucuacaagauaaugauuuaaaguugagccaggauuaguuauaccuuuaauauaaaaaauugaaauagcuuauuuaaucuguucuaggcuauaguauacggagcuagguauuaaaacauucucuauauauuuaacucuuuuuuuugagacagggucucacucugucucccaggcuagaguacaguggcaugaucuuggaucacugcagccuagaccuccugggcacaagugauucucccaccuuagccuccacaguagcugggacuacaggccuuugccaccacaccuggcucauuuuuguauuuuuuguugagacgggguuucaccuuguugcccaggcuggucuuaaaccccuaagcucaagugauccgcuugccucagccucccaaagugcugggauuacaggugugcaccacugcgcccaggcuauuugacuuuuuuauucuguaaaauugcaagcauauucagaaauaagaaaauaguauaacggggccgggugugguggcucacgccuguaaucccagcacuuugggaggcugaggcagguagaucacgaggucaggaguucgagaccagccuggccaacauggugaaaccccgucucuacuaaaaauacaaaaauuagccaggcgugguggugggcgccuguaauccuagcuacucgggaggccgaggcaggagaauuucuugaaccagggaggcggagguugcagugagccgagaucgugccacugcacuccagccugggugacagagcaagacucauuuuuuuuuuuuuuuuuuuuaaaaaaaagaaaaaagaaaauaguauaauggguugggcccgguggcucacgccuguaauccagcacuuugggaggccaaggugggcggaucaccugaggucaggaguucaagaccagccuggccaacauggugaacucuuguuucuacuaaaaacacaaaaauuagcugggcaugguggcaggcaccuguaaucccagcuacuugggaggcugaguuaggagacucacuugaaccugggagguggagguuucagugagccaagauugugccauugcaguccagccugggcaacaagagcgagacuccaucccaaaaaaaacaaaaaacaaaagacaacuauauauauauauauaaaauaacgaaacccccuaaguaccugucacccagcuucaacaauuaucaucuugcaguuaguugaauuugguuaacacuuacccuucaguggauuauucuagacuaaauuuccaaacauaaucauauuguauugaaguguuuuuugaacaaacuauacuaugggguauuuaccuaaaaugaacuauuugcaaaaagauaaguugauuuuuuuucuucuggugccaguacacaucauaauuguaguuaaaagcuauuauccucacauuaaaguuuaauuuuuaacacauuaugaaaauuuaaaacuuacagcaaagcuuuaaaaauuuuacacugaacaccaauauuauuaacaucuagauucuaccuuuaacauuuuacucuucuuuuuuuuuuacucuucuuguuuuaucacauauugauccaucuguccaacucuccauugauguaacauuucauuuuauuuucuuauucauuucaaaguaaauuacagauauuaguauaguugagguucaguuuuuaaagucauauuuucaacuaauuguuuuuccuguuuugaaagacuguuauaucugaaguuccacauuaugacaacucauagucucuaugguuccagugcuucccauuuugaacuuuucuuucauguucuacgaaccuuuauuaaaauauuuagagcuauguacaaguaauauauacaguauuuagcuaaaacuaaguagaaugaaugaggguuuugcuuguguguuuauugcagucuuuaaaaaaaaucucuucuagugagucaauguguaucuuuuuuuuuuuuuuuuuuuuuuuugagacagagucuugcucugucgcccaggcuggagugcaguggcgugaucucugcucacugcaaagcuccaccucccggauucaugccauucuccugccucagccucccgaguagcugcgacuacaggcgccugccaccacgccuggcuaauuuuuuuuguauuuuuuguagagaugggguuucauuauguuagccaggauggucuugaucuccugaccucgugaucugcccgccucggccucccaaaaugcugggauuacaggcaugagccaccgcgccuggccaagucauugcguaucuuaagaugguacacuaaacuaauaugcuugccauuggugacaacauagaugaaccuggaggacauuauggcaagugaaguuagccagacguggaaaaaauaauacuucaugacuucaaccuauauguggaaucuaagaaugccaagucugcaaaagaagagaguagaaaaguaguuaaauggguaggaaggugggagaaauggggagauauugguuaaagguuaccaaguuggaaucacguaggaugacuaggucuagagaucuaauguacagcaugaacacuauaguuaauaauacuguaucauguacuggaaaguuguuaaaagaguagauuucagguguuuucagcacacacagaaaaagauaacuauauguggagaugggacauuuugcuugaccauaguaaucauuucacuauguauauguauaucaaaacauucauguuguacacuuuauugauugauugauugagacagggucucucgcuguugccucagcuggagugcagaggcaugaucacaguucacugccugcuugaccucccaggcucaagcgaucaucccaccucagccccccaaguagcugggacuacagguguaugcuaccaugccuggcuaauuuuuauaguuuuuguagagauggguuuugccguguugcccgggcugguauugaacuccugagcucaagcaaucugcccgccucugccucccaaagugcuaggauuacagauaugagccacugcgccuggccauacccuuuaaauauauacauaaaaagaagaaugccuuuaaaaauuuuccauuuaacaauuacucucagggccaaaacucacuguuuaaguauuuugcucuuuuacuuugaucuugguguucuauguagugcuaaaauauacuuucaucuccauaugacugcuuguaacaaaaagcuguucaccacauuaugaacucccugaauacacacaauaaucauauaguaaaugcuuguugaauaaacaagacaaaauucaucaguuuuuauccuuacuuaauuuuuugaacuuuuccuugaacuucuguuaucaaacuuaauacaugaacaacagaaagaugcuacggaucuauguaguacaaaguaaaauaugaaauuuacacacuaaauauuucuguagcauauuuucagaaguaaguaauugaauauaaacagaagcaagcauauucuauuuuuuuauuauuuaagugggaaauauuuuaaaaucuuaugucauauuugcuuuagauuucuuuuaaagaauuaaaacauuacagauagaguugaagccucauggguuauuuuaauguuuucuacauaaacauguuuccauauacauaaaccuuauuuagaauuuuuucaguuuauuuauuuauuuuuauuauuauacuuuaaguuuuaggguacaugugcacauugugcagguuacauacguauacaugugccaugcuggugugcugcacccacuaacuugucaucuagcauuagguauaucucccaaagcuaucccuccccccuccccccuccccccaccccacaacaguccccagagugugauguuccccuuccuguguccaugugaucucauuguucaguucccaccuaugaaugagaauaugugguguuugguuuuuuguucuugcgauaguuuacugagaaugaaauuuuuucaguuuuauacguuuauguaaguggcaccauacaguacauauuauuuugcaacuugccuuuuuuuuuuuuguuuguuugcucaauguuguuuuuaggauuuugauguaacuccagaucugcacuguccaauacaauagccacuaacuaucuguggcuauugaguacuggaaauguagcuaguccacauugagaugugcuagaaauauauuuguacauggaauuucaaauauuuaguauuaaaaacauguaaaauaucucacuaaaaguuuaguaucccuaagaaucugaaauagaaaaugcuccaaaacccaaaauuuuuugauuacugacaugacucucaaaggaaaugcucaaagguuuaaugcaaauauuccaaaaucugaaaaaaucugauauauugaccacauauggaacugauaauaguuuggauguauuggauuaaauaaaauguaaaaauuuuaccagugguuuccuuuuuuaaaauauggcuacuagaaaauuuaaauauauauuugaaaugccuuacauuauaugucuguugggcagcacugaucuauauugcccacuuuucauuccuguuuauuuauuauuauuuuauuuuuauuuuuauuuuuugagacagagucucgcugggucgcccaggcuggagugcaguggugcuaucuuugcucacugcagcugcugccucccagguccaagcaauucucuugccuuggccucccaagcagcugcgauuacagcugugcaccaccacacuuggcuaauuuuuguauuuuuaguagagacgggguuucucuguguuggccaggcuggucucgaacuccugaccucaagugauccaccugccuuggccucccaaagugcugggauuacaggugugagucacugcucccagccuucacuccuguuuaguauuaaguuauauagauaauaguuugcuacugguggauaguuguuguuuuuuuuuuuuacgaauuuggugcuacuaaagacuguucucaugagcauucuuaaacaugucuccuuugcacauaugcuagaguuucuuucucccuaaugguucuucugauuuauacuuccacuggcaguuugagaauguucuuguucugcaguucuucauccuggucgauguuuuuguguagauaacuguaauuuaauacuuaaagucaaaagcauaaggaagcauugguaauuauuuaagugaauauaaaaugucagcuuauuuuucucagugaaucuuuuguaauagucaacucacauugccuauuuuuuauuguagugcuucugaucugaauaaauaaauuuaaaauuuaacagccauguuauguaucuuauuaguaggcagcugcaguuaugcaaccaaagaaugucccaucuuuaaguuccauuagcuugaaaaagaaauggcagcuuuacgucauggaauacugugcugccacuaaaaaugauguuuuagaagaauauuuaaugaugcagaaaaauauucacaguaucuuaauggaaagaaaagauuauaaagcaguaaccauuucguuuuguuaaaaucaggucuauguuagcuuuuuuuuuuugagauggaaucucgcucugucacccaggcuaaagugcaguggcgugaucucggcucacugcaaccuccgccuccuggguucaagugaugcuccugccucagccucccuaguagcugggauuacaggagcaugccaccacacccggcuaauuuuuuuguauuuuuaguagagaugggguuucaccauguuggccaggcuggucuugaacuccugaccucaagugauccacccgccuuggccucccaaagugcugggauuacaggugugagccaccgugcccggcgagcauuuccuuacaugcuuaucucuggauggucagauuguagguaacuucuauuuugcacuucacacuuuuuuuuuuuuucuugagauggaguuucgcucuuguugcccaggcuagagugcaauggcgucaucuuggcccacugcaaacuccgugucccggguucaagcgauucuccugccucagcuuccagaguagcugggauuacaggcgcccgccaccacaccugccuaauuuuuaguauuuuuaguagagacagagguucaccauguuggccaggcuggucucgaacuccugaccucaagugauccacucgccucggccucccaaagugcugggauuacaggcgugagccaccgugcccagccuguacuucacacuuuuaauauuucauuuucuguaguggauuuacuauuaccagggaaggggaaugcaaggaggagggaagaguucuuaaccuaaaauuuucauaguuggaauauuauuauaggaaagaagagauugaaugaggugucacuguucccauguuuaaagauaagucaauugggaggccgaggcaggugaaucacgaggucaggaguucaagaccagccuggccaauauggagaaaccccaucucuacuaaaaauacaaaaauuagcugagcgugguggcaggggccuguaaucccagcuacucgggaggcugagggaggagaauggcuugaacccagaggguggagguugcagugagcugagaucgugccacugcacuccagccugggcgacagagugagacuuugucuccaaaaaaaaaaaaaaagauaauacuuuccuucuauucaauuucaggcuuuucuuaaguuacaaauggaaccagccaaacuauguuauugcuuacccauuguuuuuccagcguuagaggaguuuuucaaagaauauuuuuugauuuagagauuauuuuauuuauuaucuauuuagagauuauucaucauuuagagauugccauuuaauuucaguaagaguuccauuugcaucugauauuuuuuaguuucggagaaaggaaaugguggagaaauggauucaucuccaauccuuuggaauaaaauucagacaguuuaagcucuagucucaacuugauuuaauuuggaauugcaugauguggugucagauuuggguucacauccaguucucuugcuguguaaccuugggaaauuuacccagcaucugaguuguuucuucaugugugcaguggagacaauaccaagaugaagauuucaugagaugucuaguguagacaucuauuuuucagaguggaugcauuuaacaguuggaugcugaauuuauaagaguauggauuucauaaaaagagcauaaauuucaugauaugauguauauaucaaaagauauaggucgggugcagugguucaugccuguagucccagcacuuugggaaguugaagcggauggaucacuugaugccaggaguucgagaccagccuggccaacauggugaaacuucgucucuacuaaaaauacaaaaauuagccaggcgugguggugugugccuguaaucccagcuacuugggaggcugaggcaggagaauugcuugaacccaggaggcagugguugcagugagccgauuuugugccacugcacuccagccugagugacagauugagacuccaucuuaaaaaaaaaaaaaugauggcugaauaggaacagcucuggucugcagcucccagugagaccaaaauguagaaggcgggggauuucuucauuuccaacugagguacccaguucaucucauugggacugguuaggcagugggugcagcccauggaggguagcagaagcaggguggggcgucgccucucccggaagugcaaggagcgagagaucucccuuccccaagccaaaggaacccgugagucuaugcuauccggcacagauacuacacuuuucccaugauuuuugcaguccgcagacccggagauuccuuagugugccaacuccaccagcccuggguuucaagcacaaaacugggcaucugggcagacagugagcuagcugcaggaguuuuuuuuuuuucccccucuucauaccccaguggugccuggaaccccagugagauagacccauucacuccccuggaaagggggcugaagccagggagcuagguggucuugcuuagcgggucccacucccacagaacccagcaagcuaagaaccacuggcuugaaauucucauugccaacacagcagucugaagcugaccugugaagauugagcuuggugaggggaggggcgucugccauuacugaggcuugaguaggcaguuuuccccugacagcacuaaggaggcugggaaguucagacugggcagaacucaccacagcguggcaaaguggcuauggccagacugcgucucuagauucuuccucucugggcagggcaucucugaaagaaaggcagcagccccagucaggggcuuauagauaaaacucacaucuuccugggacagauaaccugugggaaggugcagcugugggcgcagcuucagcagacuuaaauguuccugccugcuaggucugaagaaagcaguggauccugacaaggaggauucuccuagcacagcacuugagcucugcuaggggacagacugccuccucaagcgggucccugaccccagugccuccugacugggagagaccucccagcagggguugacagacacgucacacaggagagcucccgugggcaucaggcuggugcccuucugggacgaagcucccagaggaaggagcaggcagcaauauuugcuguucuccagccuccgcuggugauacccaggcaaacagggucaggaguggaccuuuagcaaauugcagcagaccugcauaagaggggccuguuagaugaaaaacuaacaaauagaaagcaauaauaucaacaucaacaaaaaggacccccacacaaaaaccccaucaaaaggucaucagccucaaagaucaaagguagauaaauccacgaagaugaggaaaacccagugcaaaaaugcuggaaauuccaaaaacccgaaugccucuucuccuucaaaugaacacagcuccucucuagcaaggccgcaaaacuggacggagaaugaguuugacgaauugacagaacuaggcuucagaagguggguaauaacaaacuccucugagcuaaaggagcauguucuaauccaauggaaggaagccaaggaacuugauaaaagguuacaagaacugcuaacuagaauaaccaguuuagaggacauaaaugaccugauggagcugaaaaacacagcacaagaacuucgugaagcauacacauguaucaauagucaaaucgcugaagcggaaaaaaggauaucagauauugaagaugaacuuacugaaauaaggcaugaagacaagauuagagaaaaaagguugaaaaggaacaaacaaagccucugaaaaaauaugggacuaugugaaaagaccaaaccuaugauugauuggggucccugaaagugauggggagaauggaaccaaguuggaaaacacacuucaggguauuauccaggagaacuuccacagccuaccaagacaggccaacguucaaaucaggaaauacagagaacaccacaaagauacuccuugagaagaccaaccccaagacacauaaucgucagauucuccaagguugaaaugaaggaaaaaauguuaagggcagccagagagaaaggucggguuacccacaaagggaagcucccagaggaaggauaucugggcagaaacccuacaagccagaagagagugggggccaauagucaacauucuuaaagaaaaaacuuuucaacccagaauuucacauccagccaaacuaagcuucguaagcgaaggaggaauaaaauccuuuacggacaaucaaaugcuaagagauuuugucaccacuagaccugccuuauaagagcucccgaaggaagcacuaaauacagaaaggaaaaacugguacuagccacugcaaaaacauuccaaauuguaaagaccaucgacacuauaaagaaacugcaucaacuaacggucagaauaaccagcuagcaucauaaugacaggaucaaauucacacauaauaauaugaaccuuaaauguaaaagggcuaaaugccccaauuaaaaggcacagacuggcaaauuggauaaagagucaagacccauuggugugcuguauucagaagacccaucugaugugcaaagacacacauaggcucaaaauaaaggguuggaggaauauuaaccaagcaaauggaaaaaacaaaaaaaaaagggguguuguaauccuagucucugauaaaacagacuuuaaaccaacaaaguucaaaaaaggacaaagaagggcauuacauaaugguuaagggaucgaugcaacaagaagagcuauuuuaaauguauaugcuuccaauacaggagcacccagauucauaaagcaaguucuuagagaccuacaaagagacuuagauucccacacaauaauagugggagacuuuaacaccacacugucaauauuagacagaucacugagacagaaaauuaacaaaaauauucaggacgugaacucagcucuggaccaagcagaccuaauaguaaccuacagaacucucuaccacagaucaacagaauauacguucuucucagcacaucacacuuauucacucaaaaccccacaacuacauggaaacugaacaaccugcuccugaaugacugcugguaaauaacgaaauuaaggcagaaauaaagaaguucuuugaaaccaaugagaacaaagagacaacguaccagaaaucucugggacacagauaaagcaguguuuagaggggaauuuauaucacuaaaugcccccaucagaaagcaggaaagaucuaaaaugaacacccugauaucacaauuaaaagaacuagagaaaaagagcaaacaaauucaaaagccagcagaagacaagaaauaacuaaguucagagcagaacugaaggagauagagacaugaaaaccucuccaaaaaucaaugaaucaaggagcugguuuuuugaaaagauuaacaaaauagaccaugagccagacuaauaaagaagaaaagagagaagaauuaaauagacacaauaaagaaugauaaaggggauaucaccacugaucccacagaaauacagacuaccaucagauaauauuauaaacaccucuacgcaaauaaacuagaaaaucuagaagaaauggauaaauuccuggaaacauauacccucccaaggcuaaaccaggaagaaguugacucccugaauagaccaauaacaaguucugaaauugaggcaguaauuaauagccuaccaaccaaaaaaagcccaggagcagauggauucacagccgaaugauaccagagguacaaagaggagcugguaccauucccucugaaacuauuccaagcaauagaaaaagaaggauuccuuccuaacucauuuuaugaggcaagcaucauccugauaccaaaaccugucagagacacaaccaaaaaaggaaauuucaggccaauaucccugaugaccaucgaugugaaaauccucaauaaaauacuggcaaacagaauccagcagcacaucaaaaagcuuauccaccauuaucaagucugcuucaucucugugaugcaaggcugguucaacauacgcaaaucaauaaaaguaaucaaucacauaaacggaaccagugacaagaaccacaugauuaucucaauggaugccgaaaaggccuucgauaaaauucaacaccccuucaugcuagaaacucucaauaaauuacguauugauggaacauauuucaaaauaauaagagcuauuuaugacaacccauagccaguaucauacugaaugggcaaaaguuggaagcauuccuuuugaaaaccagcacaagacaaggaugcccucucucaccacuccuauucaacauaguguuggaaguucuggcuaggcaagagaaagaaauaaagguuauucaaauagcaagacaggaaaucaaauuuucucuguuugcagaugacaugauuguauauuuagaaaaccccaucaucucaacccaaaaacuccuugagcugauaagcaacuucagcaaagucucaggauacaaaaucagugugcaaaaaucauaagcauuccuauguaccaauaauagacaaacagccaaauuaugaaggaacucccuuucacaauuacuacaaagagaauaaaauaccuaggaaugcaacuuacaaggggugugaagggccucuucaaggagaacuacaaaccacugcuugaggaaauaaggacgcaaacaaauggaaaaacauuccaugcucauggaugggaagaaucaauaucgugaaaauggccauacugcccaaaguaauuuacagagucaaugcuauuccuaucaagcuaccauugacuuucuucacagaacuaggaaaaacuacguagagccaaaacaauccuaagcaaaaagaacaaagcuggaggcauccugcuaccugaccucaaacuauacuacaaggcuccaguaaccaaaacagcaugguacugguaccaaaacagauauauagaacaauggaacagaaccgaggccucagaaauaacaccacacaucuacaaccaucugaucuucaacaaaucugacaaagacaagcaauggggaaaggauucccuguuuuauaaauggugcugggaaaacuggcuagccauaugcagaaaacagaaacuggaccccuucuuuagagcuuauacaaaaauuaacucaagaucgauuaaagacuuaaauguaaaaccuaaaaccauaaaaacccuagaagaaaaccuaggcaauaccguucaggacauaggcaugggcaaagacuuccaugacuaaaacaccaaaagcaauggcaacaaaagccaaaauugacaaaugagaucuaauuaaagagcuuccacacagcaaaaaaacuaucauuggagugaacaggcagccuacagaaugugagaaaauuuuugcaaucuaugcaucugacaaagggcuaauauccagaaucuacaaggaacuuaaauuacaagaagaaaacaacuccaucaaaaaguggguaaaggauaugaacagacauuucucaaaagaagacauuuauguggccaacaaaugugaaaaaaagcucaucaucacuggucauuagagaaaugcaaauuaaaaccacaaugagauaccaucucacgccaguuagaauggcgauuauuaaaaaggcaggaaacaacagaugcuggagaggauguggagaaauaggaacacuuuuacacuuuugguggaaggguaaauuaguucaaccauuguggaagacaguguggcuauuccucaaggaucuagaaaccagaaauacaauuugacccagcaaucccauuacuggguauauacccaaaggauuauaaaucauucuacuauaaagacacauguaccuguauguuuauugcagcacuauuuacaauagcaaagacuuggaaccaacucaaaugcccaucaaugacagacuggauaaggaaaauggggcacauauacaccaugaaauacuaugcagccauaaaaaagauugaguucgugucuuuugcagguacauggaugaagcuguaagccaucauugucagcagaguaacacaguaacagaaaaccaaacacugcacguucucacucauaagugggagucgaacagugagaacacaugggcacagggaggggaacguuacacauuggggccugucagggguuggggggcaaggggagggagugcauuaggacaaauauaaugcauguggggcuuaaaaccuagaugauggguugauaggugcagcaaaccaccauggcacaucuauaccuguguaacaaaccugcauguucugcacauguauuucagaucguaaaguaaaaaaaaaaagauauggaaguuacuaugcgcguuaauaaaauauguuuauaccuccucccuuaggugucuauuauguagaacaaguuuauuacauucuaaugauaaaguaaacacucuguuuucaaaggugguguuauacguuuguguaucuuuugccccgggcaugaugauuucaucguuuguguaauaaauuuaauacuaccauagucuccccuuauucacacgggauaaguuccaagaccccaauggaugccugaaacuguggauaguacugaauccuauauacacuuauguuuuuuuccuguacacucauauuuaugauaaaguuuaacuuauaaauugugcacagugagagacugacaauaacuauaauaaaauagaacaauuauaacaauauacuguaauaaaauuuaugugaauuugguuucaaaauaucuuauuguacuguacucacccuuaugaugaugauguuagaugauaaaaugcuuaugugaugugaugaagguaggugaauuauguuaggcauuguaaugcagcaugaagcuacuauugaccuucugguguuacaucagaaggaggaucaucugcuugggugguccugaaucaucacguccugaugaugucuguugcugguugucaggagcagacaguguccaugacuaaugggcaggcagcguauauagcauguauacacuggacaaagggaugucucauguccacggcuggacagagcaggagagugcaagauuuugucacacuacucagaaucgugcaguuuaaaacuuaccaauuguuuauuucuggaauuuuccguuuaauauuuuuggacugcaguugaccacagguaacugaauucauggaaagcaaaacaaccauggacaaagugggauuacuguauuauuucagauuuuaauuagcauuuuucaaaacucugucuagcuagugcuugcauuguagaauuugucugauuucauuuuuauugauuagggaaauaagcuuuauuuuuaucuggagugauuuguuucuuugugcuuccucaaaauugaguaguggcuacugaguauauaucgaaaaggaaauaaauuauuaugucaaaaagauaccuacauuuguauguugauuguagcacuguucacaagauuaaagauauggaaucaaccuaagugaugaagaaaauugguguguguguguguuuguguguauacauacacacuguggaauaauacuauucagccacaaaaaagaaaaaaaaaucaugucuuuugcagcaacauggaugggacuggaggccauuauccuaacugaaauaacucagaaagucaaauacuacauguucucacuuacaggugggaacuuaaaugguuacacauagaauagaguagaauaauagacauuggagacuccaaaaggugagaggguggcaggggggugaggguugaaaaauuaccuauugaguacuuuguucaguauuugggugauggguacacuaaaaucccacuuuaccaccaugcaauauaugcauguacgaaaucugcacuuguacccccuaaauauauacaaauaaaaguuuuuuaaaacacuuaguaaauagccugucauagggaauaauugaaaccauuucguaucucacuuuaaaaccuuuaggcugggugcuguugcuuaugccuauaauccuagcacucugggaggccgagguggguggaucaccugaggucaggaguucgagaccagccuggccaacauggcgaaaucccaucucuacuaaaaauauaaaaauuagccagucaugguggcacacgccuguaaugccagcuccuugggaggcugaggcgggaaaaucacuugaacccaggaggcggagguuacagugagccgagaucacaccacugcacuccagucugggcaacagagcgagacuccaucuccaaaaaaaaaaauaaaaauaaaaauaaaaaaccuuuuuaguucuguuucaauguuaucuucuuuuuauuuaauuauuuuuggaauaagaaauaauauuuauaugguuugaacaccaaaagguauaaaagauauuuuuaaagguauaaaguauaaaaguuagaaauuucccccacuucccuguucucuguucccacagcugccagcagcuuaccaccccccagcccaaucacugcuacugaugccuaaccuaucuuuccagaguucuuuguguguucaguagcaguuaaccacagaucuuuaaucauuccccuuuauaccauaaaagguggcauguuauguacacuugccuccccuuugcuuuuuccacuuaaugugucuugagaagcuuuccauauaucaguacauggaaaacuuucuuauauuguuuuauuuuaaauuuauauacaauaaaugcauggaucagaaaaauaauugaauagugggccccaaauuaaaugauuacucuaaugauuuguagauggguuuaguuaaagcacugggauauuuagcuacagguauaggaaugcaugauuauuuucugucaggaaaccuagauuuuguucuucuccccuucuuuaucaaaggugaaaucagacucuuauuuaaaccaggauuaaguauucuuugcauaauaauauauauuugcuuucccaaguuauucuucaggaaagucuugacucucuagcaaacuuuguuucuuaaaauggagguuagcagguguuggaaauaaggugagaguuuuaacacuuaaaggaaacuauauaaagauuagauauagucagaaauuuagaaaacauuaggaaauucacagagagauggaucccccuuuucuacccuagauuaccccugggcugcuuaauggcuugucuuuacuauuagauugugagcuccuugaggucagguuuuaucuguuuuuuauuucaauaccaagugccaagaauauauucagcauuugguguaaauauuauaaaaugaguaaaugaaugugcucuugaauagaaguuaacucugauuuuggguuaagucccccgcccccuuuuuuugagacagucucacucuauagcucaggcuggagugcaguagcgcagucucagcucacugcaacccccuucuccgggguucaagcaauucuuaugccucagccucccaaguagcugggauuacaggugugugccaccacacccggcugauuuuuguauuuuuaguagagaugggguuucaccauguuggccaggcugguccugaucuccugaccuuaggugaucugccugccuuggccucucaaagugcugggauuacaaguaugaucuacugcgucuggcugauuuuguguuaaaauccuuuaugucaguuccagaagagguuaaauggaaguuuucgaggcaagagauacuugugaauuugacaugaguggccuuuguuuugaaauuuuaaugcuacacagaugcuguaaaaggauuuuuucaggccgggcgcgguggcucacgccuguaaucccagcacuuugggaggccgaagcggguggaucacgagguuaggagaucgagaccauccuggccaacauggugaaaccucaucucuacuaaaaauacaaaaauuagccgggcgugguggugugcgccuguagucucagcuacucaggaggcugaggcaggagaauugcuugaacccgggagguggagguugcaguagagccgagaucgcgccacugcaacuccagccugggccacagagcaagacuccaucucaaaaaaaggguuuuucaaaaaaucauguacaauuagaaaauugugucucuuaaaucuauuugcuuauguuauuaaucccagauuaugacuguucuuuccccuaaggcauuagccuguugaaagaaacagaccuauaggacuuuuguugauguuaaagccagaccagaaauuuagaaaaucaggauauuugccauuuugauaagaaaaccauuuaauaguugaauauaggaauuugcauuuugagaguguguacuaauuuagauucuccaggaauagaaccaucaucugaaaauaaauaaguuuaaccagacggacaaggagugauauguaguuuuaggugguaagacugugauauuguuagguuacauguaucuagggcaagaugcucaaauacaauaaguauauacagacuaggaacucuaguugucuuuuuuuaauuaaugaaaagaggguuuuaugcuucauuucuaaacauucucaaaggaauuuauguuuuguugaugaucuuuuuuuauuuauauaaauuuacggggguacuugugcacuuuuuuuuuaaacauggauagauuacagagccgucaagucaagccuuuagaguuuccaucacccaaauaacacacauuguauucauuaaguaauuucucaugaucucccaccuccugcucucucaccuuuccaagucuguuaucuaucauuccaugcucuacguccauguguacacauuuuucagcauccacaugugaaugagaacauguguuauucccaccaacaguguaugaguguucccuuuucucugcaaccucaccaacuuguguuauuuuuugucuuuuuaguaauagucauucuaacuggggcuggaugauaccucauuguggguauuuuuaaaauaaaaaaaaauuuguguguacauagguauauuuauuuaugggguacaugagauaauauugauacagacauacaauguucaauaacuacaucaggguuguauccaucaccaagcauuuauccuuucuugguguuagaaacaaucuaguuucuaaucucuaauaguuucuaaucucuaguaguuauauuaaaaugcauaaugaauuauuauugacuguagucaccccauugugcuaucaaaugcuaggucuuauucauucuaucuaacuauauuuuuauacauauuagccauccccacugugccaccauccccauuagugcccuggcccccacuacccguccuagccucugguaaccaucauucuacucucuaucucuaugaguucaauuguuuugauuuuuagauaccacaaauaagugagaacaugugaaguuuguuuuucuaugucuagauuauuucacuuaauauaaugaccuacaguuccauccauguuguugcaaugacaggaucucauacuuuuuuaagggcugaauaggacuccauuguguauguguaacacauuuucuuuauucguccgucuguugauggacacucagguuacuuccaaaucuugguuauugugaauagugcugcaguaaucaugggagugcagauaacucuuugauauacugauuuccuuucuuugggguacauauuuagcaguggaauugcuggauuauaugguagcucucuaguuuuuuuuuuuuuuuuuuuuuuucauuuuugagacagggucucacucuguugcccaggcuggaaugcaguggcggagguucacuucagccucaaccucgcaggcuuaggggauccacccacuucagucuuccaaguagcugggacuauaggcgcauaccaccaugcccagcuagguuuuuguuguuguuguuguuguuguugaggcagagucucacucugucacccaggcuggagugcaguggugcgaucucggcucacugcaaccucugccuccucgguucaagccauucuccugccuuagccucccaagcagcugggauuacaggcgcccaccaccaugccuggcuaacccagcuaguuuuuaauuguucguagagaugggguuucaccauguugucuagacuggucucgaacuccucgacucaagugauccuccugcguuggugucucaaagugcugggauugcaggcacaaggcaccgugccuggucagaauuuuuuuuuaaggguuucuccuuuguaaauuucuuauucauaucuugaauugauuuucugaguuucuuguauugguuuucagacuuuucuugcaucucagugacccuuaaaaucaauauuuugaauauuuuaucugggauuuuguggauuucauuuugguuaagaucuguugcugcagaaucguguuccuuugacagugucauauuaccuugguuucugauguuuccuuugucuuuucauugauuucugugcaugugcuguaacagucacuucuuaucuuugaauuuacuuucauggugaggggagauuucuuccugaagaugugacuauaauguugguugggccuugcuucugggugcgugcaguagugaagucucuguaugauuuauuuugagacagcucuguugcccaggcuggagugcaguggcacauucauagcuugcuucagccucaaaguccugggcauaagugauccuucugccucagccuccugaguaccuaggacuacaggcgugugccaccaugccuggcuaauuuucaauuuucuuuuagagaugggggucucauuauauugcccaggcuggucuugaacuccuggucucaagcaauccucucuccuuggccucccaaaauguuaggauuacaggcaugaaccaccgugcccagccucuguaugauuucuuuggcuauaaauagcauuaauggugucugugguuuccuugaugucuuagcuugaguuuauuuguggaggcugaaguugcgcuggggauuggaaugccuaauaggccugucuuuagguuucaaugguagugauggugggcuaagcaugucuauccaugugcccuggggcagugugugcugguaacuguguuggcaguuccaggcaggcugauucuugggcuucugagugacuuucucagaugccuguuguaaugguguaccaggugggugagcuggcucuugagcuccugggcaacuggcauggcauaguuuauggugguaguaguuuuguugagauacucuugugggucccaagcacuuugcauuuguguuagcagugguuacaaugagauccaggccaguaaggugguacuugcaggcaugaggcagcugaggcgguacugguaggguguuaucccugaccucuguccccugggagaaguacucugguguuucagaguguuucagguaguggguuugguuguggaauccccugguaaccuggauccugcacuguuucucagccaggucaaagccugguagagcuggacugggaaagcuugcacucaggcccccacagugguguaaugucaugauaggcgggguggaaugaucuucaggcugcuggcaaaaugcuugggugagggaugagugccacugcugagauccugccauggggaaguugggccuggucccaggagugaguuguguuccuuucaugccccaguccaggcggaguuccuuccucuugucccugcuguucagucagaacucugcaguucuugccuagucccuaaaucaucccagggucgggucauauaagccccauccagcucaagacuuaagccuccagggcaauuaaucgugcucaaauccugggggugguguuugcuucuagcacuggugguggcugcaucccacaccaggcagagccaccccauccccgccccuacucacacucugccucuccaaacagcagcccaaguuucccuaauggcuaggacuggcccuguugcuuccccguacugcucacaguuaugagcugagauccugcaucgugucuuguuacagcugcuuagguuucaaaaauggcaugggacacagaauguguucccucccugaaacaguucuuucucacagucuuccagucauucccuaaauuaauuagauucagggcuuaagagggucagggugcucuacugaggacuggauuguaugguaguggaccacagaaaaauacucacccucucccauauuggggaaucacuucugguucccugugggucccagccacacaggcucucuguuuuccuuuugcuuccuagauuuugguuuuugcugucgcuuuucuguugaacuccuguguucccucugggauaauauauccaaagugucauugucuacacaauuuuagcucuuguaccuggaugaggcacgcuugaaauucuugcagucauccaucuuuuccugaucuuguuucuucugccccauuccccagguuccuccagggucucacaguuccccuguaugugggaaaggcaguuuucuuucugcccaauccugcuucuccuuuguccacccagaugagguuuccgcuagaauugcuacuuaaagugguucuguggaacauuuuguagcagagaaaaucagggcugagggagcaccauaaagguuagaaaagauuagaacauuagguuagaaaaucugaacuacucuaccugucuugauuaggaggauuagaguugauguuggauggguuuguugguuuauuuuccacuuaucuaucagaaugaagaacuuacugccuuuucuucuuaguuggucuaauauuuaucacuuuaauuauuuuuaaguguacaauucaguggcauuaaauauauuuauaauguaucaugaucauuacuaccuaugcccaaaacuuuuucaucauccccaacaaaacucuauauccaaaaaaaaauaaaacccucuauauguacauggaacaauuaaguugggccccuaucuugcaccauauaaaacaguuaaaugcaucaaagaucuuaacguuaacagcuaaaauuauaaaacucuuagcagaaaacauuugggcugauuuucaugaccugggauuuggcaaugauuucauaaacauaauguagaaagcacaggcagcaaaagaauaaguaaguuggacuucauuaaaaauuuaaaaauuuuuuuacaucagaggucacuaucggcuggaugugguggcucacaccuguaaucccagcacuuugagaggcugaggcggguggaucacuugaggucaggaguucgagaccagccugaccaacauggugaaacccugucucuacuaaaaauacaaaaauuagcugggcaugguggcgcgcaccuguagucccagcuacuugagaggcuguggcaggagaaucacuugagcaugggagguggagguuguagugagcugagaucgugccacugcacuagaaccugggcgagagcgcaagacuccaucucaaaacaaacaaacaaacaaaaugaagcaauccccccccccaaaaaaaggucacuaucaagagaauaaaaagaaagacaacucagaaugggagaaaauauuugcaaaucauaugacugaugaggguuuaauauccagaauguguaaagaacuuuuacugagcagcgaaaagaaaacccaaugaagaaaugaacaaaggccuucaagaaaugaacaaaggccuucaauagccaugacuuuacuuuuuuaaauuuaaauuuaaauuuuuugagacaaagucuuacucucuugcuugggcuggagugcaguggugugacuguggcucacugcagccuugaucucccagacucaagugauucuccuaccucagucucuggaguagcuaggaugacagacucacacuaccacaugugacuuuguguguguguguguguguguguguguguagagacagggucucacuauguugcucaggcuggucuugaccuccugggcucaagugagccucucacuuuuauuuuuauuuguaguagagaugagaucuugcuaauguuccccaagcuggucucgaacuccugagcucaagcaauccuaccuuccucggccucccaaagggcugggauuauaggcgugauucacugugccuggccuaguuucuuuguuuuaauuuuuuuccuccccauuugucuuuugaguuucccugagaaucugucuugcugcugucucaguugucauucacuguuauuacacuggaacccuauugauguagugguaaggaauuagggaggggaaguguuuuguaaucucaugauuaaaugucauuucuuuuuuuuuuaauugguccugagucccugaauugugacucucagaaguguuucuuagcccuugcccucccacuuagaugagacaggaaggcuauaagccucggggguuuucuaauugucuuuccucuugguagauaauggugugagcauauuugaauauaguuucuuuccucuccuccugcucaaggcacaaggaaauuuuccucaaauauuugcagugaaaacauacuaaaacccuuguaggauuccuggagguaaaaccuaggaaaguguaggggccccucuaagacugggaugucaggauuuuuaaacucucaaacuaauccauauuuggccuccagaaguugucaguuucuacuugaguguuucuguucuaggaaagcugugauauucuguaucugucuuucuaguuuuuuuugguggugguuugccuugugaccucaguuuuuggauugaucuaagauaaauuacugauuuucaguuuucucagcguuuuuucuugucaggauagaagugaggaccuccaaaauccuuacauauuauagcugccuggugaguuuuguuuguuucuuuuuuuaaaaaauuuuuuuuuuuuuuuuuuuuuuuuugggauggaguuuugcgcuucuuccccaggcuggagugcaguggcgcaaucucggcucacuaaaaccucugccucccagguucaagcaauucuccugccucagccucccaaguagcugaaauuacaggugcccgccacuauaucuggcuaauuuuuuuuauauuuuugauagagaugggguuucgucauguuggccaggcuggucuugaaauccugaccucaggugaucuacccaccucggccucccaaagugcugggauuacaaguaugagccaccuugccuggcccguuuuuucuuacuuuuaguaaaaauaaccucacguaaacugucauaggugucugugggcuuauuuuugauguucuccuuuguuggaaauucuugugaaauaccuuccaggucuuagucuuugugaggaucagguucugcuuucaauuggauguuuuaagaauuaguuuuaaaauaauuuguuuuucuuauuauuagcacccuauguuuaguugcuguacuuauuuggauagugugguaagcacaguggcuuaggcaugagaaauauaacuagagaucucauaauuuuauguguuuauaaaguguuuuauuuaaaaauuaaauaauugcaaaugaguggauaaagaaacugauauauauauaucugauuauauauauauauaucugauuauguauauauaucugauuauauauauaugauggaauacuacccggcuauaagaaugaaugaauuaauggcauuugcaguaaccuggaugggauuggagacuauuauucuaagugaaguaacucaggaauggaaaaccaaacaucguuauguucucgcucauaaguaggagcuaagcuauaaggaugcaaaggcauaagaaugacacaguggcuuuuggggacucagagggaaaggguaggaaggagaugagggauaaaagacuacaaauuggguucauguguacugcuugggagaugggugcaacaaaaucucagaaauuaccacuaaagaauuuacucguguaaccaaauaccacguauuccccagaagccuguggaaauaaaaaauuaaaaaaauugcaaauguaaauaagacaguaacaaagauggcaaagaacaaagaugaaaaaguaugcuguauuaccugaaagugcuuuuauggauaucuuagcuuauccuucguccauuuaaauauuguuaguuuuagucgggaacaugccuguaaucccagcaccuugggaggcugaggcgggcagaccacuugagaccaggaguuugagaccagccaggccaacauggugaaacccgucucuacugaaaauauaaaaauuagccgggcguuggggcgcauaccuguaaucccagcuauuuaggaggcugaggcaggacaaucacuugaaccugggaggcggagguugcagugagacgagauugugccacugaacuccagcaugggugacagaguaagacccugucuccaaaaaaaaaaaaaaaaaaaaaagacacaaaagagaaacaaaaaaaacauauuguuaguuuugaugauuaucuacuaggguaaguacuuuucuacucauuaaauuccauuagugacugugccuugauuucccugaaaggaugcaguauagaguaggcuuuugauuggagauagacuuccugauuuuccacuuaguauuuaggagugaaaauuauuauuauuauuauuuauuguuuuuuuuuuuuuuggagacagggugucacuguaucgccuaggcuggagugcaguggcuugauccugacucacuguagccuugacuuccuagggucaagcaaucuucccaccucagccuccugaguagcugggacuacaggcacgugccaccacagccggcuaauuuaaaaaaauucuguagagaugggaucucacuauguuguucaggcuugucucaaacucuugggcucaaaucaucuucccaccucagccucccuaagugcugggauuauaggugugagccacugcacccagccggaagugcaaauuauuuaacuccuuuauuuuauucagcaaauaaaugucuuucugagccucaguuuccuguaauaagguucuuauaaguuuuaaaugaggucagugugcauuaaauguacauguuagaauuugguaagguuaguaagaaaaccaaagacauguggacccuuuacaaaaaauuccagcauuuacccuaagagaugcuuuuuaagugguugaaauuugguggcauggaggaaauguauaugggcucguaucacauuugggaguaaaauuaaggcaugaaauuuaaacaaaaaauaaaauuguggguacauaguagguguauauauuuaugggauuuaugagauucugagacaggcaugaaauguguacuaaucacaucauguaaaaugggcuguccauccccucaagcauguauccuuugaguugaaaaacaauccaauuuuauucuuucagguauuaaaaaauguacaauuaauuuaauacaguaaauaauacauuaauuugaucucaaacuccugaccucaaaugauuaauuagauuaauuaauguauuaucuauuauuauauacacccuguugugccaucaaauacuaggccccccccccccuuuuuuuuuuuuggagacagagucuugcccugucgccuaagcuggagugcaauggugcgaucuuggcucacuguaaccuccgccuccuggguucaaaugauucugcugccucagccucccgaguagcugggauuacaggcgcccaccaccaagcccagcuaauuuuuguauuuuuaguagagacgggguuucaccauguuggccaggcugcuaucgaacuccugaccgcgugguucgcccgccgcggccuccuaaagugcugggaguacaggugugagccacugcgccuggccaaauacuaggucuuauucaugcuuuccaacuguuuuuuuuuuuguacccauuaaacgucaccacaucuugcccccccucgcacuucucuuuucuuucuacucugugucuccaugaguuuguuuugauuuuuagauuccacaaauaagugagaauaugcaauguuggucuuucugugccuggcuuauuucacuuagcauaauaaccucuaguuccauccauguuguugcaaaugacgggaucucauucuuuuuuauggcugaauaguaguccauuuuguguaacuaccacauuuucuuuauccauucaucucuuuugauggauacuuagguugcauccaaaccuggcuauugggaacagugcuguaauaaacaugggaaugcagguaucccuuugauaugcugauuugcuuuauuucugguguauacccaagcagcuggauugcuggaucauaugguagcucaauuuuuaguuuuauaaggaaccuccaaacuguucuucguagugguuguccuauuucacguuguugccaacuguguaugaggauuuucuuuucuuuacaucauugccaacauuuguuauugccugucuuuuggauauaagccauuucaacucaggcaagaugguaucucaugguagcuuugauuugcauuucucugaugaucagugauguagaaugcuuuuucauaugccuauuugcaauuuguaugucuucuuuugagaaauguguauccacauuuuuugcccauuuuugauuggauuauuagauuuuuauucuguagaguuguuugagcuacuuacauauucugguuauuaaucgcuuguuagauggauaguuugcaaauacuuucucccauucuuuggguuguuuguucacuuuguugauuguuucuuuuguuaugcaaaagcuuuuuaacuugaugugaucccauuugucaaguuuuguuugguuaccugugcuugugggguaugguucaagaaaauuuugcccagacuaauggccuagagaguuuccccaauguuuucuuguagaggauucauaaauugaaguuuuagauaaaauucuuuaauccauuuugauuuuauuuauguauagagcaagagauaggagucuaguuucuuuuucuuuuuuuuuuuuugagguggaguuucggcucuuguugcccauacuggagugcaauggcacggucucagcucacugcaaccuccgucucccagguucaagcgauucuccugccucagccucccgaguagcugggauuacaagagcccaccaccaugcccgucugauuuuuguauuuauuuauuuuuauuuauuuauuuauuuauuuauuuaguuuuuugagacggagucuugcucugucacccaggcuggagugcaguggcacgaucucggcucacugcaagcuccgccucccggguucacgccauucuccagccucagccucccgaguagcugggauuacaagagcccaccaccaugcccgucugauuuuuguauuuauuuuuauuuauuuauuuauuuauuuauuuauuuauuuauuuauuuauuuaguuuuuugagacggagucuugcucugucacccaggcuggagugcaguggcacgaucucggcucacugcaagcuccgccucccggguucacgccauucuccagccucagccucccgaguagcugggacuacaggcguccgucacugugccggcuaauuuuuuguauuuuuauuagagacgggguuucaccguagccagaauggucucgaucuccugaccucgugauccgccugccuuggccucccaaagugcugggauuacaggcgugagucauugcgccaggcuaauuuuuguauuuuuaauagagaccggauuucaccauguuggccaggcuggccuugaacuccugaucucagguggucuggccgucucggccucccaaacugcugagauuacagguaugagccacugcacccggccuggagucuaguuucauucuucuguauauggauauccaguuuucccggcaccauuuauuuauuuauuuuuauuuauuuuauuuuuuuuugagacagagucucauuccaucacccaggcuggagugcaguggugugaugugggcucacugcaaccucugccucccggauucaagcaguucuccugccucagccucccgaguagcugggauuacaagcuaauuuuuauauuuugaguagagaugggguuucaccauguuggccaggcugaucucgaacucuugaccucaaaugauccaccugccucggccccccaaauuacugggauuacaggcgugagccaccgugccgggccagcaccauuuauuuuuauuuuauuuuacuuauuuuuuugagagugagucucccuauguugcccaggcuggagugcaguggugcuaucucaucucacugcaugcagccucugccuccugcguucaagcgauucuccugccucagccucccaaguagcugggauuacaggcacccaccaugaugcccagcuaauuuuuguauuuuuaguagagacgggguuucaccauguuggccaggcuggucucaaacuccugaccucaggugauccuuccgccuuggccucccaaagugcugggauuacaggcaugagccaccaugcccagccuggagucuaguuucauucuuccguauauggauauccaguuuucccggcaccguuuacuuauuuauauuuauuuauuuuauuuuuuuugagacagagucucauuucaucacccaggcuggcgugcaguggugugaucuaggcucacugcaaccucuuccuccuggguucaagcaauucuccugccucagccuccugaguagcugggaugacagguguguacuaccaccaugcccaacuaauuuuuguauguauguauguauguauguauguauguauguauguauguauguauuugagacagaaucuugcucuuuugucgaggcuggagugcacuggcacgaucucggcucacugcaaccuccgccucccagguucaagcgauucuccugccucagccuccugaggagcugggauuacaggugcaugccaccacgccuggcuaauuuuuuuuucguauuuuuaguagagauggaguuucaccauguugcccaggcuggucucgaacuccugaccuugugaucugcucaccucagcuucccaaaguguugggauuacaggugugagccagcgugccuggccccagcaccuuuuauuuuauuuauuuuauuuauuuuucugagagugagucucacuguguugcccaggcuggagugcaguggugcuaucuccccucacugcaaccucugccuccuggguucaagugauucuucugccucagccuuccaaguagcugggauuacaggugccugccaccauggcuggcuaauuuuuuuuuuuuuuuuuuuuuuuuuuuagcauagaugggguuucacccuguuggccaggcuggucucaaacuccugaccucaagugauccgucugcuuuagccuuccaaaguucugggauuacagaugugagccacugugccuggccccagcaucauguauugagccuuuuucuuuuccccagcauauguucucggcaccuuucuagaaauagaaaaugaguucaccguagauguguggauuuguuucugaguucuguauucuguccauugguuuaugugucugcuuuuaugccagaaucaugcuguuuugguuacuauaacucuguaguauaauuugaagucugauaaugugauucuuccaguuuuguucuuucugcuuaguauaguuuugggaauucuggaacuuuuguaguuccguguaaguuuuaggauuguuuuuucuauuucugugaagagugucauugguauuuugauagggauugcauugaaucuauagauugcuuuggauaguauggacaguuuaacaauauugauucuuccaguccaugaacaugaaauaucuuuacauuuuuugguguccucuucaauuucauucaguuugcuuuucagauuggucacugucaauguuuagaaaugcugcugauuuuuguauauugauuuuuuauacugacaguuuacugaauuuguuuauccguucuaauaguuuuuuuguagagucuguagguuuuucuaaauauaagaucauaucaucugcaaauaaggguaauuugacuucuuccuuucccuuauuucuuucucuugucugguugcuguagcuaggacuuccaguaguacuauguugaguaacugcuggaagugggcauucuugucgugaucuggaucuuagaggaaaggcguucaguuuuuccccucaguuugauaccaguuguggguguguuguauauggcuuuuauuauguugagguauguuccuccuaaacccauuuuuuugaggguuuuuaucaugaaggaauguugaauauuaucaaauaguuuuuaagcaucaauugauauaauaugguuuuuguucuucauucuguugauaugauguaucacauugauuugcauauauugauccccucuugcauccaagggauaaacuccaccugguuacgaugaaugaucuuuuuaaugugucugauuugcuaguauuuuguugaggauguuugcagcaauauuuaucagagauauuggccugucauuuucuuuuuuugauguguuuuugucagguuuugguaacaggguaauacuggccucacagaauguguuuggaaguauugcuuccuuuuauuuuuuggaauaguuugaguaggaauaguauugaugcaggaauuuucucggccccuuuguuggacuugugacaggggcgaauguuuacucagccugccgugcucaaccccuuguuggagggugcaugugagugagugagugcgggaccuggccagcuggugggggcacugacacagcagcaagcccugugcagggaccacggccagaccaggcacaagcgagugagugugggacccagcuguucugagcaccagcaggagcaggccugugcacagcacccagguugauggggagggggguggugucugugaccccgaggccccugaggggguguuaacagugcuccuuuaguucugcugucugcugauggcuguguguuaacaaguuggccucuugccuugucaugugggguggcugcccuccacuggugagggcaaagggcuggugugacagucuuuuuuggguaccugcacucaguggguccugagcucuugucuggcauccaagaagaaugagguugaguggacacuugaaggauggugaaggugaagaauuuuauugagcagugggaauggcucaguggagaggggagcuggagaggggaugggaagggcugaucucccugaaguccggccguuucuucccuaagucaugcugucuccuuucccaaaguuuggccaucuucucuccgaaauuaagcuguuucucuccucucuaccaacugaaucuggggucuuuauaagcauaggauccucuuuauaagcacaggaugggggcggggcaggcuguagaaguuuuggaaaaggcaacauucuauugguaaagagacauuauucaaacagaaccaaucgggagagagcggacaaacaggaauagaaguuuucacuuugggcuguggguuucaggcuuuuuggcuugaacgugggguuucaccagggacugcccuugucuuccuagaauuucucugccuccugccucuaucaguauuagaucuucuuuaaauguuugguagaauucagcagugaagccaucaggucccaggcuuuuauuuacugggagaauuuuuauuauggugucaaucucguuauuuguuauagcuguguucagguugcagauuuguucaugguucaaucuugguagauugugucuaggaauuuguccauuucuucuagguuuuccaguucauuagcauauaguuuuucauaguagccaugaaugaaccuuuuuauuucugcaguauugguuaucauuguaaugucuccauucucaucucugguuuauauauuuggaucuucuuuuuuuuuucuuuuuuuuuuuuuacucuggccaaagguuuuuaaauuuucuuuuaacuuuuacaaaaaccaacauuuuguuuuauugauauuuuguauuauuuucuuuauuucaguuucguuugcuucacucugaucuuuauuauuucuucuaauuuugggguugguuuacucuugcuuuucuuauucuuuaagauguguuguuagguuguuuauuugaaguauuucuucuuuuuucauguaggcacucacagcuauaaacuucccuuuuaguaaugcuuuugcuguaucccauagguuuugguauguuguguuucaguaucauuuguuucaaugaauuuuccaauuuucuucuuaauuuuugcauugacuuacugaucauucaagaacauauuguuuaauuuacauguauuuguauacuuuucaaaauuucucauuauugauuucuaguuuuauuccguuaucagaggagaugcuugauauuauuucaauauuuuuaaugucuuaagacuuguuuuguuacuuaacauauguucuauccuugagaauaauccaugggcugaggagaagaauguguauucugcagcccuuggaugaauuuuucuguaaauaucuauuagguccauuuggccucuaaugcacauuaagucugaugcuucauuguugguuuucuuuggaaggucuguccaaugcugaaagugggauauugaagucuccaaguuuuaucauauuggggccugucucucccuuuugcucuaauaauacuugcuuuauauaugugagugcuccaguguugggugcauuuauguuuaaaaugguuacauccucuugcugaauugacugcuuuaucauuauauagugacccucuuuggcuuuuccuauaguuuuugucuugaaaucuauuuugucuuauauuaguauagccacuucugcacuuuuuugguuuccauuggcuuuggaaaagauuucucguaauucuguuugauaaggacacauguuaggagguuuucaacacuucagugaguaguaaacuuguaaguaaagcagguaugaacagaaucucuugaauuagugaaaagucaaaaucguuaauuacuguuuaauuuaaaacugaaauuauagguauuaacaaauaacuauaugccuuauacuguacuuuauuuauuuauuuuuccgagacggucuugcucuguugcccaggcuggagugcggugacgugaucuuggcucacugcagccucugccucccggguucaagcaauuuucaugccucagccuaccgaguagcugggacuacaggcaugcacuggcacacccagcuaaguuuuuuguauuuuuaguagagaugggauuucaccauguugcccaggcuggucuccaauuccugaccucaagugauccacccaccuuggccucccaaagugcugggauuacaggcaugagccaucaugcccggccauauaauguacuuuaaacaugaugauuuugaaacuggaaacacacgcacaugugaguaauuucuuaaauggaauugaauuaccuugaagaaucuuagaaaaaugauguuuuuaauuuuaaauuaguuuugcgucauacaugucuuuauuucucaaauuuuaaagaaaagucuaugaauuaaagaaaauaaaacuuuuccugcaugaaagcaaugaguguauuauguaccaaaaagguagaagaaaaauaucuucuguaauauuagcuagauauuacuuacuaaagauauuuuugggguauauuuauuagcaauauuuuaaugcaauuuuaaacauaauugucaucauacuucauagacaguuuauagccugcuauuuuugguuagcauuguaguaugagcuauuuuccauauuauuugaacuuuuaaaauuuaaugguugguaugauauuguaugacuuguaugcauccuuguuuaccuagucuuuauuauacacuuuaauugauuacaguuuuuuuuuuuuuuuuuugcuuuugugagcaucuggcagauaacuuucuugaguaaaguuauuauguagaaauauuuucuuugggccaggugcgguggcucaugccuauaaucccagcacuuugggaggcugaggcagguggaacaugaagucaggaguucaagaccagccuggccaauauggugaaaccccgucuauacuaaaaauacaaaaaucagcugggcaugguggugcaugccuguagucccagguacucaggagguugaggcaggagaauugcuugaacccgggagguggagagguugcagugagccgagaucgaaccacugcacuccagccugggcgacagagcaagacuccaacucaaaaaaaaaaaaaagaaaagaaaagaaaagaaauacuuucuuacuuucuuuguauagauaaagggagauagaauuacuagaucaaagucucuugaugguuuuugccaauuuguuuuguaaauguauguaucaccacaggcuaucuaugagagugucuauuucauggaaacuuagccuacaaugaauagucauuuuaccccuaaauauuugauaaguuaaaaaaugcuaucacauuuaacauuucauaggcuuuaagaaguugcaguuuuauauucauuucuucaugcauuuuguguacuauuucaaaaguuucuauaggggaaugagagcaaaguaauguguuuuucauuauuuauuuugcuaaccaaacauauuuaauuacuaaccaaaaggaugauccuaauuaagccaacacuuggaauuauuuucauguaaaaugucugugauagagauaauugaauuuaauaaugaaaaaaguauuacagaaauuugcucauuaaacugagcuuguuuucagcuaauccuucugcgaagugauaaugacuuuuuuuuuuuuuuuuuaaauaaagaugggggcucgcuauguugaccaggcuggucuugaacuccuggccucaagugauccucccaucuccgccucucaaauugcuaggaauacaggcaugagccaccacacuugguuuaauaguggaauuuuuauuacacuuuuuuauggauucgaggagagguggcauuguacauaacacauucuaccgcuaauuuuccaucuuucacuuuucucauugugcuuuccuucccauuccguuccugguguugaaccaaugcaucauuuguaaauuuguagacagucugaguuuuucugccauaaucuguuguuucuucagacuucuucucugguuuauaagaaaacuguuguuuuaaaacucucaguuuuguauuuuuuauuucuuauuauacuuuaaguucugggauaugugagcagaacgugcaaguuuuuuacauaaguauacaugugccauggugguuugcugcacccaucaaccuaucaucuccauuggguauuucuucuaaugcuaucccuccccuugcccccaaccccccaacaggccccagugugauguuccccuccuugugcccauauguucucauuguucaacucccacuuaugagugagaacaugcaguguuugguuuucuguuccuguguuaguuugcugagagugaugguuuccagcuucauccaugucccugcaaaauauaugaacugauccuuuuuuuauggcugcauaguauuccgugguguauaggugccacauuuucuuuauccaguguaccauugauagguauuuggguugguuccaagucuuugcuacugugaauagugcugcaguaaacauaugugugcaugugucuuuauaguagaaugauuuauaauccuuuggguauauacccaguaaugggauugcugggucaaaugguauuucuaauucuagaucauuguggaaucgucacacugucuuccacaaugguugaacgaauuuauccucccaccaacaguguaaaaguguuccuauuucuccacauccucuccagcaucuguuguuuccugacuucuuaaugaucggcauucuaauuggcaugagaugguaucucauugugguuuugauuugcauuucucuaaugaccagugaugcugagcuguuuuucauguuuguuggccauguaaaugucuucuuuggagaagugucuauucauauccuaugcccacuuuuugauaggguuauuuguuuuuuucuuauaaauuuaaguucuuuguagauucuggauauuagcccuuugucagauggauaaaaaaacacuauuuuuuuaaaaaauuuuccaauuccucaucgguaaaaaagcaguaaaacauucaugguaaugaucauggccuauaguuuuuuuuuuuuuuaagugacauuaggauuuaaaacugguaugaaaccuaaucauuuauuuuaguuagcuaauaucaggauuuagauuuauuuuuuugacccaauugcagauaggcagaucagaucucauagacugccaucugccucaagcuccuuuuguaguuaugugaaugugagccugaaggcugaacccacuuuucucuaauggagauuuuuuuuuauuacacuuuaaguucuaggguacaugugcacaacgugcagguuuguuacauaugcauacaugugccauguuggugugcugcacccauuaacucgucauuuacauuagguauaucuacuaaugcuaucccuccccccuccccccaccccaugacaggccccggugugugauguuccccuuccuguguccaaguguuuucauuguugaauucccaccuaugagugagaacaugcgguguuugguuuuuuguccuugcgauaguuugcugagaaugaugguuuccagcuucauccaugucccuauauaggacaugaacucauccuuuuuuauggcugcauaguauuccaugguguguaugugccacauuuucuuaauccagucugucauugauggacauuuggguugguuccaggucuuugcuauugugaauagugcugcaauaaacauacaugugugugagucuuuauagcagcaugauugauaauccuuuggguauauacccaguaaugggguggcugggucaaaugguauuucuaguucuagauccuugaggagucaccacacugucuuccacaaugguugaacuaguuuacagucccaccaacaauguaaaaguguuccuauuucuccacauccucuccagcauguguuguuuccugacuuuuuaaugaucgccauucuaacuggcaugagaugguaucucauugugguuuugauuugcauuugucugaugaccagugaugaugagcauuuuuacaugugucuuuggcugcauaaaugucuucuuuugagaagugucuguucauauccuuugccuacuuuuugaugggguuguuugauuuuuuucuuguaaauuuguuuaaguucuuuguagauucuggauauuagcccuuugucagaugaguagauugcaaaaauuuucucccauucuguaguuugccuguucacucugaugguaguuucuuuugcugugcagaagcucuugaguuuaauuagaucccauuugucaauuuuggcuuuuguugccauugcuuuugguguuuuagacaugaaguccuugcccaugccuauguccugaaugguauugccuagguuuucuucuaggguuuuuaugguuuuaggucugacgcuuaagucuuuaauccaucuugaauuaauuuuuguguaagguguaaggaagggauccaguuucagcuuucuccauauggcuagccaguuuucccagcaccauuuguuaaauagggaauucuuuccccauuuuuuguuuuugucagguuugucaaagaucaggugguuguagaugugugguauuauuucugagggcucuguuuuguuccauuguucuauaucucuguuuugguaccaguaccaugcuguuuugguuacuguagccuuguaguauaguuugaagucagguagcgugaugccuccagcuuuguucuuuuugcuuaggauuguuguggcaaugcgguuuaaccacucugaaaagauguauuuaaggacuuuuaucuagacucuauggugagguauaacauagugcugguugagucagcuucaaguuuuuguagagggaggaagagaguaacaaccaugucuggauuuaauaaaaaguuuagcauaaguaaaugugugcucuuuugccuuaagaaaauauuuuucaauauauaaaaaggauuaaugagugcugccuuucagauacuugguuugguguguuugaaacaucauuuccaaagauaggacauacacauuuccagggaucaucucuaugauaugacucuagaaaugauguagauuuuuaaaaucaaugucagaacuuauagacacaaauguaugcuuuccuucuaaguagucacuuugggagcccauauacauaacaguggugucauuccugaugauauguugggaacucucauuuuguaaccaguuuagaagucaugcaaguaaauaaaucuucaggauuacuucagauuugggcaaaaaauuaguuuuacccaacuugaucauuuugcauuuuucaccauauuugacucuaagugaaaacuggcuauuuccaaaaaucauacccauccugaggaugugaagauauuuuugggcugggcacgguagcucacuccuguaaucccagcaguuugggaggcugaggcaguaggguuguuugaggccagaauuugaagaccagcuuggucaacauagugagacucccucucuccaaaggaaaaaaaaaagugaaguuuuuuuuuucuuuuucaaaugaguaggcagcauuguuuaguuaucuguuuuuuuuucuuuuuuuuccacuguuggacuucuguccauucucuuuauuuguuuauuuauuuauuugagauggaguuuugcucuguugucuaggccggagugcaguggcgcgaucuuggcucacugcagucucucccucccggcucaagugauucuccugccucagccucccaaguagcugggauuacaggcaugcaccaccaggcccggcuaauuuuguguuucuaggggagacgggguuucaccauguuggccaggcuggucuggaacuccugaccucaagugaucugccugucuagcucccaaagugccgggguuacaggugugagcuaccgugccuggccugcugaucauacucucuugauuuuauuuuuguacugugguacugcgguugauggacugcacugauguuauccauauuuuuaaccuuggucacccacagugugaacucauuaaauagcugacuuugcaauuugauugcuaugauuugggaaugaguguggcagucauaauugugcagguuugcuaucguuucauuucuagagaacuuuucuauggugaucuauugaugagauaagauauaguaugacauuauuuauuccucuuuuugacuuuugguucucaggaauuuugggugcugugaguugacauguagcaucauuuccucaggucucauuuucuaucugagcacgauuaaggacacagugaccugaugauaaauuuuuuuguacaucugacucuuaucugaaagaaugguuauuggccaaauauggaaaccauacccacuugguaccuuuauucuagaggcaaaguuuguuucaaaauuuuguaaaacaacccucuccaccaaaagaaaacaaauacccacacaagaucucuaguuacggugucuguuauaucucauuucuuuuccuucccuaaauauacugagcuauucuuaacuaaauacaggaaaauugugcagaggaacacuuacuaaguguucaguaaauguuuucauuuuucuuauguguauaucuagaaguagaauuguugggucauugaguaacuguuucugcguaaauaucuauacacgugccauggugguuugcugcacccaucaacccgucaucuacauuacguauuucuccuaaugcuaucccucccccaaccccuaacaggccccagugugugauguuccccucccuguguccauguguucucauuguucaacucccacuuaugagugagaacaugcaguauuugguuuucuguucuuguguuaguuugcugagaaugaugguuuccagcuccauccaugucccugcaaaggacauaaacgcauccuuuuuuauggcugcauaguauuccaugggguauaugugccacauuuucuuuauccagucuaucacugaugggcauuuggguuaguuccaagucuuugcuauugugaauagugcugcaguaaacaugugugcaugugucuuuauaguagaaugauuuauaauccuuuggguauauacccaguaaugggauggcugggucaaaugguauuucuaguucuagauccuugaggaaucgccacacugucugccacgaugguugaacuaauuuacccucccaucaacaguguaaaauuguuccuauuucuccacauccucuccagcauguguuguucccugacuuuuuaauguucgccauucuaaccggcgugaggugguaucucauugugguuuuuauuugcauuucucuaaugaccagugaugaugaguuuuuuuucauauguuuguuggccacauaaaugucuucuuuugagaaaugucuguucauauccuuugcccacuuuuuguuaggguuguuugcuuuuuucuuguaaauuuguuuaaguucuuuguagauucuggauauuagcccuuugucagauggauagaucacaaaaaaguucucccauucuguagguugccuguucacucugaugagauauauauauauauuuuuuuuuugcugugcagaaggucuuuaguuuaguuagaucccauuugucaauuuuggcuuuuguugucauugcuuuugguguuuuagucaugaagucuuugcccaugccuauguccugaauggugguuugccuagguuuucuucuaggguuuuuaugguuuuaggucuuauguuuaagucuuuaauccaucuugaguuaauuuuuauauaauguguaaggaaggaguccagcuucaguuuucugcauauggcuagccaguuuuccaaacaccauuuauuaaauagggaguccuuucuccauugcuuguuuuugucagguuugucaaagaucagaugguuguagauaugugguguuauuucugaggccucgguucuguuccauuguucuauaucucuguuuugguaccaguaccaugcuguuuugguuacuguagccuuguaguauaguuugaagucagguagcaugaugccuccagcuuuguucuguuugcuuaggauugucguggcccugugggguauuuuuugguuccauaugaaauuuaaaguagcuuuuuuuuccaauucugugaagaaagucagugguagcuugauggggauagcauugaauguauacauuacuuugggcaguauggccauuuucaugauauugauucuuccuauccaugagcauggaauguuuuuccauuuauuugaguccucucuuauuuccuugagcagugguuuguaguucuccuugaagagguccuucacaucccuuguaaguuguauuccuagguauuuuauugucuuuguagcaauuguuaauaggaauucacucaugauuuggcucucuaucuguuauuguuguauaagaaugcuugugauuuuugcacauugauuuuguauccugagacuucgcugaaguugcuugucagcuuaaggagauuuugggcugagauggugggguuuucuaaauaugcaaucauuucaucugcagacagagaauuugacuuccucuuuuccggauugaauacccuuuauuucuuucuguugccuaaaugcccuggccagaacuuacaauacuguguugaauaggaguggugagagugggcauccuugucuuguaccggguuucaaagggaaugcuuccaguuuuugcccauucaguaugauguuggcuguggguuugucauaaauagcucuuauuauuuugagauacguuucaucgguacccaguuuauugagaguuuuuagcgugaaggaguguugaauuuuauugaaguccuuuucugcaucuauugagauaaucaugugguuuuugucauugguucuguuuaugugauggauuauguuuauugauuugcguauguugaaccagcuguguaucacagggaugaagccgacuugaucgugguggauaagcuuuuugaugugcugcuggauucggcuugccaguauuuuauugaggauuuuugcaucgauguucaucagggauauuggccugaaauuuucuuuauuuguugugucucugccagguuuugguaucaggaugaugcuggccucauaaaaugaguuagggaggauucccucguuuucuauuuuuuggaauaguuucagaaggaaugguaccagcuccucuuuguaccucugguagaauucagcuuugaaucugucugguccuggacuuauuuugaucgguaggcuauuaguuacugccucaacuucagaacuuuuuauugguuuauucagggauucgacuucuuccuuguuuagucuucggaggguguauguguccaggcauuuauccauuuccucuagauuuucuaguuuguuugcauagaggugcuuauaguauucucugaugguaguuuguauuuuugugggaucaguggugauauccccuuuaucauuuuuuauugcaucuauuugauucuucucucuuuuguucuuuauuaguccggauaguggucuguuuuguugaucuucucaaaaaaacaccuccugaauucacugauaguuugaaggguuuuuccugucucuaucucuuugaguucuucucugaucuuaguuauuucuugucuucuccuagcuuuugaaguuguuugcucuuccuucucuaguuguuuuaauuaugauguuaggguguugacuuuagauauuuccugcuuucucuugugggcauuuagugcuauaaauuucccuguacacacugcuuuaaauuugucccagaaauucugguauguugucucuuuguucucauugguuucaaagaacuucuuuauuucugccuuaauuucuuuguuuaccuaguagucauucaggggcagguuguucaguuuccauguaguugugcgguuuugaaugaguuucuuaauccugaguucuaauuugauugcauuauagucugagagacuguuaugauuuccguucuuuuucauuugcuuaggaguguuuuacuucuaauuauauggucaguuuuagaauaagcacgaugaggugcugagaagaauguauauucuguugcuuuggggucaagaguucuguagaugucuguuaggucugcuugguccagagcugaguucaaguguuguauauccuuguuaauuuuccgucuugucggucugucuaauauugacaguggguuauuaaaaucucccacuauuauugugugagagucuaagucucuuuguaggucucuaagaacuugcuuuauguucugggugcucccguauuggguacauauauauuuaggauaguuagcucuucucguugcuuugaucccuuuaccauuauguaacacccuucuuugucuguuuugaucuuuguugguuuaaagucuguuuuaucagagacuaggauugcagccccugguuuuuuuugcuuuccauuugcuugguaaauguuucuccaucccuuuauuuugaaccuauguaugucuuuaauuuguuuuuaaaauuauuauauccauccuacuuaguauaaauugguuucuuguugugguuuugauuugcauuucccugauaugacuaaugaucuugagcauuuuuucaugugcuuauuggccauugguauauauucuuuugagaaguguauaucuaagucuuuuccccauuuaaaaaauaggguugucuuuuuguuguuuaauuguaagaagucuuuauguauucugguuaccagacccucaugagauacaggauuugaaaaucguuuucucucauuguguuugcuguguuuucacuuucuugauggugcccuuugacaugcaaaaguuuugacuuuuauuaaaaauggggcugggcaugguggcucacacuugucaucccagugcuuugggaggcugagguggaggauuucuugaggccaggaguuucagaccauccugggcaacauaacuggaccccaucucuacaaaaaauuaaagaaaaaauuuagcuaagaguauaguugugugcugcacuuccucaacuaagaacauaggugugugccacagguacucaagaugcugaggcgggaggauugcuuuagcccaagaguuuugagaccucagugagucaaggucacgccacugugcucaagccugugugacagagcaagaggcuaacucuaaggaaaaaaaaugggguaaacuuauacuuuccuuauuuaaaguuuuaacuccuuaaaacccuguugaauuacagauacaucuauuauauaacuuaagaguugaugcuauaggcugggcacaguggcucacgccuguaaucccagcacuuugggaggccgagauggguggaucacgaggucaggagauagagaccauccuggcuaacacggugaaaccucgucucugcuaaaaauacaaaaaaauuagccgggcgugguggcgggcgccuguagucccagcuacuugggaggcugaggccggagaauggugugaacccgggaggcagagcuugcagugagccaagaucacgccacugcacuccagccugggugacagagcaagacuccgucuuuuaaaaaaaaaaaaaaaaaaaaagaguugaugcuauaaaacuuaguuaaugaaauauuucccugggcgauggagcucuugcaaguccuguuguauuuuuuguucaucuuuaugccagucaguuagacaguucuucuaugucaagcagaggauggaauaauaaaccaaaacacugcuuagggcuuucagagaguaaguguucaguaaauauauucgauaaauuacugaauuauuuuuuuaaaugauggaaaggaaaaucuugcccucucuuuuucuggguguuggcuaguauaaaucuuucuugaagugauaaucuacaucuauguuuugauuucuaaggauuucccaaauauaagcuauauauaagugagaggaaauaauaacuuaggugccuaaugauaauaugacaagauaaguacaagggucagcuauuuguugugaaauagcaauggauauaauuuaaauaugaauaccuuuuugcuguuuaaucccccaaauuuucuuuugauuucuuuuaaaauucuuuugugguagguagguuuauuguuucuuaagaauuaacuuaaggguaguauuuucugauacauuuuuaaguaacaugaaguuuaacuucuguuuaaacacaucauauagaguacauugaaagaccucaguauuuucgaaauguuuaguaaguaauaucagcaguuuccuuaaaugauauuuuaauccuagguaaguguacagguagguuguguuacucauauuuuuauauucuuagugaaauagaauucuuuuuuuuuuuuuuuuuugagacagggucugacuguugccuuggcuagagugcaguggcaugaucuuggcucacugcaaccucugccucacaaggcucaagccauccucccaccucagccuccugaguagcugagaccacaggcaugagccacccaugcucuauuaugagccaccacaccuggccuaaaauucguuuucuuuaauauuuuuucuuucuacacccacaacuguaacauuucccuuaguuuuuacuuugaaugugcauacucuuacacgacuuacaguauggcuauauuuucaguuugcuagagcuuuacaauuaauuuaaaacaugaaaggcuaauuaagggaauucuuuaaauuuuguuuuaauagugaaagcaaguugaauacauuggugcagaagcuucaugacuuccuugcacacucaucagaagaaucugaagaaacaaguucuccuccacgacuugcaaugaaucaaaacacagguaaauugaaaaagaaugugcuauaccuucuagucuuuuuucuauuuuuuuuuuacacuuauggagguaaccauuuauuuuauucagagagcagcuuuuaaaagagauuucaguuuguggaaaaugacagauuagcaagcuuuauagaagccccuauuauguaucuuagcuauaucugauacaggagauuuuaauuuugguaaguaugacuauagaaagcuuagaaaaggaagcauuuaugguuuuauauguaauggaaauguguuauagaauggcuagugaauguugacugugaaaaaauaguauuagaagaggcaggaguaguauaggaauguuuuguccuagcaaucauucauguauuaggaguuaaauuuuuauuuuuauuuuugugauggagucucgcucugucacccagucuggaguucaauggcaugaucuuggcucacugcaacuuccgccucuugggcucaagcuauucugcugccucagccuccugaguagcugggaucacaggcgucugccaccauguuuggcuaauuuugguauuuuuaguagagacuggguuucacccuguuggccaagcuggucuggaacucaagugaucugcccucguuggccucccgaagugcuaggauaacaggcaugagccaucacacccaacauaagaguuaaauuuuuauguuguuugauaauaucccugaguagauuugguguauuuauuuuuuaaaauaaaaccacuuaacaccuccucucuaccucccugucucucucuuuuaaaaagauauauauauauauauauauauauauauauauuuuuuuuuuuuuuuuuuuuuuaaagagacgaggucuugcuuugucacccagacuggaguguagugguguaaucauagcucacugcagccucagacuucuugggcuuaagcaaucuucucaccucacccucccgguagcugggauuacaggugugugccaccaugccugguuaauuuaaaaaaaaaaaaaaaaauuuuuagagacauggucuugcuauguuguccagacuggucuuggacuuccuggccucaaaugauucuccugccucagccuccugaguagcugaaauuauaagcaugagccauuguaccugguucccuuuuuuaaaaaacauuuuguaucaugugacaguuagcauuuucagguuuucaaggguaacuacaauacacaugcacacagacacacacaauauguacaaaaaaaguauaagagaguuauagugaaaaguucaaccauauguguaauuagaguucuagaaggaauaaagagacuugguuaaaaguccuauuuggagagauacgggcugagcauuuuuuaaaaagugaugaaaaacaucagacuagagauucaagaaguuuugugaacccugaacaggauaaauauaaagaaaacuacagcuaggcaugucauaaccaaacuccuaaagaacauaaaccgagagaaaaauaucuuaaguagccagaggaaaaaaauacauuauuuucaaaggaauaacaguaacacuggcagcucacuuaacaacagaaaugauagaaggcagaugacaaugaaauuauuucuuuaaaaugucaaagaaaagugcagucaugcaucacuuaacuaugggauagguuuuuuugagaaagcauuguugggugauuuugucauugugcaaacauuauggaguguccuuacauaggcuacuacacaccuaggcuauauguuauagccuguugcucauaggcuacaaaccugugcagcguguucuuguacugaauacgguagguaaucggaacacaaugguaaauauuugugugucuaaacacauggaaacauagaaaagguacaguaaaaauacaguauuauaaucuuaugggaccaccgauguauauguggucagucauugagugaaaugucuuuaugcagcaugugauuguaauugccagcauagaacuguauauucagugaaaacauccuucauaaaugaaggguggaauaaggccauaucugggcaaacaaaaagugagaacuugaugucaacagaccuacacuggagugaauaacuacacuagaggaaauuacaaguuuucugaaaugagaaagaaaauaauuugaaauggcaacaccaaaauacaggaaguaaugaauaagaaugggaaagcuaaauagguagguaaacuaaauaacauaaaguuauuuaagccacagucccuauucuuauuucaucaauuaccccaguaguguucacagauaaguuuuucccccuuaaauucaggauccaguucaagauuuaguaguccuguuucuuugguuuuuuaaaaaucugaagcaguuugucugccuuuugggacuaugacuuuuuuugaaauguacagguguguuacuuugugaaauggcccucaggauuaucuguuuaguuaugguuagauucagguuauacauuuuuggcaggaauacuacauaaagugguguucuguucuccaugcauccuguuacauggcacaugaugugauuugccccuuuacuggugauguuaacuuagguuguuugguuaugguuguguuugcuagguaaacccagucuaaaguuaugauuuauuccauuguaacuaauaacuaauuuaauggggggcacuuugagauuacuaagguauucuuuuuauuaucaaaacuuaauauguuuucuuuugcaaaugaccacaaaguuugcagcuuaaaacaacccaaauuuguuauuuuacaguucuguagguucggaguccggugggccuugcuggacccuucucgggcuaucacaaggucaaagucaagauguuaguaggacuagguuccuuucuggagacuguagaaaaauccauuccuaagcucauucagguuguuggcagaauucaguucuuuaugauaaucgguuagagguccuucuuucucacucacuauuggccaagacccccuccuaguucuuuucaggugucuucauuucuucucacgugaugcccuccaucuucaaauccagcaacagcacaucaagucucucucaagcuuugaagcucucugaccuagcuuuuugcuugcuaauucugcugccaccugcuaccagcuggagacauuuuucuguuuuuaaggauucaugugauuagauuaggucccucucccucucaucuccuccugauuaucucuugaguuuaagaucaacugugccauauuacauaacacaguuaugggagugauaugucaucacauugauaauuucuggggauuugcgguguagaaucuugugggccauuccuagaaggucuguuuaucacagcauacauuugugauucuuagcugaauaauuuauuccuaugauggguucaaaauggugauguucuaacuugucuuuccuucuauguuuauuaguugauauuuuauuguaagggagggguucauguucuaaccuauucaauuauuuguaucaguauauacuuacaauuuuuuccaugaauauucucugucauuauuuauuuugauccugaaauuguaucaguuuuggcuaguaggagccucaccuggauggcuccugcugaccuuuuuacaaauccgcaucauuucuugaacacuuucuuucugucccuucaaaguauucaaggcuugcuuuccauucucuguuccccagcccuacaaucaguuauuuuuugcaagaguucugauuccuuuuagugggauauaguguuuagaaaucaagaucagggugugugaugugcucauugccaccaagaugucuuuguuuccaagcucuuucacagagaaagccaauaauauguuuuauauuuucaugaguugauacugauacuuuuaauucaauuccagucuucuuucuagacuuccccuuuucauguuuuuaacuucuuucuccaacagaaagaaaccugguuccuauuauccccaauuuauuuauuuuuauuuauuuauucuuuuugagauggagucucacucuguugccaggcuggaguucaguggcgugaucucagaucacugcaaccuuugccucccagguucaagcgauucuccugccucagccuaccaaguagcugagacuacagucaugcgccaccauacccagcuaauuuuuguauuuuuaguagagacaggguuucaccauguuggccaggauggucuugaucucuugacuucaugauccgccugccucgaccucccaaagugcugggauuacaagugugagccacugugcccagccuauccccaguuuauuuauuuauuuuuauuuuuauuuuuuugagauggagucucgcugugucacacaggcuggagugcaguggcgccaucucagcucacugcaaccuccgccuccuggguucaagcgauucuccugucucagccucuuaaguagcuggaacuacaggugcacaccaccgugcccagcuaauuuuuguauuuuuaguggagacggcguuuugccaucucuggauggcaggcuggucuggaacuccugaccuuaggugauccaccugccucagccucccaaagugcucugauuacaggcgugagccaccaagcccggccuuuccccaguuuauuuguauucauuuuucuaguccucauuguacccacaguuucagaguuguuaaccauaucaucgcauuaaagaaacguaacuauaguucaguauuucuuuaaaguucuuuuugucuuuagaaugauguuacguugucggaguccuguguucacuaguugaggaacuccuucaguagugguaucuccaguuggacaaacagaugucacucacaaauaccaauuguaaauucugggcagcauacugaaggcuagauaucaacaaaguagauaaacuggaggggagucaacacauggaagaagaaguggcaauggcugaauuccccauuguuaauccuuuuugcuucagccaaggauccucuuagcuccaucuguggccuuuaagacuuggauaaaaaucuacagucuuauuggaugugaaaucaaggaaaaaauuuagggagaccacagcagcuguaacaugaguagagagaucccaucuagaaaagagccacagaacgggaaaaccagauugcacgaaaacucucccaauagcucugguccuguugccuaagugcacuccagauuccaaccagccugguuaggacuaaaagaacagaacaaaagcuuugaguuguuugguacuacaggguggaaaggguuuggaguuucauuucaaguaaguuaacuaucuguuuguuugguugguugguuuuuuuugagacagguucuuuuucuguugccuaggcuggugugcagugaugccaucucagcucacagcaacuuccaccucccggguucaagugauucuugugccucagcuuucugaauagcugggauuacaggcaccugccaccacgcccagcuaauuuuuguauuuuuaguagaggcaguguuucaccauguuggccaggcuggucuugaacucaugacuucagguuaucugccugccucggcuucccaaagugcugggauuacaggcgugagccaccacacccagcccaguugacuuuuuauguuggccuuguauccugugaacuugcuuaacguacuuauuaguucuaaauaguauuuuucccccucuuguagauucuuugggauuuucuacuuagacaguuauaucaccugcaaauagggauaguuuuauuuuuuccuuuccaucuguauaccuuuuaauuucuuuucuugcuucauuauauuagcuaggauuuucuguauuuuccaguauuacauugaagaaugaugaugauagcagacauccucuuaguguuaccaauuuuagugggaaaacauucagucuuucacagugaaggauguuugcuuuauagguuucuuguaaaugcccuuuaucaaguugaggaaguuccccucuauuccuaguuugcugagaauuuuuuuaagcuuaaauuucuauuugauuucuauuuguaauuauaaauucacaugcaguuguaauaacuaauauagagagagcucuuaugcacuuuggcaguuucccucaaugguaacauauaaaacuagaauacaauaucacaaccaggaaauugacauugauaaaaucuauuaaucaagauuuugucaguuuuacuuuguguguguguguguguguguguguguguguguuaaaguucuauacauuuuuuuuuuaccuggguugauucaugcaucuaccaccacaguugagauacagaauaguucaucaacacaggauuccucaucuuggcauuuuauaaucacacccacuucccuccgccuaccucugccuaugcuuaacaccuggcaaccacuaaucugucuuccauuuugaaaauuuugucauuucaaauauguuaaauaaauggaguuauauaguaaauaaucuuuugggguuggaguguuuucacuuggcauaauucuguggagauucauugagguuguuguauguaucaacaauccuuuccuuuuaauugcaggguaauauuccaugguauggauguacagauugaguauccuuaaccccagaaucagaaaucugaaauguuccaagaucggaaacuuuugagugcugacaugacacucaaaggaaaugcucauuggaacauuugggauuuucagauuagggaugcugaaucccuaaugugaauaaaccagaauagugcaaauaugcuagaaucugaaaaaauccaaaauuugaaacacuucuggucccaugcauuuuggauaaggaauacgcaaccuguaccacaguuguauuuguauuguuuuuuuuuuuuuuuuauugaaauggagucuuguuuugucacccaggcuagagggcaguggcaugaucuugacucacugcaaccuccgccucccagguucaagugauucuccugcuucagccuccggaguagcugggauuacaggcaagcgccaccacacccggcuaauuuuuguauuuauaguagagacgagguuucaccauguuggccaggcuggucucgaacuccugaccucaggugauccacccaccucggccucccaaagugcugggauuacaggugugagccaccgcgccuggccuguaccacaguuuguuuaaccauuuauuuguuaaagcaaaucugggccgauuccugauuucaguuguuacaauuaaagcugguggugaauauuuauauauacguuuuuauaugaauuuauguuuucauuucuuugcaauaaaugccaggagugcauuuugcaguucauaugaugguuacacauuuauuuuuauuaaauuaauuaaacuacauuuacauuuuauuuuauuuuggguagagacagagccucacuguguuggccaggcuuguuaugaacuccugaccucagguaauccuccugccuuguccucuggaggcccuuggauuacagacaugaaucacugcaccugguuugcauuuuuuuuuuuuuuuuacuccauuggacucuaucagugcuuuuauuuauuuauugguauuuauuuauuuauuuauuuuaacuuuuagguucagugguaccugugaagguuugucacauagguaagguagcaucacugggguuuauuguuuagauuauuucaucacuuagguauuaagcccaguaccuaauaguuaucuugucuacucuuacauguucauuuuuuuaaaagaaacuccugaacuguuauccagagugguuguacuguuuuauauucccacagcaauguaugagugauccaguuucuccacauccuugccaacacuggguguuaauacuauuuuuaaauuuuagccauuugauauuuaugguaucucauugugguuuuaauuugcauuuacuuaaugaguaauaaauucuuuuuaaauagaaacaggauauugcucuguugcccaggcuggagugcaguggugcaauuauagcucacugcagccucaaacuccuaggcucaagugauccuccugccucagccucucgaguagcugagacugccucagccugucgaguagccaagacuacaggcacaugccaccauacccagcuaauuuuuuaauguucuguagagacggggucuggcucuguugcccaugcuggucucagacuccuggccucaagcgaucuucccaccauggccucccaaaguauuuagauuacaggcaucagccacugcaucuggcugguaauaaaacauuaaacaucuuuauugaaauauaauuuacaugccauacaauuaacccauuuaaaguauaaaauucagugguuuuuaguauauugaauauuuacacauauguacaaccaucaccaccaucaauuuuaaaauauuuuuaucaccucaaaaagaaacuccauacccuuuagcuaucacccccuagcucuaagaaaucacuaaucuaguuucuuguuuugaguuuuuuauuuuuauuuuuauuuuuauuuuuuuuuugagacagagucucguucuguugcccaggcuggagugcaguggcuauuuuggcuuacugcaaccucugccucccagguucaaaugauuuuugugccuuggccucccaaguagcugggauuauaggcgugcgccaccacaccuggcuaauuuuuguauuuuuuaguagagacaggguuuugccauguuggccgggcuggucucaaacuccuggccucaagucaucugcccaccucagguucccaaaguccugggauugcaggcgugagccacugcgccuggccuauuucccuauuuuggacuuucauaugaauggcaucauauaauacguguuuuuguggcugauuucuuucauuuagcguaauguauucaagauaucuguuguaacaugucuuaguacuccauuccuuuuuauggccacauaauauuccauuauauguguauaccauauuuguuuauccauuuauccauugauggacauuugucuuguucccauguuuuggcuguuaggaauaaugcggcuguaaauauugguguacaguuuuuuguguguagccauauauuuuuguuuaucuuguguauauaccuaggaaucuaauugcuggauuuauaugguaacuauguuaaauuguuugaggaaaugucaaacuguuuuccaaaguagagauacuauuuuacuuuuccaccaggaguauauaaagauugugaguucuucacauccaugccaaccauuguuaauaacagacuuuuugauucuagccauucuagugcaugugaaguaguaucucauugugauuuuaguuuucaacugccugaaggguaaugauguugaacaucauuucaugugcuuauuuguaguuuguauauauuccuuggagaaacuucuauucaaacccucuguccagucuuuuucuuuuugacaggguccugcucuguuucccaggcuggagugcaguggcaugaucucagcucacagcacccucaaccucccuggcucaaaugaucuucccaccucagccucccgaguagcuaagacuaugggugugugccacagugcccagcuaauuuuuguuuauuuuuuauagagauggggucuuaauuuguugaccaagcuggucuugaacucuugugcuuaagcaauucacccgccucggccucccaaagugcugggauuacaggcgugagccaccgugcccagccccuuugcccauuuuuaaaauggguauuuaugcuuucauuguugauuuguaagaauucuuuauauauucuaaauuuuuuauuguaaaauaugcauaacauaaaaauugccauuuuaacuaauuuuaaauguacaguccuguaacguuaaguaaaauuguugugcauucaccaccaccauccaugucuaguacuuuuucaucuuccccaagugaaacucuguacccaucacauacuaacuccccaaucuucccucuccuuagccuugcaaacaccauucuacauucucuuccuaggaauuugacuacucuaggaacuucauauacguauaauccuacaauauuuguccuucugacauauuuuacuuagcacaauguguugaagguuauccauguuguaguauaucucaaaauuucauuucuuuugaagucugaauaccauuccauuguauguauauaccacauuuuguuuaucuauucauauuucaauggacacuuggauaagauauauaauuuggaaauauuuuccccuauucuuugaguugucuuuauuuauuuuuagagacaggguuuugcucuguugcucaggcuggggugcaguggcaagaucauaguucacugcagccuugaacuccuggguacaagcaauccuuccaucucagccucccaaguagaugagacuauaguugugugccaccaugucuggcuaguauuuuuuuuuuuuuauuuuuuagagaugaggucuuaccauguagcccaggcugagcuugaacuccuggccucaggcgauccaccuuggccucacaaguagcugggauuacaggcgugagacacugcacccaguuggguugucuuuaauugaagcacaaguuacuaauuuugaugaacuuuuauuuaucuguuuuuccuuuuguugcucauucuuuuggugucuuuaagaauccauuaccaaauugaagguaaugaagauuuacccccauguuuucuucuaaaaguuuuauagauuuaguucuuaaauuuaggucuuugaucuacuuugaguuaauguuuuguauauguugcgaaguagggguccagcuucauuuuuuguagguuucuaaccaguugucucagcaccauuuauugaaagacaauucuuucuucauugaauggucuugccacccuugucagaaaucagugggacuguugggcaugguggcucaugucuguaaucccagcacuuugggaggccgaggugggagggguacucgggcccaggaguuccagaccagccuggacaacacagugagacuccaucucuauuaaaaaaaaaaaaagccaggcguaguggugugugccuguagucccagcuacuuaggaggcugaggcagaaggaucacuugagcccaggagacugaggcugcagugagccaugauuguaccacugcacccuagccugggugacagagugagauccugucuccaaaaaaaaaauuaaaaaaaaaaucagcuggucauagauauauggguuuauuucuggacucuuaauucuguuuguccuuuuaccaguacuccacggucuugauugcauuguuuuacaguuuugugcaaaguugcaccaaaguuguuguguaguuuugcaaaacuggcaaucaagucugugcaguacuggcaaaauuaggaagugugagucuucauacuuuucauuuuucaaaauuaucugccuauucugaauguuuucaauucccuaugaauuuuaacucuuuguuuuuucuugguagagaugagguuucacuauguuucugaggcuguucuuaaacuucuguccucaagugauccuuccaccuuggccucccaaagugcugggauuauaggucugagccaccaugccugguccauaugaauuuuggaaugagcuugucaauuuuuacaaagaagucagcugggauucugacagagauugcagcgugucuguagauuaguuuguggaguauuggugauggcagcggugggccgucuggaguggcugcugccaucacacuggcugcagcagggagacguggccagggcugcacggucuauagaguuggugggagccaggggcaagcaggagcccugccccuuccaaguuggagcucccuggguccugcugcagcugccuaagcauggcuguagaccugggcaucccugugcucuugagucuugggagcaggcuggagccccacccucccaggugcaacugcagcuggccaaaccguggcugcagucccaggccucucauuccauggagcaggcaggagacccacccucccgggugcagcugcagucucccaaacugcggcuacagaaccuugccuucugcuccacgagcaggcaggagcccugggugcagcaggagccccgggugcagccgcagccacccaaaccauggcugcagaucugguccuccugcuuuauggagcaggcuggagucccacccuccugggcacagcuauagcugcccaaauuguggguauagaccugggccuccugcuuuauggggcaggcaggagcccugccccacugggugcagcugcagccacccaaaucaugggggggcugcagacccaggugucucugcacucuuggggccugggaaggccccccuugcucucauaggcuugggagugccugcuccugcugccuggcuucacccugcuauuggcaccugcucugaucuuguggcaaaguuggggccgagccugggugcugucguagccuggccagguauccacaugcuuggggaacugcugacaugccagccuucugcugccuugacccccucuggacuuuggguacugacaaacauagggaagcugaggcagggcugagggcaguucagcacuggccugcaggugcccccuugcaucuacagccugggcaccaugaauggcagcaggagguagacagguuccucaguggaagguggcaggucccuggugaggacccaccuucaggccagggaaagccugaaggcuggagguugggcugccaguugcauggaucagagugggaacuuguggugccuuuucugggccugccuguggaccaauuggcaugcacauccuccccucugaggcccauaaaaaccccaggcucagccagagcugaacagaugucaggaugaccagcugcagagaggagcaacccacucuagggccuccucucugcugugagcugcagaggugacaagaugaccuuccugcaaagaggugccacacauucuagggccuccucuuugcugagagcugcagagacgaugggucgacuuuccugcagagagguacuacucauacuagggccuccucucuacugagagcugcagagacgaaggagagaugauggggagaugaugggaugaccugccugcaaagagaagccacccacucucaggccuccucucuccugagagcugugcagaugacgggauaaucagcugcugagaggagcuacccucucugcugauagcugaacacuuguaguaacgacuugccuagcagagaagaaccacccucucugcuaggagcugaacacuuguaguaaugacuugccuagcagagaagaaccacccucucugcuaggagcugaacacuuguugggauaccuugacuguggaaaggagcugcccccuuuggguuuccucugagcuguucuauugcucaauaaagccccucuuuaucuugcuuacucuccacuuuucuaugcaccucauucuucuugggugcaggacaagaacuugggaccugccagaugaggcuaaaauagcuguaacacaaacagggcugagacaugccccuugcucaccuuguugcaggugaagagaaggaaagaagagcugcagcccucuggggagcccagaccugggagcuccccaagccagggcugugacucccucuuuggggcccugccugcgguuccuggugucuccaaacuucugggugccaccguguucccuggugccagcuguggaugcugcuugugguguucaugguccagcugcagccucacagagaaagagcugaugcccgugcuggcaccuggagcugcgugcccugcugcagcugccaggaugucugauugcgcagugaccggaccccacacuugcucacauaccccuugcugcuucauccagucuuccuuggcuaucauaggacacaggccaguagcaugagccgaguguagccggccaggccaaauaggcgggacgagcccagcaggccugagcaaaacucuggcacaggugccaccagccgcagauguuucuggccagaaaagugacaccccaaagauucuguaacacuggcaucauaagaaugauaaaucuuauggcuuggccugguggcugaaggaauuguguacuuuaaauggguaaauuauaugguguguaaauuguaucucaaggauguuuaauguuuuaucacuggcgaggugcggugacuuaugccuguaauuccagcacuuugggaggcugaggugggaggauuacuugaggacaggaauuugagaccagccugggaaacauagccagaacccaucucuacaaaacauuuaaaaaucagccaggcaugguggcaugugccuguagugccagcuaaucaggauacugaggcaggaggaucacuugagcccaggaauuugaggcggcagugagcuauaauugcaccacugcacuccagccugggcaauagggugagacucugucccuaguaaaaaaaaaauguuaucuucuaauucaugaacaugaaguguuuuuccauugauuuaggucuuuaauuucuuucaauagcguuuuauaauuuucagaguauguuuuguacuucuuuuuuuuucaaauuauuuccuucuaauucuguuauaaauggaauucuuuucuuaauuucauuuugagauuauucauugcaaguguauagacauaacauugauuuuuguuuauuguccuuguacccaucaaucuuccugaacuaauuuuauucccauaguucuuuuauuauuauuauuauuauuuuuugagauagucuugcucuguuccccaggcuggggugcaguggugcgaucuuggcucacugcaaccucugccucccagguucaagcaauucucuugccucggcuuaccgaguagcugggauuacaggcaccugccaccacgcccagcuaauuuuuguauuuuuaguagagacaggguuuugccauguuggccaggcuggucuugaacuccugaccucuggugauccgccugccucggccucccaaaguuuugggauuacaggcgugagccacugcgcccagccuauuccaauaauucuuuaguggauuccuuaggaucuucuauguaugagauaaugucacauucuaauaaggauaguuuuauuuuuuauuuuuuuuugagacagagucucgcuuuguugaccaggguggagugcaguggcaugaccucagcucacugcaaccucuacccccuggguucaagugacuuuccuaccucagcaucccuaggagcugggauuacagggaugcgccaccacacccggcaaauuucuguacuuuuaguagagaugggguuuugccauguuggcuaggcuggucuugaacuccggaccucgggugauccacccgccucagccucccaaagugcugggauuacaggcaucagccaccgcgccuggcccucuaauaggaauaguuucauaccuucauuuuaaauacugaugacuuucaauuuuuuuuuuuaacaugcaugcucugaguagaauccguagugcaaaguugaauagaaauggugagagcagauuuccuugccuuguuccugaucuuaaggguuucggaaagcauucagucugucgccauuaaguaugauauuaccuaccuguggguuuuuguagauuuuaaaauuuccuuucuuccuuaauuuauuagaaaaaagauuuuuuuuuuuuuuugagacggaguuuugcucuuguugcccaggcuggagugcaauggcacaaucucggcucacugcagccuccaccuccuggauucaagugauuuuccugucucagccucccgaguagcuaggauugcaggugcaugccaccacgcccagcuaauuuuuguauuuuuaguagcaacaggguuucaucauauuggucaagcuggucucgaacuccugaccucaggugaucugcccaccucagccucccaaagugcuaggauuacaggugugagccaccacaccuggccagaaaaaaaagauauuuuuaaagagcuguuuuagguucauagcaaaauugagcaaaaaguacagugaguucccauaugucccugcuuccacacaugcacagcaucucccacuaucagcauuccguaagagaguuguacauuuguuauauaacguugaugaaccuacauugacaugucauuauuaccccaaaugcauaguuuauguuaagguucacucuugguguuauacauuuuaaagauuuuugacaaauauauaaugaccugcauucaccauugugguaucauacagaauaguuucacugcccuaaaaagauuccugugcugugccuguuucuucaucccuuucuccccugugagcacuggcagccacugaucuuuuuacuuucuccauaguuuugccuuuuucagauugucauaguuguaaucauauguauguaaccuuuccagacuggcuucuuucacauaguaaucugcauuuguuuccuccaugucucuuuguagcuugauagcuaauuuauuucuagugcugaauaauauuccauugucuggauguacuacaguuuguuuauccauucaucuucuaaaggacaucuugguugcuucuaaguuuuggcaguuaugaauaaagcugcuuauaaagauauuuauauaaguaaaugaagauguuuacauaaaauaaagacauuuauaaauaucuccaugcagguuauuuuguggauguauguuuucagcuucuuuggauaaauaccaaggagugugauugcugcuuuauauaugguaugcuuaguuuuguaagaaauugcugaacuguuuuccugaguggcuguaucauuuugcauucccaccagcaauaaaugauaguuucuuuugcuccauaugcuucucagcaguuuugauguagucaguguucuggauuuuggcuauucuaauaggcaugcagggguauauuguuuuaauuugcaauucccuaaugacauguugagcauuuuuucaugugcuuauuugcgucuguauaucuuuuuuggugaggugucuguucacauauuucuuuuuuuuuccuugcuuuaaaaucauguuguuuguuuuauuguugaguuuuaagcauucuuuguauaguuuggauaauugucuuuuaucagauguguacuuugugaagauuuucucccagucucuagccugucuucugauuugaaguuuucuaauauuuuuguggacuuuugcaucuauauucauaagugauacuugccuguaguuuucucuauuugugauauauuuuuuauaucagggcaauacuguuuucauaaaaugaguugggaaauguugccuccuuuucuguuuuuuagaagaguuugugaaggauugguauuaguccuuuuuuaaauguuuguuauaauuaaguggugagaacauuugggccuuuucuuuauggguagcuuuuuuuauugcuaauuuaaucucaucaauuguuacaggucuguucacaccuguuucuucuugagucaguuuuaguaguuuguguuuuggaauuuguucauuucauguaaguuauuuaguuuuuuggcacacaguuguucauaguauuccuuuauaauccguuuauuucaguaagauuaguaguaauguccucuuuuucauuucugauucuaguaacuugagucuuguuucuuuuuuuucuuggucagucuacccuaaaguuuguucaucuuuucuucccccacagguaaguuguuacacaaucccuagcagauuccaacuuucauggccaagguccucuuugaucaucuuuuuaaaaaauuaguuuuuggccaggugccuguggcucacgccugcaaucucagcacuuugggaggccaaggugggcagaccacuugaacccaggaguuagagaccaggcugggcaacaugacaaaaccccaucuccacaaaaaauuagccaggugugguggugcgcgccuguagucccagcuaccugggaggcuuagaggggaggaucaccugaacccgggagguugaggcuaaagugaaccaugauagcaccucugcacuccaguauggacaauggagugagacccuaucucuaaaaaaaaaggaggaaaaggaaaagaacuacucuuugguuuuauugauuuuuuuuuucuauugcuuuucuauuuccuauuucauuaguuucaugaauuucugccauaaucuuuauuauuuccuucuccuugauuuugguuuaguuugcucuuauuuucccaguauuuuaugguaaaaugaaauauacuuuauugguaguauguuuuuuauuuuuaguguaauaguuuaaauuuucuucugcugggaaaugucuugcaauauuuauaaacuacaacaggaaauguuuuuauaccaaaguaaucuuuacagagauuucaugcuuuauaaggagggguuaguaugcaaaaggagagugauucuagugaaagaacacuucuaggaauauuuuaaugugaguaguauguuaacaauacugccagacuucauagugugagaauggguuuguggaguuauagguauugauguucuguuugauaaugcaucgaagagauaaauaauguucuuuauuucuucuuuuuuagauaaaaucagugguucuggaaguaacucugauaugauggaaaacagcaaggaagagguaaggauaauuauuuagagauauuuguuaguuacgauuaaccaaguagagcauaugucuuuagauugcuucuggacacauguaugugucgaaggcuacugauacccaguugucauuauacuucaguuucguuguuuuccaguuugagaacagguguucauuguuucuguuauuguugugguucacuucagugguuuaccuaaagucagacaacugaagacuuccaacagauagauauuaaacugucuuuauauugccccaaagguguuugagguggauguuaagggcaugaacuccaugguugugaaaucucucaaaacuugguaucuagagucugcuaagcauuauuauagcaacucauaacaagguccuuugccugauacacagguccacaacugugguuuugggaauuuuuugaccuacuguaaaaaaaaacugaauccaguaaaauauauugauuauacuggcaaaaugaggguaaguuuaguaucucaaagcaaguuguagaaguuacuucaugccauauguuagcuuagagaagaaugaaacauauuuagauccuugaaacucccuacuucucuugagaucugauuacuucugcaucuuuguuuugucuuuguugacuggggccaugaucauuuugcagcaguguauuccccgcagcaugccacagcaaccauguaaaaaacgagaaauuuaaucuucagccaaggaaaccuggcaguaaaugagaauuaguuuuaauuuuuauuuuuuugcaucuguguuccuuaugugguagagaauuaguuuuugaaguuccuuuuagaaaaauauucuaggcacauaaauagcaucucauuauaucacuguauugaaguugcuauagggaaauagcuaauuguagggaugccguuucgagaauuuuauucacuuuuauauuuaugucucacaucuagggaacuagcucuucagaaaaauccaagucuucaggaucgucacgaucaaagagguugguugauguugaagggacaaaaaguuauuuucuuuuucagguuauuuucuguuucuaaaaccauguuuuuuucugaacucaugucaaccacuauucugaguuaacuauucuauacaaauauacauauuugaaaaugauuagcauaauauaaugaaucccuuuguaucuaucaccugauuucaacaauuauuauucauucuaacuuugaauucuaaaggguuuuuaaggauuuauuauauauuaguggcccuugcaauauguaguuuauuucauuagacaauauauguccuugaaaaaggacaaaauaauuguugaaugccuaugaggcaguggguuuuuuggguuauaugaaauugucuaggaugggaaguuagucaucauaguuguaaguuauaaggagaaaaaagagugguaaaaaacacuuuuuucugcuaaauugucaacucaagucauacauaaaaacugaaacuuuucuaacauaauguaguacccaauauacuaugcaguauaauuguuauuagaaguuugccgcuuagucuauuggacuuucauuguuucuaaccagugggaaugucucuuaaaaaccaagcuuguuugauauuaauuuauucucugaaguagugauucuuaaagaagaguguccuccagggucucccugguagcuuuuucagaaugcguaugccuugguccugcuccagaccuacugaaucauaaucuucagugauaugguauagacauacaugcuucccuaggugauucugaugugcuuccuuguugagacccacugcucaaucucaacauguuauuuauguucuuuggguauuguuccaguugucagaaacauucauaauucuaugaacuuaauucuuucauaggaaaccuucaauuguaacaaaguauguagaaucagaugaugaaaaaccuuuggaugaugaaacuguaaaugaagaugcgucuaaugaaaauucagaaaaugauauuacuaugcagagcuugccaaaagguaauguguguuaauuuuucaugaaguuaaaguugaaaugaauuuuuaaacaucauuuuuauaaaauuggaacuugauuacuguuaacuauguacaaacgaccaaacauggcauuuuccuagugguugucuagaaauauauuuguaugccaaugauaauauguguuauugaaguuaaaaauuuggaauauucaguugguuuuguaaagaaugaaaucuauuuuuuucuuuccuuugaguuuuagacaaggggcuuuaguuuccaaauuauacuucaguguguaagcagguuuaaaaauuuaauauauuagguuuugguucagucaauguuaaugugcuugcuuuauacaaaaauguaaugacuguuccugaaaacuuaaaaaucauguacagucuaguuuagucuuauugcauucuuaaauucccuaaggcuaaaagcugaaguuaacuaucauagauagauuuaguuguauuucuugcuguuaucuuuuuuaaaaaacuuugucacauaccucucaacuguugaaguucuaaccauaaaaccuuguuaauaagaauagggaacaauagccaaaugaauaucuuggacucuucauagcucaagucugagagcaauauaauuggaugaugagaaugacagggaacuugguucaaagagucaaauuuuagauuuuuuuucuuuguuaaauaauauguuguagucucuuggcacauuuuucaaauucauucucauagaucuuuuacagcagugcuuauuaaaccuuguucccugucuauguuuuuaugacauauuuucaaauuauggaaguuuaaaaaauacaguagguaggagggaugggacuuuccuugacuaggauaaauuagaaguuacaaaaggugauaaaugaaaugaggaaaggaaauuaaugaaagaagagagauaggggccuaccgcuuacuuaguuuugcaaaucauuuaugacaauuuuauguaaugguuuugguggccaagggcagaaacaacuaacaugggagucuaagucccauagguggugacuuacuuuggauuuuuacauucucagugguugucacugggaguguuuaugauguaagaaauaggaauucaaacuuuuguuuuaauuguacuguggaagaaagucagcauaugauguuacuaaccugaacuaugccuaauucugucagaccaaaacaaaaacagacccguuucauaagguuaaauuuggguguuuauauuauuguuguaauauuuauugaguauguauaaguaccaggcucuuacagaauuaacuccuuuaauccucaaaacaacacuguaagguaguuauuauuuugcuuguagagauaaaggaacaaauucagaacccaaggaacuuuuucagcuuuaaauugagaagcuaagauuucaacccaggucugcuugaauccaaagccuagugagugcucuuuucacucugcugcuuugcuuccaauucucccuagaagaaaucuagggagaauucaguuuuuuuuuuuuuugucguuguuguuaauuuaaaaucuuuaguucuuuucaaaugcuggggcuucucugagugucuacaugcaaugauugcugugaauaacuuuuuuuugguggggauuauuuaauuuuacuacaaucuguaaaaucucaaucaucuguguccuccccccccccacccuuucagagacucagaaacucauuuaacaacuagaugcuauaacuugucaaaauuugcuuguugaauaacauagagccauauuucagagaaagccccuggugacuaccugcuuuuuuuuccuuaauuguugccaaugauagccaguuacuaagcccagcaauguagguaaacauugaaaccuaaacccuuuuuacuaugccugucuuauuugcucuugagagaacuaaugaaaacuuaaauugacagccucucucuucaauucacauguuuuauaguuaaggaaggacauucuuucuaaaauauuaacauagggaucaacaaaugaucucauucuacaauuuauuguuaggguacuucagcuaaaguaucuuaaucuguuaaaacucuuuaaggacuuuacagaguagugaaacuuugacauaccaguugggaaaugcugcaguauagauacaggaguaauagaaugaacuucauuucccccaccaauaccccucccuugcaauauaaaacuacccuuaaaaaucuuucugaguuuaugauuuggauuaugaaaauaggaugucuuuaaaaauuuuuucccucugaaccacacauauuuuaugaauucuuuauggaacuuagcauagauguucauauucauaacagcuuuugugauaggcacuauaaaaauucagaacuggguugaggcuuucuguuugauucacacauuuguuuuguaaucacuccauaauaccucccuuuccuguuuuuaugaacuauauuucaacaaauaaacuguugacaccuggcccuuuuacuauuucccuguuuuauuuacuuuugugagguccuuacaccaauaucuaaagcuugaaagaaacaaacuauguaccagcaauguuggcuuuaucugaacugaagucuuguacuucacuugcacauuuaauauguguaaugguuuuuuaaaugaaaucauucuagguacagugauuguacagccagagccagugcugaaugaagacaaagaugauuuuaaagggccugaauuuagaagcagaaguaaaaugaaaacugaaaaucucaaaaaacgcggagguaaauacaagugaaaaugaaacaugaauuuaaauugcuguuuaugaccauauuggaaaaucggaugugcuuacuaaaaauaccuccacuuuucugccuuuuguuuauuaaaagcacuacuuaaauauaacuucuguuucucucugagcucugaagcagaaaagguuaagcaccauuuaucgaaacaccuuugccuucaguggcuauuaaguuaucucaagaagcguagcauuuccuucuuccacauguucuauaauacauauaugccauaauacuauguuuuccccccaacccuaaaauaauuuuagauucaugcaaaaucuugucuguggccuacagguaacuuuauauauauuuagaguuggauagagugacguacaucugcauuaguauuaguugggguauuauaaaugcaagucccuugacuccacuccucacaaauuagaauuucuguugaugaggucaagaauguacuccaguuuguucuuguguacacugaaguuucaaauccacuaaucuaagaauggcaacauggacauaaguaggaaggaguagggagcuagagcugauaacccucccucugucuuccagaggcaccucucccuuugucugucuaucuucccuuaaacacacaaacgguggggagugguggcucacaccuguaauaccagcacuuuaggaagccaaggcaggagaauuacuugaguccuggaguucgagaccagcuugggcaauauggugagaccccauaucuacaaaaaauaaaaauaucagcuggacauagcggcgcaugccuguaguccuagcuauucuggaggcugaggugggaggaucacuugagcccaggugaucgaggcugcagugagccgugauugcaccacugcacugcagccuggaugacagagugagacccugucucaaaaaaauuaaaacacacacacacacacacacacacacacacacacacacacacucuaauauuggcuaaccaucuauaaaaaguuugcaucagaaggauucauuuagaaauaauaguggacuaugugucccacuuguuugugugugauucuuaaauggugccuauauauauuuuggggcagcuuaauaaagccagaauucauaacuauaaaaggaaugaaucuccaaaugauagaacaugacacuaaauuucuaaguagaaguguagugaaagcauauccauuuaauauugaucagauuauauaauugugaaauuauagugaaguucuuauauuggugaaauuuuguguggauuuuuauuuuaaugcuaugauuaucuugcuggaaccaguaaaauauaucuauuuuuauaacauauuuuauauauucauuuuccgauuaaauaauuuguaagguuguuggcaaaaauaaaggaaauauuauauagucuuuuguccacaaagggguagucaacuccuuuugagcauaaggaaucuuucugagaaucuaguucaugguagggaaacugccauugcagcaacagagcucauuaaagcuaagguaguagucuuaaaauuuaagagaauccucaauuauaaagugaugguaaagaucaguaguaagaguuucuuuccucugaucauagguucucuagagaagacaaauaacuaaguguucugcauuguguacacuuaguguacagagugucuaaaugguguuauuuuugggaagggacccuguagcagucagugucugaaauguggauaagggcugaaagaauaaaagaaccacuguuguugacgaggguauuccuagugccacuuugguaugcugcugacauuuggucucagcugauaaguuucaggaacauuuuauugaaugaucuguguaggaauguuuugguaucacgcuuaagggaauacaugcauuuauagccaucaguagcacuuaaaucuuucacaucuauuuucaucuuaaugauuuguuacauuuuuaagcugucagaaaucacacaggaaauuuaacacuagguuuacuuuauauacacauauauagauaaauuggugaucugaaauacugaauugguguaguuaauauuuaaacuuuuuaagaaagcugguuccaaauugaagccuaacuuaggaaacugucaagaauguaaacuuucuuguauuacaagaaauguaagacauuacaagaauguaagacaauauauaaagucuuauauugauuuggaauaauauuauaacacaaagauacgguuaaaguuaacauuucaggagcugauuuuuuaaaaaauuuucaguaucauacccuauuuugacauucucuucccaguuuaauuguuagaaaguauauuuuacaccuaacuuuuuuacaugacacaauaauuuuguucuauuuaaaaccauuaaaaucuauugagcucagaaaugaaaaugccucuuuuccauuuauacccuguguuacaauuuuaaauauauuucauaauuaaaaauaaaaaauuuaaacauguauacagcaacaaguacauaaaguaacauuucaacauuuuaccauauuugcuucagaucucacuuaaguaaaauauugguucaguccuacucucauccauuuccccuucuucccaccccacagguaaugauuauauugaaguuuuaugcaugugcaugugugugcauguuuuucuauguuuuuuauauauguauucauaaaacauuuuucauuuaaaaguauaacaaaauaauaugcuguauauaucauuugggaacguuuuucauuuaacauuguuuuugaauuguauucaugucaguaaauguacaucuaguuuguuuauuuuucacugcucuauagaauuauguuauaucaauaagccacuauucauuucccacauaggaaguuauucccaauuuuucauuuucuaauuuucuaauuagugcuguggugaauauccuuauauuugauuccuugugcacaugugggagaaaaucuccaaagaauuaccuaguuuuguuuaauucuugagcgauguaugcaccaaagcacauagaagauacuuaguaaguauuacuuaacacuggaugaacauucagauucuacauuuuauuuaucuuguuaguuuaucugaaugaaaucauuguuugaaaugaaaaaguauggugugguguauuuguuucuguuaaaacaaauacagaauauaugaauacccaagaucaaacugguguuuguaaauaaugugauuauaauacauuaggcuuguaaugccugcuauuagguagguugagauaggaggauugcuugaacucaggcguuugaggcuacagugauuuauaauugugccauuguacuccagucugggugauggauugagaccccaucuuuaaaauuaaaaaaauaaauaaauaaaaauauuagcaacauaaauaguaaaccuucaaguuuacuuuucuaaaaaaguaugaugguguucuuauacauuaacguuuuuagcuucuggcuaggugugguggcucacaccuguaaucccagcauuuugggaggcugaugccagaagauugcuugagcccaggaguuggagaccagccugggcaacacagugagacccagucuuuaaaaagaauuagcuggguguagugguguaugccuauagucccagcuacucaggaggcugagguaggaggauugcuugagccugggagguagaggcugcagugagcugaauuugcaccauugcauuccagccuaggugacagagugagacucuagcucuuaaaaauuuuuuuaaaguuucuacaaauaaaaauauucaugauaauauuuggguccauggcgcuuuggaccuuaaaccuaacagaaacccaaaagagaaaauuaaaagggugaaaaauauaugugauguuuuguuuuuuauuuaaggauggagccaauuuguuuuuuaguugucuccuuuuuauuugugaauguaagcauuuugagugacuucugaauuauaaucuaccaucuuauuuugaucaaggucuugguugcacaucaggaucaucuuugaaacuuuaagaaaaugccugagagauuuuaauucagugguuuaggggugggaauggcuguuuuuaaaaagauucuucagaugacucuaauguuuagcucagggugugaaacacugccuuagcagaacuagggacaagagggaggcuggagagguuucuguagguuuucuucagucuguuuaucaggagacaguacagaaugggacucugccuuuuucccccagucguucugauguuuugcugccaaaauagauauaccugcaaugucuuguuugucuuuauuuggaaauaguagacaguauugauauggaguggauaguggaguacacauagaaaaaaggcaguuuaaugacaauuuauguauaguguugaaguaaauauuagcaaggaaauugguaauaucauaaaauuaccaaguuuuuacauaccauauugauaggaucugugcagacaauuccaaugagaauaaaaaccuuuauggcauacuuaaguguaggauugcaaaagaaucuguuccguauauguuacuuacuuccccauucuuuaaggacugauacugaauuuauuugcaaagcaauaacaaaauaagagcucuuggccccuaguuuuagaacuuuuuauggguucucuuaauguuauuucaaguuguaaaaaauggcauuugcaucuguaaaaggaaacaauuaggauuuguaacuuggaauuugccaagguugucaugugcuuaguaagucgauaaaauauuaaccuuuuuuacuuguguccaauaugccauuuuucuaaggauuaugagguauuucaugucuaauacaaaaguuacaaaaugcugacuaaaguaaguaucuuuuucuguguauaaaugugugaauaauagccacuccuuucuccuagaagaugggcuucaugggauugugagcugcacugcuuguggacaacaggucaaucauuuucaaaaagauuccauuuauagacacccuucauugcaaguucuuauuuguaagguauguaaugaucuguugauauuucauaccguaaauauuugaaugcuuaccauauaccaggccuuugagggcacagucuugaagaaagaugaaaaugguaucugcccuuggaagacuucuacuauaguggggaaaauagacguacaaagccuaagugucaugauaggggagauacugugauuaugggagcacaccggaagccuguguaaauaggauuuggauggcuuucuaguggaaagcuguaugugaaauaugaauaagaaucagccugguaagugagauugguucaucauguucugggaagaggcaacauaguauucagauacugguaguugagggagagcuugguguguuugaaaaucucaagaguggauguguguaauguuuguguuuuauaaucuuuccccuuauauauccuacuuccccaaauguaaacuaucuauguggagcaggguuuugacauaacuuggagaugauagaauuaaaaauguuuuuuauguguugauuauaauuuuaacagucugugccacuuuuuuguuaguaauaccuuggaguuaauuuuaaauaucuauaaaugugggccuggcaugguggcucaugcuuguaauccuagcacuuugggaugcugaggcagguggaucuccugaggucaggaguucgagaccagccuggcuaacauggugaaaccccgugucuacuaaaaauacaaaaaauuagccgggcaugguggcgggucccuguaaucccagcuacuugggagacugaggcaggagaaucgcuugaacccgggagguggagguugcagcgagucgagaucgcgccauuguacuccagccuggacaacaagagggaaauuuugucucaguaacuaccuaccuaccuauaaaugucaagguuaugguuuucuuaacucauauuccugcuaagauuaauccuauguuaguuuguuucccaauaaaaagcugccuuugaaaugcaguggcaggccauguuuuccuuggaauucuagcucuagaucuuuucuugcaugaauuuuugauagauucagacaugcuuaaaugaacuguacuuuguucuuuagcaauuuguaucccuccuuuccuugaauucaguucagccaggggccuaucuaggguauguauuagagaguuucauuuuaaauugugacaguagaaucuaauauugcuggauuugugacauguauuugccuuucuguuuucuuaucuaugugauugucuuuuuucaagaaccagucuguugagccuaggccauuucacuaaucgguaguuuguaucagugagcaccuuuucccuuucugcagucccacuggaaagacuuugaagucagucaaacuuggauuugaauaacagcuuugccucuuacuaguuguaugacuuuagauuuauuuacauauuaaugaaaguuagccuuuucucucauaauauguccuaccuugcaugguagguauuugguauuuaaagauaauauagauuaauuguuuagcuguauacauaguagcuguuuguauaugguggcuauuaaaauuguuaaguacccaaaucuaauacauuuuuauguagagcuuuaguagcuagauguaugagaccagaaauuagcuuuacuaaaaucuuuuguaaacuuuuuuuuuuuuuuuuuuuuuuuuuuugagacggagucuugcucugucgcccaggcuggaguacaguggcgcgaucuuggcucacgacaacguccaccuccugggucaagugauucuccugccucagccucucgaguagcugggauuacagguguccacuaccacaccuggcuaauuuuuguauuuuuaguagagacgggguuuuacccuguuggccaggcuggucuugaacuccugaccucaagugauccacccaucucagccucccaaagugcugggauuacaggcaugagccaccaaacacccagccaaaaaucuuuuauacacuuuuaaauaaggaauagugguacuugaguguauggaaaucuguuucaaggcauuaauucuugagauaguuagaugucuggaaaauacagacauuggguaguggguagcaguguuuauuuuauuuauuuauuuauuuuugaggcggagugucacucuguugcccaggcuggagugcaauggcgugaucuuggcucacugcaaccuccgccucaggguucaagugagucuccugccucaaccuuuagaauagcugggauuacaggcgcuugccaccacgcccggcuaauuuuuguauuuuuaguagagacuggguuucgccauguuggccaggcuggucuugaacuccugaccucaggugauccacccuccucguccucccagagugcugggauuauaggcaugagccacuguacccggcugcaguagugcaguguuuuugcuuugagucucugaaacaugcacacauacucccuuuuuuaaaaaaaaauuguuuguauuuuuaaaauuuuuguggguucaugguagguguauauauuuauggcauacaugagauguuuuaauacuggcgugcaauguaaaauaagcacauuguggaaaaugggguauccauccccucaagcauuuauccuuugaguuacaagcaaucuaauuacauucuuuaaguuauuuaaaaauguacaauuaaguugcuauugacuguagucacccuauugugcuauuaaauaguaggucuuauucuuuguauuuuuuuguacucauuaaccauccccaccuccucccuauccccucacuaccuuucccagcuucuuguaacuguccuucaugacauccuucauuaguucauccaugaguucaauuguuuugauuuuuagaucccacuuauaagugacaacaugcaguguuugucuuucugugccuggcuuauuucacuuaacauaaugaucuccaguuccuuccauguuguugcaaaugacaggaucucauucuuuuuuauggcugaauaguacuccauuguguauauguaccgcauuuuauuuauuuacuuaucuguugaugggcacuuagguugcuuccaaaucuuugcuauuguaaacaguggcccaacaaucauaggagugccaguaucucuuugauauacucauuuccuuucuuuuguguauauacucagcagguggauugcuggaucauacgguaucucaauuuuuaguuuuuuugaggaaucucccaacuguuuucuauagugauuguacucauuuacauuccuaccaacaguauacaaggguucccuuuucuccacauccuugccagcauuuguuauugccugucuuuuggauauaagccauuuuaacuggggugagaugauaucuuauuauaguuuugauuaacauuucucugauaaucaaugauggugagcagcuuuucauaugccuguuugucauuuguaugucuucuuuggagaaauguccagucuaaucuuuugcccauuuuuugauuggauuauuugauuuuuuccuauagaauuguuggagcucuuuauauauugugguuauuaauccauugucagaugggcacuuugcaaaauguucucccauucuguggguugucuuuucauuuuguugauuguauccuuugcugugcagaagcuuuuuaacuugaugugaucucauuugccaauuuuugcuuugguugccugagcuuguguaauaugcucaauaaaucuuugcccacaccaguguccuggagauuuuccccaguguuuuuaauuacuuaaaaaaauaaaguuuuuguccuuuaugaauguuaucaauuuugaauuaaauuuccccuuccucuuuucuuuuaauagaauugcuuuaaguauuacaugagugaugauauuagccgugacucagauggaauggaugaacaauguagguagguaauauagaugagcuaacauucaguguuuccuacuuuugggaggaauuguuacauaaucauuuaugagguuugucuuucauaguaucgucauugaugucuuuaaugaaagguuguucuuuuccauaaaacccuggauuuaugucuaguuuaaguuucuaauaaagaguaagcagaugaccuaaauuaccacuaaaauuacuggcaguaaaauuuaaauugcauuauaacaaagagauuaaaaugaguuuuguugggaauaauguuuauuuuuauuuuuuuacauaucuuuucaguuuccugaaagaagggaauaauguuuuaaucuuuaaaacauuucagguggugugcggaagguggaaacuugauuuguugugacuuuugccauaaugcuuucugcaagaaaugcauucuacgcaaccuuggucgaaaggaguuguccacaauaauggaugaaaacaaccaaugguauugcuacauuugucacccagagccuuuguuggacuuggucacugcauguaacagcguauuugagaauuuagaacaguuguugcagcaaaauaagaagaagauaaaaguugacagugaaaagaguaauaaaguauaugaacauacauccagauuuucuccaaagaagacuaguucaaauuguaauggagaagaaaagaaauuagaugauuccuguucuggcucuguaaccuacucuuauuccgcacuaauugugcccaaagagaugauuaagaaggcaaaaaaacugauugagaccacagccaacaugaacuccaguuauguuaaauuuuuaaagcaggcaacagauaauucagaaaucaguucugcuacaaaauuacgucagcuuaaggcuuuuaagucuguguuggcugauauuaagaaggcucaucuugcauuggaagaagacuuaaauuccgaguuucgagcgauggaugcuguaaacaaagagaaaaauaccaaagagcauaaagucauagaugcuaaguuugaaacaaaagcacgaaaaggagaaaaaccuugugcuuuggaaaagaaggauauuucaaagucagaagcuaaacuuucaagaaaacagguagauagugagcacaugcaucagaauguuccaacagaggaacaaagaacaaauaaaaguaccgguggugaacauaagaaaucugauagaaaagaagaaccucaauaugaaccugccaacacuucugaagauuuagacauggauauugugucuguuccuuccucaguuccagaagacauuuuugagaaucuugagacugcuauggaaguucagaguucaguugaucaucaaggggauggcagcaguggaacugaacaagaaguggagaguucaucuguaaaauuaaauauuucuucaaaagacaacagaggagguauuaaaucaaaaacuacagcuaaaguaacaaaagaauuauauguuaaacucacuccuguuucccuuucuaauuccccaauuaaaggugcugauugucaggaaguuccacaagauaaagauggcuauaaaaguuguggucugaaccccaaguuagagaaauguggacuuggacaggaaaacagugauaaugagcauuugguugaaaaugaaguuucauuacuuuuagaggaaucugaucuucgaagauccccacguguaaagacuacacccuugaggcgaccgacagaaacuaacccuguaacaucuaauucagaugaagaauguaaugaaacaguuaaggagaaacaaaaacuaucaguuccagugagaaaaaaggauaagcguaauucuucugacagugcuauagauaauccuaagccuaauaaauugccaaaaucuaagcaaucagagacuguggaucaaaauucagauucugaugaaaugcuagcaauccucaaagaggugagcaggaugagucacaguucuucuucagauacugauauuaaugaaauucauacaaaccauaagacuuuguaugauuuaaagacucaggcggggaaagaugauaaaggaaaaaggaaacgaaaaaguucuacaucuggcucagauuuugauacuaaaaagggcaaaucagcuaagagcucuauaauuucuaaaaagaaacgacaaacccagucugagucuucuaauuaugacucagaauuagaaaaagagauaaagagcaugaguaaaauuggugcugccagaaccaccaaaaaaagaauuccaaauacaaaagauuuugacucuucugaagaugagaaacacagcaaaaaaggaauggauaaucaagggcacaaaaauuugaagaccucacaagaaggaucaucugaugaugcugaaagaaaacaagagagagagacuuucucuucagcagaaggcacaguugauaaagacacgaccaucauggaauuaagagaucgacuuccuaagaagcagcaagcaagugcuuccacugauggugucgauaagcuuucugggaaagagcagaguuuuacuucuuuggaaguuagaaaaguugcugaaacuaaagaaaagagcaagcaucucaaaaccaaaacauguaaaaaaguacaggauggcuuaucugauauugcagagaaauuccuaaagaaagaccagagcgaugaaacuucugaagaugauaaaaagcagagcaaaaagggaacugaagaaaaaaagaaaccuucagacuuuaagaaaaaaguaauuaaaauggaacaacaguaugaaucuucaucugauggcacugaaaaguuaccugagcgagaagaaauuugucauuuuccuaagggcauaaaacaaauuaagaauggaacaacugauggagaaaagaaaaguaaaaaaauaagagauaaaacuucuaaaaagaaggaugaauuaucugauuaugcugagaagucaacagggaaaggagauaguugugacucuucagaggauaaaaagaguaagaauggagcauaugguagagagaagaaaaggugcaaguugcuuggaaagaguucaaggaagagacaagauuguucaucaucugauacugagaaauauuccaugaaagaagaugguuguaacucuucugauaagagacugaaaagaauagaauugagggaaagaagaaauuuaaguucaaagagaaauacuaaggaaauacaaaguggcucaucaucaucugaugcugaggaaaguucugaagauaauaaaaagaagaagcaaagaacuucaucuaaaaagaaggcagucauugucaaggagaaaaagagaaacucccuaagaacaagcacuaaaaggaagcaagcugacauuacauccucaucuucuucugauauagaagaugaugaucagaauucuauaggugagggaagcagcgaugaacagaaaauuaagccugugacugaaaauuuagugcugucuucacauacuggauuuugccaaucuucagguaugcaaaaauaaauaaaaaauucauaauuuguacuucccccucuugaguuacuacauuguuuaauuuccucugaagcuaaucaaauuuaggguuacuacuuaggagaauaccacuuaaaaauuauuuaggaguuuauuaaaaaaaguuucccuauuuauuuuuaugcugccauuggaagauauuuugaacauugcuaguauucaguaucagggaucucaaauuuguugaguaaaugacaaaauuucuuuaucaauguuuagugcuuuucucuggaguaaugagcagaaggaaaagcggacuggugccagugguucaguagcuauuuaguuauauaauggaagugagugcuugguacugguaugacauggugugucaaaauuuuaacugccaugcauauggcuuuuuaaguuugaacauauaacuuugugucucaugaaauccccuuuaauuauuuuuaauuuaccucauuaaaacccuuuguugaugcuuauuaacuaguuucuaaugacaugaacagauguuuuucuuuuaaaaacacugucaaaaugaaggaagaaaauccaaacauuagcuggauuagccuacccugaugagguagaguacuaggaacauuaaaguuugggucagcuggugaaugaaaauauuuuuaugaauuaauuaaaaucuuuaaaauuuaugaaaaauaauuuuaaaaauaaguuuuuauuauugaaguuauuuuaaaaaucaguuguauaauaaauguguauuggucauuugucuuuuuuuuuagucaguaagaccugucaguucuauggauacucagaauuuauuuaaaaauguuuauaaaguggguuuuacauaaaauuguauuuccaacauagguagaauuuaaaaauuuuuccuuccaguucuuauguuacaguuuucaauuuaucccaauuggauuuuaauggaauuaauuugaaucuuggcuauuuuuuaaauuuuaauuuuuaauuuuguagagaugaggucuugcuauguuacccaggcugaucuugaacuccuggcaucaagcaauccuuccaccucggccuuccaaaguguuggaauuacaggcaugagcuacugugcccagcaaaaucuuguuuuuuaauaaaacuuuacauuucuuuuauggaguacuuaugacuugacuugaaaaccacaugugauaugcaguguguguguuucaauugaaugcucugcuauaucagaugacuagauggagcucuguuuguguggcuauuguaacuucaaguucacaguuucuuaccugaaauucuuggggucuguuguguuucagaauuugcaacuuuuugguuuuuagaaaaauaauagagagaaguuacuauauauuuuauaaaagcuccaguggggccugaugcagcaccagauaaucaaacacauaguauuucugcagcaaaacauuugaagauucacauuuaaaggaauaagcaguuuagaccagguuuugcugccagauugucuuugguacccucuuacagaaacuuuccauuuugagaguguuuuagauuucaaaauuauauauaagggauuguggacuuauauuaaaaauacagaaucuaauauuuacuuugaugucaaaucaauguuuuaguuguuagguuagcugugaaaauccuuauuaaggauuagaguuuaagaauaauaaauuguguuuaaaaauuaguuaaaauccauuaaaaauuauaugucacugagcuaauuuuauuucugguuuuauuuauuuggaucuucucucuuuuuuucuuagucuggcuauuuuuaaacuuuggaaaauugguuucugugauuaaacaguuucacuggugaaaucaguauguuugauuucaaguauuuuacuacuuuucuuaagaucucacuugauuuauugauaccuaugaaaguuucuguuaugcaccucucauguugagaauuauuaauauuuaguguaauaauuaauaugaauucauuaggccuuaagaagggauggugauauauggcaaauacucaauugaugcaucucuugauaauuacuuaucucagcacugaucuagaucacuguguuccauuuugauuuauuuaacuuugaucugaaggacaaauaggcugauggggaguaaacuuuuucucagguguguaucaagagaaacuuugagaauucgucacuucagcaaauuccaauccuucaacugcuuggugaaauaagccuuguugagauuuucuuuacccuggauauuuuugggggcuaagcugauuauuugggaugaaauaagaaagaagauaaauuuguuagggaauuuaaccugugaaaaauugggccuugucaauagaaacaaguagaauagaauaugagugccuugaaaauaagcgcuguaaaaaguucuguuuuuaaagauaaguuugcgugugagccaguguuaugauauuccuucagaauuuacuuacaugcuuauguaagcaugcugaauuuauguacuccucugucuaacuuaauuuuaggucacaguuuuagaagguuaaaagaaaaacccugcccccuauugaguuuagaggauuccaguuuauucgcaguauuuggguaucauauuacagcuacaguauuuuccuagaaauuggggcuugguaauggcaugaauaaccaagaugaagaacaugguccuaggagauugcaguuuaaugcaagacagacauagagaaaucauuaaaaaaaguaacagaagaaagauauaaaacuagaauggggccuguaaucccagcacuuugggaggccaagguggguggauuaucugaggucaguaguucaaaaccagccuggccaacauggugaaaccccaucucuacuaaaaauacaaaaaaauuagccagguguaguggcgcacaccuguaaucccagcuacuugggaggcugaggcaggagaaucgcuugaacccaggagauggagauugcagugagccacgaucgcgccacugcacuugagccugggcgacagagcgagacuccgucucaaaacagaaacagcaacaaacacaacaaacuauaauggggcuacacaauaaauggcaagugaacuacuuaaauauuuggggaaauauuuagaagaauaguuggcauuugaacuucaaaggauaggucaaauuuugaaagguguaguaaagagggagugacaguacuguuacuaauuauauuucauuugaagauuggucuguuugaaugagauauuuauugugaguuugcugggauauuaugaaaucucuucucucucucugucucuuuuuuuuuuuuuugaguugaagucucacucugccacccaggcuggagugcaguggugcaaucucggcucacugcaaucccugcucacugcaaccucugccuuccggguucaagcgauucucaugccucaggcuccuggguagcugagauuacaggugcaugccaccacauuggcuaauuuuuguauuuucaguagagacaggguuucuccauguuggccaggcuggccucgagcuccugaccucaagugauccgccugccucagccucucaaaaugcuggcauuacaagcuugagccaccacgccuggccuuauuuaguguauuucuauccugagccuguaggugucuguuuccuuuauagauuuuuuccuccauuucccuucaacauuuuauugugaaaaacauuuaaguauacaccaaagcaucuaccauuaauauuauacuguauuuucuugauaacauaucuauauauccuucugucuauccaucaguauaucuuuuuuuugccuuuuuagcuuuuuauuuugcauaauuauaaauccacagaaauuuguaaaaaaaaaaaaaaaauacagggaggucucagauaaccuuuacuuaguuucccucaaggguaauaucuuguaacucuaguacagugucaaaaccagaaaacugaagauuuauucagauuucaccaguuucacaugcacucauuuguguguguauaaguauaguucagugcaguuguaccacguguguaucuuuguauaaucaccaccacaaccgauauaucaaaccaguuccauuaucacaaggcucccuugugauacugcuguccuuaccuccauuccugacaucuggcaacuaguaaucuguucuuuaucacuguaauuuugcuauuuugaaauggaaucaugaaguauauaaccuuuugagauuggcuuuuuucacuuaguauaauacccuuaaaaucuuugaugcauuucagauuaaacgguagacaucagcauacuucuccugaaacacuuaagcaugcauaguauuaaccuacaguuuaauauuucaguuuuucuuuugaaguaaaauuuauauagaaugaaaugcccaaaucuuaaccucuuuagauuuuuuuuuuuuuuuugagagaguuguuacccaggcuggagugccguggugcgaucuuggcuuacugaaaccuccgccucccagguucaagugauucuccugccucagccucccuaguagcugggauuacaggcacacaccaccauggcugguuaauuuuuguguuuuuaguagagacgggauuucgccauguuggccaggcuggucuggaacuccugaccucaggugauccgcuugccuuggcuucccaaagugcugggauuacaggcgugcgccaccucacccggcccucuuuagauuuuuaaucaaaauauagaaaugcagcuuuuuauaagaaaauaaguuuuacuguacugaacuguaucucuggguaacucaggucacaaauaccauacacauucaacugcauuuuaaaauuacuugcuacuaccaaaauauuaauacuguuuuugcuauuccucgaagauacagcaccaguuaacgucaaaauuaaaauggaccaguacgaagguuauuguggcaagaaacuuaugcuaauaugauggcuguugauacagaauuguuacugagaaggguggacuuuaaaagccuugugcccugggaaggaacucugaaauauauaagguccagcuauuuaucauuuuacugcuggcacuucacaaauaaccuguuauguuuucuauaagaaugcuuuuuacucauauuuuggaguccagaguuuagaccccacuuaguuugcuuuaaaguuuuuggcuuucaguuuuauuuuacaugguuuuaauuauauagcuuauuuaaagcuaauuuuaaguacacuuuuuucccucaaggagaugaagccuuaucuaaaucagugccugucacaguggaugaugaugaugacgacaaugauccugagaauagguaugauuccaucuguaaggacuuuaaaaagauuauaacacacccuaggcaugggcacaaacagcagcaacggaacagcaagcagguuguaaaaaccaggagugccugccuuagaaagacucgcucacagucuuccugcaaguuugaaagaaaggccagaaaaugggcuaaaacucagaaaccuuaagagaaaguaauaucauuauuuacacaccuagcauaggguguguuauaaauacagaacugucaauuuuauguugcuauguaaacugcaguaauuuuuuuggaauaauuuauuuugacagauuauugaugaaaguaaaucauaucucaguaaauugguaacaacagacaucuccucuauauuugacuauuguuaauugccauccaauauggugguccuauuuauuaaggccuguugagaagaaacaaaaagagagauuacucagauauuuaagauuaagaaauugcuuucaaaauaagugucaguuuacaagguaucuagacugaguuagaguuuaaccaguuuucaaauaaaauagaaauacacgguaugagagcauuuacuuuaauaagacuuaauagguuuaaaugucaacaguguagccuauacagauauacuuaaguaagggguggcugggugaagaaaaaaaaagacacuaucaguguagugaagaauaaggaaaacaacaguauuaaagacuauagcuauaauguuucaacauaacuuuuaaacacuuccuggacaauagcauaccccaugcucauaaucuucaacaagaagacagcaugguauagugcauggaauuuuggaauaaugggcauaaggguaucugauuucuaacauuuuuaacaacugucugugucaucaugggcaagugacuuuacuuuuugucaaaaauuuacuauauuuaagaagaaaaaguugggcgaaauuuucuguaauucuaguaccaaaaaauccaugauagauuugagaugauuucauuaaagagcacuacauuaaccauucauuuauuccuaauaguaaguucuaacauuaagaaaacauaaaaauauacauguaauuuucugucauaauuuuguaagaaauuaacugacuuaguaaaugcccuggguucagcuguuaguuucgcucuuuuauaucuugcugaugcuguuagguuucucuguuucaaaggucagcauucugcuaauuaacagaagaauguuuuuauuaaggugaaugaacaguuuuauuuuacaguuuugaauagagcuuaauuguggacacaaauauucagauucugcuugccuacuuuuuuaaauuaaaaaauguauauccauuuauuuuaugggauaggugguagguuccagaauggagugauaagggcauacaauuuauucaucagggauuuuacauuauaucaucacagccagauacugaaagcauuuaaaauuuuacucuuuuuuaagaugcuuuaauuuuucuucauuuauauuugcuauuugauuuucuauacaucaugaggccucagauguuacucaaaggcuaauaauguuuuaaacauucuauaucuuaauuuaacugugaaugauuuacuuuaauuucauauuuaaccaccaaauaagaguguuguuaagguauaauuuuuuuguguguguuagagcuugucaaaauauaaauaucauuuucaacuuuuaaguuaccugaucguaucucucuguaacuggcaaguauuuuauuggaaaguaucuuuaauuccaccuugaauuugugauuaaaaaauacaacccuguugaguacuuuugagaagaauugaauuuuaucuugagcaugucuuucuauacucaguuuaauuuguuuuuauaaaauauacaauuuauuaacuuguuuaauauucacuauaccaaagagguaucuaauacccauggguuauguagucaugauggggauacaaauacuuucuugcacuauuuuaguauagauuauauauuugagcauauuugaauaugcacuaagcaacuuaaaaaauucauuugcagaucacgauuaagucuuagaauuauuuuucuaacuuccuaauuuuugaguagguuguauuuugguagacagcauauuguaauuguauguaaauuuguacacaauuguguguaaauuguguauaaaucuuauaugcuuugucuuuuuagcaguauuguaauacauuuucaguguugguguuuaugaagcgauaguguauuauugcaaaugguuaacuauuuggaugcaauaaauuuuuguaaaccuuuuuucuuguucaagcauuuaauuuuaauaauaauguuacuuuuuuauaucaugagaguugacauaauuuguuauuaaaauauagaggcuaguuuguagccaaagaaguuuugaaauuuugaaauuuaggacguaaauacuuuuaauuccccuaacauauauacuuauauauauuugugugaaaguuuuacaacagauuuaacuacuauuuacuuuuucuguuuuaaagcuaugauggcuuuugggggcauuuaaaaaacuuagucauauccugaauauuuuaguaaaugugaauacauuucuguuuuagcaugcuauuauguagcgucacucauauuugaaaguaaauguauaauauuaugagacaguggucuaaccuauaaauuaauuucuauuuaauuggauuuacuuaaugaacaaggacagaauauuauagauugaucaacacuuguauguuucugguuuagcuuuuuauaaaaaaaaguagacuaaucauauauuuugaauuuuauauaacugaaaauuuagagcuuaggcuuuauguaguuucucaauggcagaauaauaauaccaaauagguugucagguuuucacauuuauacacguaauuuuaaaguaauauacuugaaagugccauuaggguaggguuucauuggccuuucaaauaccuguuaguuggauuuuaaauugguucuuucucugaaaagacaucuauucauauaauuuauuucaauucaauaauuagccuggcauugaaaauacaccauaauuccuuuauauguucaauauaacuggggauauuuugaccaaacauuuucuaauaauaucauauauuuuaauuuaauaucuguacugggaaugagccucaaguaauacgauaguaguguguucaaguuuuaacaguauuaguuuugaggaucauuaaacuaggcuugucuuuagagauugcauacugaacaaucacugaagagaccauuuaucccaaaaaagaauuaucuuuugaaauuucuuuauucgcuuauuuugcaggaugugagaaauauuuacaauugagcuuuugagagcaaaagaccaaagugcuagguuuuucuaaauaagcauucuuucucccugacaacuuugacuaagagcugagauuucuacauggaugucugcuccccuaacaaacacauuuacuuuauuguugaaaugugcuuaauugggucuaguaauacuccacauuuuuucucauaauuucucugugggugcgacuaaaugcuuuuuuuuucauagaagcgaaauuugauguggagauugcuaaaaaaaauugucccauuguuauauuuaauuauauugggacuagaccauagcauuuuaaauuuccaacuguuguuguaucauuugaugauaauuuuguguuucaaacuagaaaauaugcuaaugauuuuuuuuuuuccuacuggcuugguguggguaugcuguugaugacggcucuguauuguuaauccagcauauuuucggaggaaacuaaugauuucuggauguuauuuaugccuaagaagauauuuaaugauuguuuaccugauuucagcacaauuaauggcauggauguaucacaagucccuuaaucguuugauguucacuuugcuuucauuuuaaacacuuuuucaaaugucugucuccuacacauguugucuauucucuaugcaaauuugcuaaauuuggaauaauuuuuuucugugauuuuuuuuuugugguaguucuguuucguuagcaaaacugcuuugauucuccuuuauuguacuugaaaaacaaagguggcguuuuaaauuaaguauuuuacuuguuuuuccauuugaguaaggguuuuaaauaucuagcaauuuuacgguaauuuuuuuuucaauuuccuuugucuguauagcacagguaaguauugcaagucauuuaaguauaacacagguguccagccaguagauaggaucuacuuguagauaucugaacuggcuguaguuguuacuggcuuucuuuuuucuacuagaauucccagucaggaaagacauaugauguguaguggugaccuuuguccuucuauggucaagauuuaaacauuauaaccaguguuucuuucuuguucucuguucuuuggugauauugggacuuucagaaaauaagaaauaggucuuccucaaaaaagaaaaaaaagaaaaagagaaaaaggaagaguuuggauuucuaguguuaggaaaagugauucauuuuucugacuuaauauccuuugucuuuaacuuugaaauuucaaaauaaaauuuugaaauuugagaugaguaaauucuguguuuucauuuuucaaguauaaaaauauugaacuaguuauuuaauaugaucaaauuucccauauuaauuugaauauauuuuuucuuguuaaaaugccucuaaaacugguuuagauuuuuguauaaaauuagggaauacacauguaauaauucaggccuauugaaacauaagucuguaugaauuauuaauaacuguggguucuuaauuucauaguuuuuauuguucuaccuccaagauuuuuuuaaaaagucauuugauauuaauuuuccugguacccucaccaaaaaggauacagagcuacuuuucauuaacuacccacauuguaggauuugcgacuaaaaaaaaauauuucaaaccauuguuuagcuuuuugauuauuuggugacuucauuauuaucucgugaauuccaccauuuugggguacagaucauuaugccuuaguuuuauauauauauauauauauauauauauauauauauuuuuuuuuuuuuuuuuuuuuuugagacagagucucacucugucacccaggcuggagugcagaggcaugaucucggcucacugcagccuccacuucccuguuucaagcaauucuccugccucagccuccugaguagcugagauuacaggcacccgccagcacaccuggcuaauuuuugaauuuuuaguagagaugagauuucaccauguuggccaggcugcucucgaacuccugaccucaagugauccacccgccucagccucccaaagugcugggauuacaggcaugagccaccgugccuggccagucauauuuuuuaauagaaaacuuaagauacuaauuuugaaccugaguugaaauauauacuaauaugaauuuugaagaauuccauauuccauaacuuuuuuuuuuuuuuugagacagagucucgcguugucacccaggcuggagugcaguggcaugaucuccgcucacugcaaccuccgccuccuggguacaggugauucacuugccucagccucccaaguagcugggacuacaggugccugccaccaugcccggcuaauuuuuguauuuuuaguagagaugggguuuugcaauguuggccaggcuggucucaaacuccugaccucagguuauuugccugccuuggccucccaaauugcugggauuacaggcgugagccaucgugcccggccacauguuuuguuuuuuaauuccuauccuuuaaauauaugacauuuauuaaaacaaagccucacacccuacuaaaauauuuaacauuccuuggcuauacuccuuugaauuauuuuauauaucaaacuuuaaaauauggugugaugcuuuaguacuacauauacuuagguaccucuaaagagcaugcauuuaaacccauuaucuuauuuauaauucuguaaauuaaguacucuauuaugauauuguacacaaaaaccaauuuuuaagcaaauuuuaucaccuuguuuauggaugcccaguauuuuggccuucuaaaaauauauuuuuuuccagcaauuuucuucaaaccuguucucagaaccucuuaaaagauaaaauggucauuguagaauguaucucagaugaccuaucgugcauuuuagagugcauacuggauuaaauauguuuaaaacuccuuuuaucaucuuuaaaaacucaagcugguugcaguggcucacacuugcaaucccaaugcuuugggaggcugaggugggaggaucacuugaggccaggaguuuaagaccagccugggcaacguagugauaccuugucucuacuaaaaagaaaaaauuagccgggcauggugguacaugccuguaguuccagcuacucaggauaccgaggcagaaugauugcuuuagcccgggaguucaagguuacaaggauauguguuugugccacuacauucuagccugggcaacagagcaagacugucucuaaaauaaaauuaaaaaaaaaauuaaagcuugaguucuugcauuucuaaauacauaaauuuaaaauaugcgaaauacacuuauuuuuaaaaaugggggucagcgcgguggcucaugccuguaaucccagcacuuugggaggcugagguggauggaucaccugaggucaggaguuugagaccauccuggucaacauggugaaagccuguuucuaauaaaacuacaacaauuagcugggugugguggcacacaccuguaguccuacguacucgggaggcugaggcaggagaauugcuugaaccugggaagcagagguugcagugagccucccucacuccagguugagauugugcuacugcacuucagccugggugacagaacaagacuuugucuggaaaaaaaaaaaaaaggcaucaucuguauuugcccaggcacucauuagcauacaaguauuaacaaguagaggguauagugcuggcacaguaaaauuaauagcagauugggauuuaggaucuuagguucuacuccugacuuugccacuaguuagcuuuguuucuuuggcugagucauuuccuauaucuaagccuguuuccucaucuguagaaugacaaagcuguacucugagguuuguccuucuggcucuaacauuuuguauugcuuuuguuaauggcucgaaagcucccuggugcaggagguccuucucuugauugcauuuuaagaaacucaacauuucgaauuauugauuuaccuaucagcaagaggugguuuacuuuccuuuccuguuugagcguuuaaacaagcgacauuacucauuuccuuucuagauaggauuggaguuaauaaaggcuuucuuggcuuucuccuauguuuuuuuuuuuuuuuccccgauugcuuguuugucauuguguuguugggcucacuucuuauuauuuuauuugugcuuucuuuuaguaaugguguuaucuugguguucauuauguacuuuggaagacuuaguauauguggguuuugggguccuauuuauuuucucaugcgccaguuccgaucauuguuuguuuguggguuuuuacccuuccucccauauuguuuugcuuucucccccucucccuucccucccuuucaggaaaauggaggaguggcuccauuacuucuggcucugcccagguuuucugccacaagaguggcacggccugugccucuaaugcuucugauagagucgugacugcuuuggaugcuacaccugccccaagauguaauauugagcauugagauuccaggggcaguacaucguccuggaaagccucaagaaaggaaacuucagagcaaacagaaucaacuagggaucaugacuauacauccagcaugauccagcauggguccagccgaggccuccaaaaugaugcuuugccagccucagcugguucucaagugaugauauccuugaagucucuguggcccgugacuccagaguuaagguaguggaguuucccuuuaaagcaucucacagcaggcuuuguagaugggacacaucucacuucaacaugcuugcugacuacucagguugaaggucagccucagcccuuagguccguuaaauuaaguucuaauuuugaaauguagguuauuauguuauaggcuagguuuaugguagacugggucuuugacauauuggacuucaguaauaacuuaugcaaaaugauucaacuuauucuuuuuagggcuuaauuuacauagcuauaaauuagguuuuccuuuggacaaaagguguuagagggcaaaaauaaaaccuuuagccagguagucuccaucacucuguauauaauuugugauuuggagaaaaaugaccugaaguuuguaauuuuuuggcuucugaauguacuaugauuguucuauauguuaugaucuuacugaaaguugucgcuaaguuguacuucuacaguauguggaucugauuucacuuuauaugauuuauuaauagguauacaauuguauuuuaucucauguacaucauauuucuuagucuaaugacaauccagaacuugagaaugcauuaaguagguuuauguauugugacuuuccguuuuuuaguagacauauucuuuggagacugggauuugaaagaagaaaaauugugugauuuccuacaauuaacaaccaaaucuuuauaguuaauaggaauuuuuuaaagacuuuuuuugaacuuguaaacacaaacugaaaucagguuguugaacuaggcuuucaaguaacuagauuaggaauuguauuuuuguuggcuguuuaguguucaacccaaaugaugguaugagaucuuguacuugcaaguaaacuguguuuuuccauuucuaauccaguauucaaugcuucacauauuuuauacacacacacacacacacacacacacacacacacacacacauauuuauucgucccaaaauucauuauucagauuaguuugaggaaguuuuucugguccaugagaaaugacaguguaguauuacuaaagaugguuuuaauauauaccaacagaaaaaaaaagugcugugccagacauagaaauuugcugcuaacauuuuauuuuaguaucuucuagucuuuuuuagggacauacaaauuuuagaaguuuuuuuuuuuuaaauagaacuauauugugguuuauaaauuacuuuuucacugaauauuaauaaauauuuucuaucuuaaucuuauuuagaauaucauuuuaauuucuaucucuuauggauaaucaugugaaaauacuauuuaaucaguuucugauauugaauguuuaaacguuuucucacccuuugcuauugcagacaacauuauaauaaacauacaugaauuuuuuuuuucuuuugagacagaguuuuguugcucagguuggagugcaauggcaugaucucagcucacugcaaccuccgccucccggguucaagcaauucuccugccucagccuccugaguagcugggauuacaggcaugcgccaccacacccagcuaauuuucguacuuuuaguagagacaggguuucgccauguuggccaggcuagucucguacaccugaccucaggugaucugccugccucugcuuuccaaagugcagggauuacaggcaugagccaccacaccuggcugaaauuuuuuuuaaaaagaugauuuuagagaauuuuuccagaaagauguauaucuucaauuuaaaggguuucccuuuauucugaaacuguuuccuaauuuggggaggguauguuguaaauagucuuuauuuuauaaaugaugaaaguaaauggaauuuggguuuaaauuucuuuuuuuggcaaaaugaaaaguuggcaacccuguauuugucccauuuuaagaaagcuuacagugugcaaaccauugaucuagaaauguaagagcaaaacuuuauagcucaacuuuaguaagauuuaaauuggugugaucuaaucuucacuuuauugaaauacaaaucagggcagaaauccucagaaaagcaaacccaucuguggcuuccuuuagcaauugaugauucuguguguugucuaaauauuccugauccaucuguuugagggagaaagcaccaaaaggcauauaauaaacauuuauggaagugauugccuauuuugcuucagucuauuuagaugccuuugcuaugcaucuuugaauaugaauaguaaugaacaaucuaucugucaaauaaaauuuaggaggcagcuaacaugcauuaauaucuccugccauugaaugaauucuucauugaaaugugggugcgugcuaagaaguguaaagagggguuucaaauccagaaauaacaaauguuccaucaucucagcuacaaguuuuugacuuagagagucagucuugauugcagagaacauguuuaucccauacagauuagcucauggcagacugucaggaucaugccaucuucuuuuugaacuuuucuauaagcuauuuucuuguuaccgugauuugugaauuuauauugaaaggauacccagacuuaucaaaacaucuugucuugcacaaaagcuguaugauugcuuuaaucuuacauuuucaguuauuuuucuugaguauaaacauggagauuuccuaggaauauauuuuauuuuaacauaugaugguaggaguaaaaguaguguuuucuuaugcuuuuaguaauugauuuuuccauuagcaaauuggucuuugaggagcaucuugagaaauuuuguugugagugaagcaacugcacuauuuuuuuuaaaguaacccauuuaugguaauucguguucuuuuuaccauguauguaauuaauagcacucaugucccuucuuuccccugucuugaauauuauuagagauuauuuauugcuguaauacuuaacauuuguguaugcuuucaucugguucacagcauuuauguaguacauugaaauuaagguccaaaacuaucauccucuaguuugaagcaaggugucauuauauagugguuuauuacacauugguuuuccaagaauauauuuugcuguugaauaaaaccucucguggaguuuuaucuuggaaugccauuuaucugaacaaguucauuuacuguuguugaccugucugacuuuguaguuguaggauggugucagcaaagcaaauagaggauuggaagguuaugcagcaucaaauugcaauugguaaaaauagucaauagaauauguccuucagaguuuucaauauauugcagaauuguauagaauugagaaauaauaaguguaaagaacauuuuuaaaaguuuuuguuuauagcuuagguuaaaacaugguuuugcuaguuguuuauuuacaauauaaaaucuauuggcacauuuauuucuauuuugauucaaagaagucuguuuuuauuuuuaauuugguguauuucacccccagauauauaguucuuuuuuuauuguuuuuuacucucaagaauugccaagaagaugcuuuuagaagaaauuaaagccaaucuuuccucugaugaggauggaucuucagaugaugagccagaagaagggaaaaaaagaacuggaaaacaaaaugaagaaaacccaggagaugagggugagcuccccagagagaaguuuauaaugucauaauuugauuccuugacuaauucagucuuugaagaauaucugaccaagaaauaucuuaauauggcccggcgugguggcucacgccuauaaucucaggacuuugggaggccaaagcagguggaucacuugagguuaagaguuugagaccagccugaccaacauggugaaacccugucucuacuaaaaguagcugggcgugauagugcgugccuguagucccagcuacucaggaggcugaggcaggagaaucacuugaaccugggaggcagagguugcagugagccgagaucacgcugcugcacuccagccugggugacaaagcgagacuccaucucaaaaagaagaagaagaagaagaagaaaaaaaaucucuuaauacuuguauuuagaguucauggaaauguuuaaaacuuuauuaccaugacuucucuugaauaucuuguaauaauuauggaaguuacucuaauuuugucaguuacugccaauaaacagaugauuuuuuuuuuuuuuuugagacagaguuuugcucuuguugcccaggcaggggugcaauagcgcaauuuuggcucacugcaaccucugccucccggguucaagcgauucuccugccucagccucccgaguagcuggaauuauaggcaugcgccaccacacccugcuaauuuuguauuuuuaguagagacgggguuucuccauguugaucaggcuggucuugaacucccgaacucaggugaucugcccaccucggccucccaaagagcugggauuacaggugugagccacugcacccggcccuaaacagaugauuuucaaagcaaaauauuuuauaccuuacaaaggguucuauaaauauauaggugauauuuagucaauauuuaauaauaguaauaugucaagucugaugugugagauuaccugauaacaccaaugauaccaaaguaugugucuaacucugauuuuuuucauaaguugcaguaguugucaacaggcaaaauagauauacgaggcauuuuaaaggcugaagaagguuuuauugauuuauuuccuucauuuagaagcaaaaaaucaagucaauucugaaucagauucagauucugaagaaucuaagaagccaagauacagacauaggcuuuugcggcacaaauugacugugagugacggagaaucuggagaagaaaaaaagacaaagccuaaagagcauaaagaagucaaaggcagaaacagaagaaaggguaagauguuuuaauucugaauguaaagaacauauuggaccagacaguggcuuaugccuguaauccuagcacuuugggaagcugaggugggcagauugcuugagcccaggaguuuaagaccagccugggcaacauagggaaaccucaucuuuaugaaaaauagaagaaauagcugggugugguggugugcaccuguagucccagcuacuugggaggcugaggugggaggaucaccugagccccggaggucaaggcuguagugagcagcgauugcaccacugcauugcagccugggcgacagagugagacccugucucaaaaacaaaagcaaaaacaaaaaaaauacugguuuuguaaacuaauuauaguaaugaaauuuaaguguauggccaggcacgguggcucauaccuguaaucccagcacuuugggaggccaagucggguggaucacaaggucaggagauugagaccauccuggcuaacacggugaaaccccgucucuacuaaaaauauaagaaauuagcuggguuugguggcacgcaccuguagucccagcuacucuggaggcugaggcaggagaaucgcuugaacccaggaggcggagguugcagcagugagcugagauugcgccauugcaguccaacuugagcggcagagcgagacucuuucuccaagaaaaauaaaaaaaaaaaaauuuaagcauaucugcucaaacaguugaccacuuauauuaagcaaaugucaguacacuggcaacaaguauacuaucacaugagauuaaaauuaauaauuuagagugggaagauaacccagaaacuuuagaugacacaaagaauauuuuuaaccuuuagauuauaaagagaaauaaauaugauuuaauaaauaaaacauuauguagaaaguauaagauugcauacaacugcagaauuagugcuuuccuguagaaggguagaaaaugaaauuaauuuggguaaauuuaugcaagcuuauaugcagaacuugacuggcauauagucagaguagauuuccauuucauuaaaagccugaguccuuuugcauugagggcuuacauguuuccagcaguauggugggcauugaggauacaaaaaugaauaaaaauguaucucagugauucugauagguaacuagguuuggcagucacugguuuaguaagaauuauugaccuuuguauuauaaaaaaauuauagcaccaugagggacauuuuguguaacguaauuauauaauguggcacaaagaagggcuucuuuagcuucuugagggguaggaguuaccccagagaaggcuucacaaagaaggcuuuuacccaacagauuaaauucaaaaugugggagcacguagauuguugugaagauuuacaacacaagcagggaaaaaaauuuuaaaaccuguguaaaauguuggcacaugauggaugggauacaauuaauauaguauaagcugcucuauagauaggaguagggaaaggaacaacaggggaugaagcugggccuguaaaacagagaccagauacuggagaucuuuguaagccuguguuuuucacacuggaguacugggugguauaccaagguguacaucucuuuggugucucuauuuauaauuugagguuuggggaaggucauuuuauguuaaauaauauauauuggguaauuaaaugugauauuugccugcgaauuuuggguaacaaaaaguucaaagaauuuuuuuguuguugcuguggugggcuuuuugaugacuagggguaaauuuugaagacuguuguuaguacccaacccauggauggcagaugaacucuucuuugccaacugggaauaggaacgcauuuuugcaaguguuugggaaauauaauaggcucuaaaggaugcagagccauugaaaaguuuuuuuuuuuuuucaauuacuguauuuauuuuugaacucuggaccucugguuauccaccuaccucggccucccaaagugcugggauuauaggcgugagccaccguaccggccuuauuuuuaaauuuuuuguauaacagcuauauugagauauaacucacaaaccacacaguucaccauuuacaguauacaauuuagcaguuuuuaguauaaucauagaggauuaccaccacuuuaaaaaauguuuuauuugaaauguauguacaaagaagugcacauuaucaauaaguagacaucuugaugaaaacguagggcacccagaucaaggaacaagauguugauuacuaacacccaagaaucacaaucucagcaugaccacuuuuuucccuauugaaagauuuuaaucaaagauaucauaugaucagauuaguuccuuacuauucagugagaaugaaggcacugaauguuuggaagguauugcuguaguugaugacaaaugggguuguuggagaagaggaagauugacuugagucuuauaggagguugaauuguuaggucuucuuaauugguaugaaagggaaaagucuacaaugagugucagguuuuuagaguugucaugguguauguacaauaucacagaaauaguugagguuauucaguggaguuguaauguuuuacaaauggaaagcuaaggacauagucuuggaauccuaaacauuuauagggcuuuugggcaagaguuauucacuaaagaugagggggagaaguucuugccacacacauauacaauuaauaugucauggacauuuuaauguuaauaaauaauaguacaucauuuugugacuacuugucuuauaaauuucuuuuuuauuauuauuauuuuuuuauuuuuauuauuuauuuauuuauuuauuuugagucggagucuugcuuugucgcccaggccggagugcaguggcgcgaucucggcucacacugcaagcucugccucccggguucaugccauucuccugccucagcuucccuaguagcugggacuacaggcgcccaccaccaugcccggcuaauuuuuuauauuuuuaguagaaacaggguuucaccguguuagccaggauggucucgaucuccugaccucgugauccacccgccucggccucccaaaagugcugggauuacaggcgugagccacugcgcccagcuugucuuauaaauuucuuugcaauauggcugcaagcucuuacagauucuauaaaggaacugugugauuuagcauguuauauaucacaacauggauuccugugccucuucaacaaaaggggcaauauugauuuugcuucugaagcuuaguucaauauauagacccuuuuaauauauaugauuacauuugagauuugcuuuauuaaaaccugaguuuucugugaucuguguuucuacagccugauucuguggguaauuuauuacccaagugguuuuguuguuguuguuuuuuguuuguguaggagagaguaaacuucuaaaaucucaucauauuuguguuucuaauauggauugugaucauagugguugauauauaguugaaguugcaugauuuucugaguuuuguaaauucuaauguuccuauauuauuuggaaauuugaauugagagaugggaaaaaaucaguagugaauagucugcuuauuaaaucuaguugaauuaaauugaaaugcauugaagagguauaagaacaaagugcaacaugugaacucuaauuuucuccuaaauuagaaaaauguuacaaaauuauuuuagugacaauuugaaauuguaaauauugccuucauauuagaugauaguaauuuuuuuuucagaugugauaaugguauuuaguuauguagggcaguauccuuaugcuuagggguaaagugucauccgcgcuuaauaucacaugguucaguguaagaaaaguugugucugccuguguguguguguguguguguguguguguguguguguguguguagagagagaaagaaaaaaagcaaaugugguaaacugcuaacaauaagugaauuuaggagaagggauacaaguguucauucaauaauucuuucaaauuuuugguagauuucaaaaauuuuaaaaugcugggugaacaauuaauacuaggcuuaaaauuauacuuaauuacaggauuuuuuugugucaguguguguguuuuugguauucucccagcuuuccaguugcuuagcuauucuuuuuuuuuauuauugugguaaaauauauguaacauaaaauuuaccauuuuacccauuuuuaaguguaugauucagugacauuaaguacauucacauuuuuauacaaccauaacuucugucugucccuaaaacgugucgucauuccaaauggaaucucuuuaaccauuaaacaauaacucuuuguuccccucucccccgacauuucuuuauagcauuuauguucucccauuuauagcauuucuguuagcauuuauguucucucauuuuuuaaaaagcuggaauagaucuuugauucugaucucagguuaugauagauuuuuuuaaaaaauuauuuugaaacaauucuugauuuacagaaauguuacacaaauagugcagaguucuguguaucuuucaccuagcuucccugauuuaauacccuaucauaguaccaugaucaaaaccaggaaauuaauauugguacaauacuaucaacuaagccggggguuuacaaacugcaccugugggccaaaucugauccucugccuguuuuuauaaauaagcuuuuauugaaacacagccauauucauuaauuuacuguuuucacauauguacaauggcaaaguugaguagagaugaguaguugcaacagagaccauacgguccacaagucaaaaauauuuacuaucaaacuuuuuacauaaaauguuuuaugaccucugaaguaaacuauagaucuuauucagagauuaguuuucccacuaauguuuucuuucugcucuaugauucaauccaggaucucacauugcaucgaguuauaaugucuccuuaaucuacuucagccugugacaauuccucagucuuuacuuugaugaccuugacacuuguggaguguugauuccuuauuuucucaacuguuccuugauauauauuugucuaauguuuucucaugaucgaauugagauuauuaugcauuuugacagaauaccacagaagugauguugugucuucagugcaugauaucaagaauagaugaugucaguaugucuuuuuuuuugagagaagaccucgcucuguugcccaggcuggaguacaguggugcgaucauggcucacugcagacucaaccuccugggcucaagugauccucucgucucagccucccaaguagcugggaccacagguguguaccaucaugccuggcuaauuuuuaaauuuuuuuuguagagacagaaucucccuauguugcccaggcuggucucaaauucgugggcucaagugauccucucaacuuggccucccaaagggcugggauuacaggggugagccaccaugcccagccgucaauaugucuuauuacucucacgguuaacuuuuguuacuugcuuaaguuggugucugcugguauuuuuccacuguaaagaagaaaauauuauuuuucuaucuauauuuaguauuuuguugggagauacuuugugaccaugcauauauccuguuucuuaucauacuuaagcccacuaauuuuaguaugcaucuugggugaagcaguuaguacugugguauuugccuaguuguaauuuucuauuuauuucauuacuuccacauuuaguaauuguaagggagauuuguuuuccccuauuuauuuauugcauuauuuauaucaauaugacuuauagauuuuuauuuuaccaguuauaaucaaauaguaucauuuauuuuauugcucaaauuguucuagcuuugguuguugggagcuccuucaaguugaaucuuguguccuuucaacaugugccugcccauguuugaacacugcuuuguuuucuggcacuauaagauguuguaagcuuaucuuguauuuuuuucugcccugcuuccucuggccagaaagagguuuucuccuggaauuuuauaugcuuccauuacuguguuaauugugagaaaaagaaaauugaggauuccacauguagagccugauuuuccugguguuguggcuagaaauagggauuuuucuucacagucuuguugucaguaccgucugcauaccuuuggaauuuagccugccuucuggucaaaaccaggaaacaaagaaagaaaauaaccauacgcccucacagcucucuccccuccaccaauuguagaggggucauuauucaaguuuugauuucagucuccaaucugccuauuauuguuucccuuuccgaguucuucgguugugucaucauugguggagacaaucuguaaucuuacuccaucuuggccagccuaccuugcuuguuuugaauagccaaacuucuuuuucauuaauuuaccuuugguaauuacauauauuuuauugacagguaauuuauucuuauucugucaauucauauacaauugaauacuuauauuuuaauguacaaccacaguuuuauaauuacauuagaaauacaucugaauuuuauguauaucauguaaagcauuaacugguauauucuauauuauguauuauccauucacauauauaccucugauguucuuacaaugcucuguuuuaaugucgagucagugguaaauuaagugaauuagguuucuauugaaaaauaauuaauaauuuuauguauuuuuuaaaauucaagugagcagugaagauucagaagauucugauuuucaggaaucaggaguuagugaagaaguuagugaauccgaagaugaacagcggcccagaacaagguauuauaauugguuuuuaaaaaauuuuaggaauuaaucugaaugaccaugccuucaaaugauuuauaugguuacuguuaccaauaaaguuaaguuagugugauauauaauauuuugauuugaaacuaauuguuauacuuaauaguuuaaaaagaaucuaagcauauuuuauguguaguugaauuauguauucuaaccuggguagauuuucagucugcaaaaccacucgugucugcaguguuuuauuguuacgggggaaauuguaggauaauaguaaagaggcuuuauagaaaaacugccucagucuaacuuugggcuuuucuacuuucuguuuguauaaauaaucuaugcuucaguuuccucaucuguaaagugggggauuacaauauacuugacugacuauugugggcauuaaaugagacaauacguguacaagguuuauaauaguaccuaccuggcaaauaguaagugcucaauauauaaauuauuggucucaguaguacuacaguaauaaugauaugcuuguucuuguaacacgaacagucacugaucuagauuaccuguaauuuaaaauuuggcuuccuucuuaguaugguauguuagauaauacuacuacuacaauuuucuuauuucccccagaauaacauaaucuuucuacaguuuaucaaaugaacaaucuguguguguuuguguauguaugucuacaaaggugucuaucugcauuuguaaguuuuagaacauucgagguuuuuuuagguuaauacuuaccagguugugcuuagaauauagcaauauauuauacuuuaagucaauauaaaaugaaaaugauaagauaugaugagagguuuuuuuuuuuuuuaaaccaagauacaauucagcauguuauacuguggaauacaguggucuucagaauauuugcaaaguugugcaacaaacaccacucuauaauuucugaacauuuccaucauccaagaaaacaacccuguacuuacuagcagucauuuuccauuccccaugcccucguacucuaauaaacacuaaaaucuacuuucugucucuauggauuugccuguucuggauauuuugcaugaguugauucauauaauguauauccuuuuaugaauggauuuuuuuuucacuuagcauaauguuuucaugguucauccauguuguagccuguaucaguacuucauucuuucuuuaaugauuauuuuuaauagugguaaaaugcacauaacauuuaccaucuuaaccauuuuuuuucuuucaugguauuacugggaauuuuuauuuucaucuuaacgauuuuuaaguguauggcuuaguaguguuaaguacauucacuuuuuuugaaccaaucuccaaaaccuuuuccccuugcaaaauugaaauguuacucauuaaaccacucucuuuuuccucuucccugaagccccuggcaaccaccauucuauuuucugucucuaugaauuuuacuacucuaggaaccucauauaaguggaaucauacaguauuugucuuuuuugacuggcuuauuucacuuagcaucaugugcuccagcuucauguauguugaggcauguuucagaauuuucuuccuuuuaaagacuuaauguuccauuguauaccacguuuuguuuaucaauuuauuuguugauggacauuugauuuguaaccuuuuggcuaucaugaauaaugcugcuuugaacauggguguagaaauaucucuucaaguccuugcuuucauuucuuuuggguauauacccagaaaaggaauugcaugguaauucuauuuuuaauuuuuugacgaacugccauaauguuuccauagcagcugcaccauuuuacauuuccauuaauagugaacaggguuucacuuucuccacauccuuacugacagugguuauuuugucuggauuaauguagcuuuguguaccaauuucuaagcccagaaauauuuuucucaccaaaaguuguuacuuuuuuuuuuaaaucucugugaccuguuaugaagaaaacaguauucaaauuuguaaucugcuuuuuuuuagugaugaugaauguuuuuuaguaugucuauuggcuguuuguauuuuauacuagaagaauagucuuaauguccuuuuaugcaucuucuuacucauauaacaaaccuccccucaggauacuguaaaauguugaucauuggauuaaaaugaaggguuaggcugcugcuggaauauccauuuugaaccuauugauuuuuuuucuguuuguuuuuaggaaugcauacagagguagaacaguuuuaaaauaguacauaacuuauugauggaaguuuaucaugaaauauuuuauuuuguguuuuaaauuuucgucaggucugcaaagaaagcagaguuggaagaaaaucagcggagcuauaaacagaaaaagaaaaggcgacguauuaagguucaagaagauucauccagugaaaacaagguaauaaugacauuuaccacaugcuugaauuauaaccaguacaguagacuaugguaauuaugcuguuaccucucuguuccauucauucauuguauuguacuggcuuauuuacauuuuacacuuguggaaggauugguuauugaauauauauauguaaaaguauugauuugacauuaucauuuuuuucuauuccuuaauuucuaauggaauuuuauuuaagccauucuaauucauuauuuuacauuuguagugaugugaguguucuauuuucugaagacaaaauacuauccugaaugaugacucauauaugaauaaauuucuucucauagugaaaucagccaauuugaauuuuuguauuuaagcaggcuuacauaaaguaaaaggugucuguaauauguuugauucugucaacacaaugcucuucagagggauauuugucuuuugaaaauuaacuuuuaaaauauuuuaaaauguacaguucaguggccuuaauuauauucacaagcagaaacucuucacucauuaaacauuaacaccauuuccuucuaucccccauccccugguaaccucuauuuucauuuaugucuccaagaauuuguguauuuuaaguaccucauauauauaaguugaaucaugcaauauuuguccuuuugugucuggcuuauuucauugacauaauauuuucuagguucauccauguuuuagcauauaucagaauuucauucccuuuuuaaggugaauaauauuccauuguaagugugugccacauuuuguuagcccagucaucuguugauggacauuuggguuguuucuaccuuucggcuauuuugaauaauacugcuaugaauauggguguuuacauaucugagucccuguuuuuaauuauucuagguauauauggaaaaauggaauugcuacaucauauaguaguuguauguuuaacuuuuggaaaacuccacacuguuuuucucugguaucuguaacauuugacguucccguuagcaauguaccaagauuccaauuugucugcaucuuugccaacacuuccuuuguuucuuucuuuuuuucuuuuuuucuuuuuuuuuuuuuuuuuaacaagaaacauccuaaugagugggaaguggcauuucuuugugguuuuguuuuguauuuuccuaaugacuggugauauucaacaucuuuucauaugcuuauaucuucuuuugagaaauguuuauucuaguugguagcccauuuuuaauugaguuguuuguuuuuuuuaauagguguugaagaguuguuuuuuuuuuuugagacagagucucgcucugucgcccaggcuggagucugauggcacgaucucggcucccugcgagcuccgccuccuggguucacaccaucuuccugccucagccuccugaguagcugggacuacaggcgcacacugccaugcccggcuaauuuuuuuuuuuuguauuuuuaguagagacgggguuucaccguguuagccaggauggucucuaucuccugaccuugugauccacccgccucggccucccaaagugcugggauuauaggugugagccaccgugcccggccgaagaguuguuuuuuuuuuuuuaauacuacucuauugcugaauauaauucuaaagguuuucagcauguuuucuuccaccuuuuccugcuguguuaauuaauggaauaugaaauggauaaauuaaaugacuuuguacuguuuaccucuaauuguuuaaauucuguagaguaauucugaggaagaagaggaggaaaaagaagaggaggaggaagaggaggaggaggaggaagaggaggaggaagaugaaaaugaugauuccaagucuccuggaaaaggcagaaagaaaauucggaagauucuuaaagaugauaaacugagaacagaaacacaaaaugcucuuaaggaagaggaagagagacgaaaacguauugcugagagggagcgugagcgagaaaaauugagagagguaacuaauuucuuucuucuucuuuuucuuuuguagcuacagggucuugcucuguugcccaggcuggccucgaacucuugggcucaagugauccuccuaccuuggccuccuaaacuucugggauuacaggcgugagucaacacacccagccuuaauuuauuucuauuaaugauuuauuuuauuugguauaugacuucaauauauuucagcauuuuaagaguagaauguuguaaucuaccacagauuucuuuuuuuuagacggagucuggcucuguuacccaggcuggauugcaguggcaugaucucagcucacugcaaccuuugccuccuggguucaugugauucuugugccucagccucccaaguggccgggacuacaggcaugcacuaccacacccagcuaauuuuuguauuuuuuaguagaguugggguuucaccauguuggccaggcuggucuugugcuccugaccucaagugauccaccugccucagccucccaaaguacugggauuacaugugugagccaccuugcccagccucaaccacaggauuucuaguugcaauugauuuuuccuacugucacuauuucaugcaacuuaaaauagucauuaagcuuuauuaauuuaauuaagugcauggaaagcauugagauucuugaaugaucaccaaaaugguuauguuguauuuuggguagagaaauguuucaaaauuacuucuuaaauccauaaaagauuucaguuuuuuaaauggacuuuauguuacaaaaguuuucaaauucacagguggagagaauaauauaauaauucucccuggaucuauuaacucaguuucagcaguuacuaacacaggacgagucuuguuucaucuuuuuuuuuuuuuuuuuuuuuuuuuuuuuugagauggaguuucacucuugucacccaggcuggagugcaguggcccaaucucggcucacugcaaccuccaccuccuggguucaagugauucuccugucucagccuccugaguaucugagauuacaggugcacgccaccaugccuggccguuucaucuauucuuuuuccuucagauuauuucagagcaaaucucagaaaucauauucuguuuauaaauaguugggaauguauuguuaaaagauaaugguauuuuaaacauuacugcagugccauuauuaaacugaauucucucauugccucacauaguaguuuuaaaaaauaguugguaugggccuggcgcgguggcucacgccuguaaucccaacacuuugggaggcugaggcggguggaucaccugaggucagguguuggagaccagccuggccaacauggugaaaccccgucucuacuaaaaauacaaaaaaaauuagccagguaugguggugcacgccugugaucucagccucuugggaggcugagacaggagaauugcuugaaccugggaggcagagcuugcagugagccaggguugcaccauugcacuuuagucugggugacaagagcaaaacucugucucaaaaaaaaaaaauaguugguuugaaucagggucuuaacaagggccaucugcauauucuguuguauuuggauguuacaucucuuaccuaauuuuaaccuaguuucucuuugguucuuucuuuuucuuuacccauucuuacaguucauuugcuuaagaaaccagauuauuuuuguaaaauuuucuauauucugaguuuuguuauuugcaucccugugguacaguuucacuggcuucuauauuucguauaaauugguaauaagaucuagaguccugaucagauuuagauucaguucucuuuuugguagaaauacucaugggcaguaauauguacuuccuuuuggaucucauuaagagguacuuuaaaacugcuugucccuuuuuuugugguacagcuccucuaacuuuguuccacuuuuucagaaucuuuuuggauauucucaguucuuugcauuuccacauaguauuacguuguugguuuuuacaaaaaucccuguggaauuucuguuggaauuuuguugaaucuuucuuguaauguggccagaagacaucuuaacaguguuuugucuccuguuacaugaauauaguguacuucucuauuuauuuaccuucucuuuaauuucucuuaggaauguuuuguaguuuucucuguacaggucuaguacauauuuuaaaaaauuuauccccaaguaauuccugauuuuugauguuacauuguauuaguccauuuucacgcugcuaauaaagacauacccaagacugggcaauuuauaaaagaaagaguuuuauuggacuuauaguuccauguggcuuggggaggccucacaaucaugguggaagguaaaaggcacauuucacauuguggcagacgagaagaacuugugcagggaaacuccucuuuuuaaaacuauagaucuugugagacuuauucacuaucacaagaacagcacaggaaagaccugcccccgugauucaauuaccucccacuggguccgucccacaacaugugggaauucaagaugagauuuggguggggacacagccaagccauaucauauaguaaauguaguuucacguaauguuggcauaaugaccuuguguccuaagcucuaaauuuacuuacucguuauaguagcuuuuuugauaaauucuuugugacuuucauguauacguuuguguugucuguaaagaaaaacuauuuugcuaauuccauuccaaucugucauuuauuuuuuuaaaauuauaaauggugaauuucuucaaaugcuuuucauugcaucuguuggagugaccuagaaaaugucuuguauuccuugaauaaaccuugcuuagucacguuauauuacuccuuuuauauauuguauugcauuugcugauccuuccuuccuuccuuccucccuuccuuccuuccuuccuuucuuucuuucuuuuucuuucuuucaagauagggucuugcucugucucucaggcuagagugcuauagugugaucauagcucacugcagccucaaacuccugggcucaagcaauccucuugccucagcuuuccaaguagcugggacaacaggcauguaccaccauaccugguuaauuuuuuauuuuagagauugggucucauuaugcuacccaggcuggucuugacccccuggccucaagugguccucucccaucagccucccaaagugcugugacuauaguagggagccuccacaccuggcauauuccauuucuuuaauacauguagaacuauuuagaucuuuucuuuuucuuuaggucuguuuugguaaauuucaaacuuaaggaauuuuuccauuucauuuaaguagucaaauuauuuauguaaauuuguuuauagucuuucauuauacuuuguagguucugucauuuauuguuucuguuaggaauuuguguuuuaucauuuuuuccuugauuaaucugugcaaaaaguucacaauuuuacuaucucaaaaaaaaaaaaaaacgcagcuuuggauuucauuaauuuuuuuucuauuguuugacccuuuucuauuucauugauuuucauucuucuuuuuacuguguuuauccuucuuuggacuuauuuucuguucuuuuucuagcuacuuaagguggauuuuggaucuucuuuaacguaugcauuuuuaaagguauaaaauuugccacugugcauacuguuuaaacacugcaucuuacagauuuugguauuuuguguucauuuuuacucugcucugaaucuuuucuaauuucugugagccagaauaugaucugucuugguggauguucaauguuuauauucugcuguuguugggugacauauucuauaaauuuugaucagauuauauugauggcugauuauauucacaucuucuguaguuuuaaugguauucucuccaaucagaggaguguugaugucuccaacuauaauuguuaauucaucucuuucuccuuguaggucucucagauuuugcuucauguuugcuggaaguuguuuuguuagguacauauacauuuaggauuacaucuuucugguuaauucccccuuuaacaacauguaaugugacucuguauuaucugguaauuuucuuucaccugaagucugcuguauuugauaauaaugguaacgacaucaucaucuuucuuuuccaacaucuuaggaaaaguuucauuuauacagccagguugaaaguauuucauugauuuccuguaaacuuacuuccuagauuuuuuucauugucauauuuuucauuuucauguuuccuuuauuacauuccuauuuauguacuaaucuuuaucuaucaguacaucuuuuuaugcauuucauaguaaauugcauacaucauuucauuuaucucaaaugcuuuagcagguguaucauuagcuaaaguucaauauuuauguguuuuccuuuuuauguaaaaggaaauuuacuuaaaaugaaaggcaaaaaucuuguguacauuuguuuuugaauaauaugugguguauauuuucucauuauuuuuuucuaguaauuuuguucccccacaauuuuaucgugaaauuuguaaauauauggagagaauuguaaacaugaacacgaauguaccuaccauguagcuucuucauuucuuaacauguugcuguauuugcuuuauuacauaucugucuuaucuaugcauccaucaaccauuuuauucgucccugcucuaaucuguauuauuuccuuuuauucucuagcuaggguuuaguuugugcuuccuuuucugguuccuuaagguguaaaguuagguucuugauugugaucuuucuucuuuucuacuguaugccuuuaucgcuguaaauccucuucuuaguacuguuuucucuacgucccauauguuuuguauuuuguguuuuaacuuucauuugucucaaaguguuuucuaauuuuccuugugaucuuuuacuugauccuuuaguuacuuauuuaauuuccacauauuuguguucuuuccaguugucuucuguuauggauuuuuuguugcauucccuugugacuggaaaagauacuucagucucuuuauauuuauuaaggcuuuuuugugccugauuauauggucuguccuugagaaugugcacuugagagaaaauguauagucuaccauuguugaguggaguguucuuuauaugucuguuaggucuauuuuuuuuuuuuuuuuaaagacacagugucuugcucuguugcucaggcuggagugcagugacgugaucauagcucacuguagccucgaacuccugggcucaagugauccuccugccuccgccccuugaguagcugggaccauaggugcaugccaccaccccagcuaauuuuuuuaaacuguuuuacagaggcagggucuuacaguguugcccagguuggucuccaacuccuggccucaagugauccuccugccuuggcuuccuaaagugguggaauuaaggcaugaaacacuguggccagcuccaauugguuuauaguguuauucgaguccuauauuuccuuaauuaucuuugucuacuuguuuuacgcuuuuauugauauugggcuauuuaugucuccaacuguuucucucuuuuuuuguuuuaguuuuccccuacuacacugauguauauuucuccuuuuaguucuuucagugcuuucuucauaugucuuggugcucuguuguuuguuguauuuauguuuauaauuacauuuuuugagaaccuggcuuuauuaucaauacauaauauccuauuugucucuuguaacaguuucugacuuaaagucuauuuugucugaugucuauauagucaucucagcucucuuuugguuguuauuugcauggaaugucuuuuacuauucuuucacuuucaguuuauuugugucuuuagaucuaaagcgaaccuuuuuuagauaaccaguauuuggaucauuuuuuaaaaauuauuauguccaucuaugucuuuuugauccaggaguuuaauccauuuacacuugagguaaguagugauaaauaaggauuuacuucugccauuuuguguuuuccuuuuucauuuuguucauuauuuuguucauuauuuccuccauuacugcuuucuuuuguguuugguuaauuuuuugcagugacauauuuugauucccaucucacuuucauuuuuguauauucuauauuuucuuugugguuaucauggagauuacauauaacauccuaaaguuaugagagucuuacuugaauugaugugaacuuaacuucaguugcauacaaaaauucuacucuuccacagcuccauuccccuguauauuauguggugacucuguuacaauuauugauaucacaaauuacauuuuuauacaugucgugaaugguaacauauauucauaauuguauuuuaugcuuuugucuuuuaaauccuaaagaaaguaaaaagugagguuaugaaacaaaauuuugugauacuagguuuuauauuugccccuguauguaucucuucuaggagaucuuuauuucuuuauauggcuuugaguuacuucuagcauccuuucauuucaacccaaagacuucccuguaggaagcauuuuuuauagggcaggucuaguuuuaacaaauucauuuggcuuaggagugucuuaacuuguuccucuauuuugaaggauaauuuugcuggguauagaauccucagcugaugccuggcacaguagcucaccccuguaaucccagcacuuugggagaccgaggcgggaggaucacuugaggccaggagcuuaagaccagacugggcaacauagugagaccuugucuuuacaaaaaauuaaaaaauuaucuggaugugguggcacacacuuguggucuaagcuacuugagagguuggaggauugcuuuagccagggguucgaggauacaguaagcuaugauuaugccauuguacuauagccuggaugacagagugagaugcugugucuauuuuuuaaaaaagaaaaaagaauccucagcuaacuuuuuuuuucauucaucacuuugaaauauauugucacacugccuucuggccucuaaaguuuuugaugagaaauuaggugaugaucuuauugaaguuuuuuuguauguguugacuugcuucucucuugcugcuuucaauauucucuuugucuuuggccuucgacaguuuguguguaauguguuuugaucuauacguauuugaguuuaucccaguuugaguucauuccuguauuuguagauuuaagucucucuccuucaauuugggaaguuuuccacaauuauuucaucaaauaauuguugcuucuuucuuuuucuuuucuccuucugugacucucguaauacauaagauguucuucaugaugguuucccucccaucccuuuuuguuucuucacuuuaguuuuuuuuuuucccuuuuugaucuucggacuugaggauuucaguuaauaucuucauauucacugauucuucugccugcucaaaucugcuauucauccucuuuugauugggccauauuuuccuauuuggcuguaucuuugugauuuuuuuuaauacuuuaaguucuaggguacaugugcacaaugugcagguuuguuacauagguauacaugugccauguugguuugcugcacccaucaacucgugugauuuuuuaaaauugcauauuguguauuugacuguuguaacuuggcaacucugcauaugagguucucucccuuuucaaggguuugcugggauuuuaaaauauauauaaauuguaguagaccuauuguuuuaagacucccccacauuauuuuuucaaagaguguucuuguugugugucaucaguaaagucucugucccuuucauucauguucaacuaauguuuugaaagauuuuuuugaacgucugcugggugugguggcucacgcccauaaucccagcacuuugggaggccaaggcaggcggaucaccuggauucaggaguucgagaccagccuagccaacauggugaaauccuauuucuacuaaaaauacaaaaaauuuagccagacaugguggcacgugccugcaaucccagcuacucgggaggcugaggcacaagaauugcuugaacccgggaggcagagguugcagugagccaagauugcgccauugcauuccagccugggcgacagagcaagacuccaucucaaaaaauaaaagaaggcuuuuuuuuuuuaaugccugcucucucuguuuguagauugauugugcuggugcacuccuuuaauccauaacuaggcuuccacuaaaccuaaagauaagccugaggggaaaacuuaagauuuuaauaaagaucuuuucugagcauguauuuuaccuggacacacauauggcuuucugaauuauccuauauaccugguugcuuuugagugucccaaauuuaaaaguagcugcgugugguggcucauaccuguagucccagcaacucuggaggcugagguaggaggauagcuugagcccaguugugugaggccagccugggcaacauugugagacccuguuucuacaaaaauaaagacuaguugggcgugguggugcacaccuauagucccagcuacuugggcgguugagguggcuagaucgguugagguggcuagaucgguugagguggcuggaucaauucaacccaggaguucagugcugcagugagcuauaauuacaccacagcacuccagccuuggugacaaagcaagacccuguaucuugaaaaaaaaaauuccaaaaguguccuaucucuagcuauuugggccuuaggugguguuuuggguguguuccccuguaaugccuugccccaggccuguagucacguugcaguuguuuuguguguguguguguguguguguuuuaaagcuguucuuguuguccuucucaccagagcucugaguuaggugaagaaaugaugagagccuuaugucaguccuucaaguauccuucagacagguuagauaaaauuuacacaauaauuuguaaauaacaucugcuuugcucccucugguuugugggaggauacugggaaacagggugcugcugcuuugagacuaaaaccuucaccuucugguaggugguggggcaaggacaaguaaaaaugcuguaaaacguuccuauuguauugaaggugacuuuuuuucuuuuucguuauuuuagagacagggucuugcuauguugccuggguuagccucaaauucuuggguucaagcgauccuccugucuaggccuaguuguuuguacuacaggcggucaccaccaugccuggcuaagauguuguuuucuugauuggguauuugcuugguugcuguaaaccuuugacuguguuccagagcucugacaaaguugguucagaaaguuucuacuuguuuacaaaauaguucugugugggaacuggaguuuggagcuuccuaaucuauuguuuuguugauaucuacauuuucccuucuuuuuuuuuuuuguuuuuuuuuuggagacagucuuacucugucacccagcuuggaaugaugcaguagcaugaucacuguagccuggaauuccugggcucaagcaauucucccacuucagccuucugaguagcuagaaguacaggagcaagcuaaucucuucauuuuugaaaguuguuuucccuggguauagaauucuaaauugauacuuuaaaaaaaucucuuuaaagauguuacuucuuugugacauuuuguuuguuaucuuucuccuuuuuccuucaucuuugcuccucugcaugugccuuuuauuucuuggaaagauagucuuaaaagauuuuucaguauuuuaagauuuucuguuaaugucuggcuuucggaaauugaagauuuuuauuuucuuuguuuauccugcucuggguuccuugaacuuguuggaucugugaguuuauaguuucaucaaauuuuuguugguuuguuuuagagacagggucuuacucuguugcccaugcuagagugcagugguacgauaauuggucacuguaaccucaaacuccugggcucaagagauacucuugccucagcuuccggaguggcuaggacuagaggcaugcccuauugcuaauuuuuaaacuuuucguagaaacaaggucuugcuauguugcccaagcuggccucaaacuugugaccucaagugauccucacaccuuggccucccaaagaucuuggauuacaggugugagcuaccauauccagcuuccaucaaauuuuuggaaaguucacaucauuauuuuuugaaauaauuuuuuucuguucuauuuuucuuugggacuuauauauuaugcucuuuaauauuguuccauagguuucuuauuuuccccccucuguuucauuuuggauaguuuuucuugcuuugucuucaauuuuguugaucuuuucuucugcacuauuaugauauuaauccacuuagugaauuacaguguacuauaauuuucaucacuaggaauuccauuuaguuuuuugaaauaucuucuauuuuuguuuucauuguguucauguuuucaguguuugggcauuuuuuuuuuuuuuuuuucugagauggaggcucgcucuaucacccaggcuggagugcaguggugcgaucucucugcucacuggaaccuccgccuccuggguucaagcgauucuccugccucagccuccugaguagcugggacuacaggcgugugccaccaugcccagcuaauuuuuuauauauuuuuaguagagacgagguuucaccacguugcccaggcuggucugaaacuccugagcucaagcgauucaccuaccucugccucccaaagugcugggauuacaggugugagccaccacacccggccuauuugggcauuuuuaaucagcugucucacuuuacuugucugccuauuucauuauuucuguuacuucuugucccauuuuuguugacucuuuuuuccccugguuauucuucauauuuuuuuucuucuugacaaaccuaguaauguuuuauuaaaaaguucaguuuaauuuugaagcuuuuaaaaaagccugguuaaugcguuucuucaauacucuuuaauuuaugaauugcuuugacccacugcuaagauuuggucucuucguggucucuacugaaugcccuggguuauaaacgaagaggcuacugugccuccucugaaaucgaaugccucccagcaccaugugaucacugggagcuguuuagcucacagcuucuuggucaugcucugccuggccucacaaaguuucacuccucaugugugcauuuuaauguucagcuaugacucaaagugaauccugucuugauuuugaguucuuuuuguguagcucuuuuuucuuuguaguucugccccacaacuucagucaucucagccugaccuuuguuucuucaacuugauauaucuccagugcucuccuugggaaucccuuuucccugauccuucaggcaccaauucaaggggaauauaggggucuuguugguuuuccuacucugagggaucagggucccguggugucuuuauuuaaugacugaaaaaaauuuuuuucauauauuuugccuacuuuucuacuugauuacagcaggaagguaaaccugguuccuaauaaaccaucaugacuggaagcagaaguuuggcucaaccuuuuaauauuuuggucauaugauuuuuuuuccuuuauuuucccuucaauucagauaugggagauauuucaugucuguauuuauuuuuacuacaccuuaagugauuauuuguccuaaguuuuucuccuauuucauugcuguguauuuaucauuuuuuaaaauuucagcuuuuaguuuagauacgggguggggggguacauguacagguuuguuacuagguauauugugugaugcucagguuugggauguggaucccaucaccgugguagugaacauaguacccaauaguuguucagccuaugcccucuuccuucccucccccuccaguaguucauagugucuauuguucccauguugauguccaugugugcucaguguuuaguucccacuugggagaacaugugguauuugguuuucuguuccuaugugaauuugcuuagauuuauagccuccagcugccuccaaguugcuguagaggacaugauuuucuucuuuauggcugcauaguauuccgugguguauauguaccacauuuuguuuaccuaauccaccauucauggucaccuaggcugauuacaugucuuugcuauugugaauagcauggcaaugaacuuaugaguacuugugucuuuuuuggaagaauuauuuauuuuccuuuggguauauacccaguauuauuaguuaaauaaaguuuccuuauauuauagcuugagugcauaaacacaucuacuuagucacuaauaggcagaugauuucuuuuuaacuuaucuccuccuacauuuaggaugaagauacacuaauccucaauccugaagacaacacuuaauaacaaaaguaucaucaagucacugaugaacauaugguucagaaaucuuaauuaaagccuuguauauuaguuuuuuuuauuguggcauuaaaauguaccacacacuuaaccucuuaagacaaacuuauuugucucacgggucaggaaguugggaauagcuuagugagcguggcucuacuggguuuucugcuuaguuucccaccaagccgaaauuaagauguuaacuagaguuuugcuuucaucuaagacuuuguauccuuuuccaacucacuuguugguagaauuuaguuccuuucaguuauuacacuuagguccuuagcuacuagaguucucucuccacaacauggcagauuguuucaucuuugagaucaauagaaaagcauuucagucauuuaaagggcucacuuuaauuaggucaggcucaccuagaauaucucccuuuugauuaaaucagagucagcuuauuagugggccaauuaugcgaaugauagcccaaucauauuuacaggucucaaccauacucagaaggugaggggauuaugcaggguguuuauaucagaugacgguaauucuggggccauuuuaggauucuguguaccacaccuuguaaacaggacaagacauuuagggaauuuuccauuuuuauauaauggcuuuaccccagugauaugaagcuacuacauauccaggcuaggacacaguaauaauuuagugaauacuuagccuaugccagauacuuugcauacauugccuuauucagucuccagaacaaccuuguggaaacuauugauaaucauucccaguuugcagauucagacacagaagcuaagaggguuuagguagcuugaugaaauggaauuugggucugaauggccuaugcuauuuuuacuucaccacacuguuucucagcguuaaucuugguuuguauaucacaauuuuauguaaguacaauaucuauucagauaauuuacugcaaaucugugacuuauuuguaguuuuuuggaugugacaaugaucguaugguuuuacaaagaggaaguguccuuuuaaagagacauuuacaaacauuuuauagaugacauugcauauuuucuuguguucgcuucaaaaugauuugugggaucuggggaacuggacaauggguaaaaugcugucagugaaacaaaacuggccuuaaguugauaauuuucuuuuucuuuugagacggagucucacucugucgcccaggcuagagugcaguggcgcaaucacggcucuccgcaaccuccaccucucagguucaagcgauucuccugccucagccuccugaguagcugggacuauaggcgcgcgccacugcgcuuggcuaauuuuguuguuguuauuguauuuuuaguagagaugggauuucaccauauugaccagguuggucucaaacuccugaccucaugauccacccaccuuggccucccaaagugcugggauuacaggcaugagugaccgugcccggccuuaaguugauaauuuuugaagcugagugauggguaauaggauuuauuauucucuuccaucuacuuuuguguauguuugaaaauuucuauauugaacauuaacaaauucauuuguuaacuaguuuuaauuguaaauaagaaaaaagugccuaaaauuuuauuucuucaccauuguaauuuuuguuuuuuaauuuuuuuuuaaaguuuuuuuuguuuguuuguguuuuuuuuuuuuuuuuuuugagauggagcuuugcucuuucacccaggcuggaaugaaguggcacgaucucggcucauugcaaccuccgcugccagguucaauccauucuccugucucggccuccagaguagcugggauuacaggcgcccgccaccagccuggcuaauuuuuguauauuuuguagagacaggguuucaccauguuggccaggcuggucuugaacucuugaccucaggcgauccaucccccucagccuaccaaaguguuaggauuauaggagugagccaccgugcccaacugcguaauguuuuuaugauuuuaaaaucacgaguuucuauuuuuuuuucauggaaccauaaaacuguuuaucacaagcauuuauuuuacuaaacuaguauuuuguaauguuuaagagcauggacucgggggaucaacccucuggguaaaucucagugucaugauacucaauagucguaugaccuugugcagguuacuuuacuucucugucccucaguuuuuucaucugucaaaugguaauacuuguaccuaucuugcguaguuacugaauauacuauguaacggauagagauuaggauaagacagcaaaaaauauaugcacacacacacuuguuaccugugugcauauauuauaucuacuuaaguuuuauucuaaauaaggagcuugugauaauuguuuccguuuuguaauuagaagguauuauauguuccuaucaugauuuuugagccugugguucugaaaccaguguuucuaaauauuuuuuucuuuucacaucauguauuuacaguguuuuucagugguagucauguugacauccugagucgcacaguucuuguuugggacugucuucuuccuccuccuuccuucuuccuccuucuucuuucuucuuccuccuccuuccuccuccuuccuucuucuuccuccuccuucuuccuccuuccuccuccuuccuucuucuuccuucuucuuuuuucuuccuccuccuuccuccuucuuccuucuccuuccuccuuccuucuuccuucuuccuucuucuucuucuuucuucuucuuccuccuccuccucccuccuccucccuccuuccuccuccuuccaccuccuuccuccuuccugcuuccuccuccuccuccuucuuccuucuccuucuucuuccuucuuucuucuuuuuuuuuuuuuggcauagcaaccaacaacagggaacacugcuuuuuucacaacucuguguaauaaauguuguugaaauauccagggugagaucuguugagcuaaauuacugacauuaucagagugauuuaaaauuuuuuggagaguuuugauuuuagaagacauaaaacccugggcucuguccuggcuuuauugaagcaaaauaguaguguauuaguucugagauuggguaauuuauaaagaaaagaguuuucauugacucacgguuuugcaggcugugcaggaaauauaguggcuucugcuuccggggaggccucaggaagcuuccaaucauggcagaaagcaaagggggagugaggcaccucacauggugggagcaggagcaagagagugagggagaggugcugcacaguuuuaaacaacuggaucuugugagaacucgcucacugucacaagaauagcaccaaaggggaugguguuaaaccauucaugagaaauccaccuucaugauccagccaccucccaccaggccccaccuccaacauuggggauuacaauuaacaugagauuugguggggacacagauccaaaucauaccaauuggauuuguggugugggaguaaaugugucuauauuuuggaaaaucucccuugguaagacugaccauugcuugaaugauuucuuugagcuuaacuaucaacaacuccuuuucuuguaggugauagaaauugaagaugcuucacccaccaaguguccaauaacaaccaaguugguuuuagaugaagaugaagaaaccaaagaaccuuuagugcagguucauagaaauaugguuaucaaauugaaaccccaucaaguagaugguaagaaacuauuagaugauucaauaauuuuuaguuaaauuuuuaccaauauuugggugugaggcagcugccucacauccugcuaaguccuggagguaaauuggugagugggguggggaauccacaauuccccugccuuuauggagcucauaaacaaaugaggaagaacaaaauugggugauuucaaacacaaugagcguuauaaaaagagaaagaagugcuacuuacaaauggguagauauagcaaguagguuucaccuaauuagcaaagacuggccuaagggcagcuagggguugggaagagcuguagcuagcuaaaagccuuuuucagaaaaugcuauuucagcauuuuuagguauguuuucuuuauuagaguugaaucaguaagucaguuuugaguguuuaugugaauuaaucauaagggagguucuguaguuccuaccuuuugaguugcuaguccccuuucuugcucaguguuuacuaucgaauaaaggaaaagaugaugaaauuaucucauggguuuuuuuuuccugauugacucaauaaacucaaagguauuuuugauaggaagccauucucuuuuuggauaaaguugcucucuuuuuacaaaaauuauuauuauuauuuuuugagauggagucucgcucugucacucaggcuggaguacaguggugcuauaacagcucacugcaaucucugccuccuggccucaagugauucucccaacucagccuccugaguaucugggacuacaggugcacaccaccaccacgcccagcuaauuuuuuguauuuuaguagagacgggguuucaccauguuggccaggcuggucucgaacuccugaccucaagugaucuacccgccucggccuuccaaagugcuuggauuacaggcgugagccacugugcccggccacguuucucuuuuagaguauucuuauguuucuuugaaccaucucagggaauacagaacaucuacuguggauagcuuagagaagaugaaggaaagucccccuguucuauguuuguguuaacuuguuucugcuuuaguuuggugggaaaaaaucccauuuagauguaagaaauuauuuagcuaaguguuuuuuuaaugcuguuucuuagaaguuuugguuauguuuuugauguguuuauguaaaggaaguuuuuaacuuggaccuuuaaauuuaacuuaaugaagcuguuauuuuuagguguucaguuuaugugggauugcugcugugagucugugaaaaaaacaaagaaaucuccagguucaggaugcauucuugcccacuguaugggccuugguaagacuuuacagguaagagcugaagaauaugaagguauccuguuuuuguggauucauuaauauauauuggauucuauuauguuucaggcacagucguaggggcugaagauaaagcagugaacaagaauaacaagaucugucuccaaggagcuuauauucuaguggaggagagagcugcuaaucaaauaagaaauauguacuuucagaaaaugaauguuaagggaggauauugaguuaggaaaggcaucuuuuaggagguaauguuugagcagagguccuaaugaagcgaggcugugggguuucagguauggccaacaacaacugcaaagauucuaagguagaaauuaccuuuuuuuuuuuuuuuuuuuuuuuuuuuacaacuuuuaacgguuuaugauguuaaaguaaugacaaaguaaaguaucuuuuacuauuaaaauugcugcauuucuaaauggcaggaguuguagcagagauguaaaauuggugaauguauuuguacuuuuaaaccauaaaguaauuauagauuuaaugggucagaacacauuaaaguggaaaaauauuauguaacaugauucucuucuaaaugagcgaugguauuuuuugaaagacuauagggacauucuguggagaccuaggacuuaguauugguaugggaucauuuuauacuauucacauugaucauagaaucauggagcuuuagaguuggaagagccugauacaucaucuaguugaacuuuggcauuuuacuaucucuuucccugugccuugccugguuuggaaauucuggccguuuauuguuuaagcaaaacaaagcuauaauauuguaagauugcuuaauuuauuaaauuuuuuuguggauauuuaaacgaaggugacaaucuguuuucuuauaggugguaaguuuucuucauacaguucuuuugugugacaaacuggauuucagcacggcguuagugguuuguccucuuaauacugcuuugaauuggaugaaugaauuugagaaguggcaagagggauuaaaagaugaugagaagcuugagguaacuuauuuuaaauguuuucuauuauuaaaauagucacaugaaauucauauaguaaacuauuuuuaauuuuuuuuaauuuuuaauguuuuuuaaccagugaugcauauuucagugggaauauuuaauauucacauguuuuuaguagcuacuuaaaaaaaucuuuauuuccccacaaaagguuucugaauuagcaacugugaaacguccucaggagagaagcuacaugcugcagagguggcaagaagauggugguguuaugaucauaggcuaugagauguauagaaaucuugcucaaggaaggaaugugaagagucggaaacuuaaagaaauauuuaacaaagcuuugguugauccagguaagguauuaauagacagugacauaaagaagcaaguugaauaaaaaauguguuuauauuuuaacaaauaguaauugcacagcuacuaaguaucuggucuuuguugugguuauccuucagguuuuugccuuuuagaaaauucuuaguauuucaauagaauaaaaucacccuuaaugucgccagcuguucagaauuuauuugcugagucugaaaguguuuaggguuuuaggggauaccuuguaaacacuuaaaaaugcaucaaaugccuguguugcaaucaaagauucuuccagcuauccaaauauuaggugauaacaagagcucucuccauauccugaaaacaguuugugucuuuccaaacuucaugucauuagaagaauugcugcuugcuuaucuccuuuuaaggggccaucaguaugaaagguuaauauuuucaauacuguugauccuuaugugauaguaaucugaugugagagccagauguugauauauuugccacuuggaaaagcaacacguuguacugucugcaaaacuaaaauuauuuuuuaaucuacgauuauuaauuugugcaacuuuuucuucauauguuuaucuugucauaucauauuuaagacacuauugagguuuuauuuuuguugagaaagucuggguaauugucauugucaaagugauaguaaucuuuagaauccuuggcuuugccucuuuuuuaaagauaaugagguaguuaauacauagcaaaauaacugccaucacaaaucuaaggccuaauaauaaguuuaucucuuucccacgauuaaauagguguuuauaaaucuuguggcugguuuauuguugaaaaauuauaagcuagugucuaguaucauuguagcagauuuuuuccacaagauuuccuugaaacuguuuaauacaacaguuucaggugcuuaguguacuuauuuguucaugaaaaaaaugaagaaaaaaaagaaauuaaagcuucuaacaugaaggguaacauuugucauugccauauuuuaucauuuagugacauuuaaaaaaaauuuuuggccgggcaugguggugcacuccuguagucccagcuacucaggaggcugaggcagaagaaucgcucaaaccugggagcuggagguuccagugagccaagauugugccacugcacucccaucugggugacagagcgagacuccaucucaaaaauaaaaaacaaaaaaacaaaaaaaaacuuuucauuuuggaauaauuuucuguuuacaugaaaguugaaaagguagugcagagaguucccauauacccuacaucugguuccucaauuguuaacaucuuacauugccaugguagauuugucaaaacuaagaaauugacacauuauuauuaauaacuucaaacugcauuuguauugcaccaguuuuucuauccaggguucuacauuguauuuagcugucaugucucuaacagucuucuggucuaugacgguuucucaaucuuuauuuuuucauuaucucaucagucuuaaggaggaccguccagguagauauccuguagaguguucucugaucugaauuuauaguuuuucuugugauuagacugagauuagacugagguuuugaaagaauauaccagaggugacauacccuuuuugucacaucauaucucauaucggggguacaugauaagcacuugcuguuacugaugauguuaacuuucaucacuuggcuaggguagaguuugucagguuucucuccuguagagcugcuacuuuuaccugucccucaucuguucauuggaauccagucacucaaucuagcccaccugaaugggaggaugguggaaauuaagcuguaucuccuauaguggguaauaucuacacauaaaauuuggauuuuuuuaaagaaaaaauuaucuuuucuuacccauuuauuuagccuuugauuuauauaauuauauacucaucuauuuuuaguucgugcauuggacuauaaaccauuacugcauuuuuuuuuuuuuuuugcucaaauuguuucacuuugaccauugggagcuuuuuuuaaggugagguccucuacccuuugauaugucccuauccuuuuggcuuugagcacuuuauuacuuucuggcauuacaggaugcuccagguucauguuauauuguccuggccccagaaucagccauuucuugaagacaucaugguuccuuuuacugaaaauugacauuuacaaauguaaacacacccauauaauuugcaaauauauccuuccauucugugaguugucuuuuuacuuuuuuauaucaucuuuucaguacuaaucuuuaaaauuuugauuacauuuaauuuaccuauuuuuuucuuguguugcuuuugcauuuagugcauauccaaguauucauugcuuaaucgaaggucaugaauuuuuucaccuguguuuucuuauuuuauaguucuagcucuuguauuuauguuuaugaucuauuuucaguuuauuuuuguauauggcaugaggugggaguccaacuucauuuuuuguauuuugauauccaguuguucuaacaccauuuguugaaaagacuauucuuucuucauugaagagucuugacaccauuguugaaaaucaauugaccauagauguauguguuuauuucuaggcucucaauauuauuguauugaucuauaugucuguccuuaugccagugugacauuguuuuaauuacuguagcuuugugguaaguuuugcaaucaggaagaaguccuacagcuuuauuuuucugucucaaaguuguuuugcuauuugagguuccuugaaauuucauuugaauuugaugauuggcuuuuauauuuccucaaagaaacuagcugggauucuguuagauauugcauugaaucuguagauuaauuugaggaauauugccaucuuaacaauauuaaaucuuccccuccaugaacaucuaauuucucuccguuuauuuaggucuuuaauuucuuuuaauaaugaaauuugauuuagguccuuuaauuucuuuaguguaaaagucuuggacuuauuuucuuaaauuuauuccuaaauauuuuauucuuuuugagccuuuuggaaauaaaauuguuuuaauuuuauuuucagauaauucuuuguuaguguauagaaauacaacagauuuuuguauacugauucuguauccugcaacuuaguugaguccauuuauaaguucuaauaguuguaugugugcgcucacgcgugugugugcgcgcgcacgcacgcgauuuaguuuucuauuaagaaaaucauagucuaugaguagaaauaguuuuacuuuuuccuuuccaauaugaauaucuucaacuucuuuuucuugccuaauugcccuucuuagaaauuuccauacaaugucgaacguaaguggucagagcaguugguugucauguuuuugaucucagggaaagcuuucaguucuccaccauuaaguaugacauuagcuguggauuucuaauaggugucuuuuaucagguugaguaaguucuacauuggguuauauuuuuuguuuguuuugauaauuaaaaaaauaaauaccuagauuacccuuguuaaaacuuaagaggggcugguuucuccauuagguuuuacuggauguucuucaggaaacugaagcucuacuuuuauuuucuuuuccagaguauauauaaguauuagagauaguuccucugccauagcuggguaaccaucugcaacaagaauauucuaauauccaucauguauaacauggaauauauuaaaacuguuguuaaguuuuaagguuuagugauaguaucuagauauaauuuucuuugccaccuaagucuaaagugucaggaucuguucaguacuucuaaauuuauuagaagggaucuguucaguauaacacuuaauuuuccaguacauguuuuccauuuuaugcccaauuuaucuucucugauuuggaacaaauuagugauagugaagaaucauauaaauggcagcagaguaugugaagacugaaguuuggguguaauguuaaagaaaagucuaaauugaaguucaagauggaaacaaaaugucagaaccagacaguuuuggguaugagauucuuaaggaugagcugagguuguaaacuuauaagguaggcuauuagaucagaagccuggaaaauugggaguauguauuaggauuggaaacaguguuuagagcugaccagaguuaagauaguaguguucaucuuucaacuuagcugcucugguuaucucuuccugcguaacaauuaucccaagccuuaguagcuuaaagugacaagaaucagcugggugcaauggcucauaccuguaauaacaauacuuugggaggccaaggcaggaggauugcuugaggcugggaguuugaggccagccugggcaacauagugagaccccauaucuacaaaaaaauaaaagaauuaaccaggugugguggcacacaccuguagucucagcuauucaggaagcugacaugggaugauugcuugaguccaggaguucaaggaagcagugaacuaugaucacugagaucauaaucaucacagagugugagacccaguuucuuaaaaaagaaagugacaacauuuuguuaacuuuccuaguuuuacugggucagggauuuaauagagguuuacuuggacaguucuaaacauuuuaucaacuuuucucucuaauaucuuuaugguuuuuuauguaaaaaaauucaccaauagguggcaauguaacacugaaaaauaauuugcauuuguuacuauuauaauagcaugugacaaaaccuuuauuugaccuuucuucccuaacuuaccauuuguuuugaggcauauuuuucuacuuaauguacuuaaacaaucugguggaguuuucuaauucacauuacuguuuuuagaagaauguuccacauuuuguagcuugagaggacauaauuuuuaugugugugcaugaaugugcauaugcacaggauuaacucaagguacuguuugcuuuaagcaauaagauauaucuauguaauuuuauaaaauaaugacagguuuccauaguguauugaaccaucuuaaguuaacagacucuuuuagucaggcuugaauuuuugaacagaagaaauuuucuucaagucuuucucuaaauuccuguucuucugcucuccagagccucauggcugccauucccccuguaguuucuguauaauuauuuauaaguguagguauuuugaaacccuccuaucugauauauauaugucauuguuugggaauuaaguuuucuagaaaguauauaagguaacaaacauuucauuuuauguaaguauguauguauguauuuagggggcagggagauggggaucucauucuguuacccaggcuggagugcaguagcaugauuauagcucacuguagcuucaaauccugggcucaagugauccucccaguucagccuucugaggagcuaagacuacaggagugugccgccaugcccaacuacauuuuuuuuuuuuuuuuugguagagacagggucuuacuguguugcccaggcuggucucgaacuccugacaacaccuagauaauuauuuggagaugaggaucucacuguguuacccaagcuggucucgaacuccugacacacaacuaauuuuuuggagacgagggucucguuauguugcuuagguuagucuuggccuccuggccucaagcaauccuucugccucagccuccugaguaguagcuggcauuacaggugugagccaccaaguccagcuaaaacuuacuccuuucgaacauuaaaaauacuuauuuuuaauuuuuuauguuaguaaauguuauauacauuucuaucuuauaauucauauucuauuuaauaugaugaauaacauguuuaauauaugaauaacaauuuuaacuuuuucauugacucaggguuauuaaugagugcauuuacuuuuauuuuuauuuuauuuaauuuuuuuuuuugagacggagucucacucugucacccaggcuggagcgcaguggcgcgaucucggcucacugcgagcuccgccucccggguucacgccauucuccugccucagccucccgaguagcugggacuacaggcgccugccaccacgccuggcuaauuuuuuuuucuuguauuuuuuuaguggaaacgggguuucaccguguuagccaggauggucucuaucuccugaccucgugauccgcccgucuuggccugccaaagugcugggauuacaggcgugagccaccgcgccuggcuuacuuuuauucuuaauucuucuaguucuucagauauccguacuaaccauagggcuaccacucuccuuccauugccaugccaacaaauaguucuuuuaaguuaaagaaauuauaaaaguaauacauauccuuaagcaaaauaaaaacagaagaaaauguuguauauugaaaaguaaaaguucccuaccuccuagucucauuauuguuucauuuauauccguauaggaauuuuuugugcuuacagaagcauguauucuccuuauuugguauugcaacauuuaggugguccucaaagccacccucaggcuugguaacucauaagaaggacucacagaacucagaaaauccauuagacucaugguuaugguuuauuacagcaaaaauauacaaaugggaucauaauauggauaacuauucugcaacacacuccuuuuuauuuaguaauauauuugucauaucuuucaagguuugcacauagagauauacaucauuuuuucagauuauuuauuuuucuauaaguuauugggguacaggugguauuugguuacaugaguaaguucuuuaguggugauuugugagauccuggugcauccaucacccgagcaguauaugcuacaccauauauguugucuuuuaucccuugcccuccuccuacucuuaccccaaaguccccaaaguccguugugucauucuuaugccuuuguguccucauagccuagcuuccacauaucagugagaacauuugauguuugcuuuucuauuccugaguuacuucacuuagaauaauagucccaagucucauccagguaauugcaaauacuguuaauucauuccuuuuuauggcuguguaguauuccaucauauauauauauauauauauauauauauauauauauauauauauauauauauauauauauauauauauauauaugccacaauuucuuuauccacucauucauugaugggcauuugggcugguuccacaauuuugcaacugugaauugugcugcuauaaauaugcaugugcaaauaucuuuuuugaauaaugacuucuuuuccucuggguagauacacaguagugggauugcuggaucaaauugugguucuacuuuuaguucuuuaaggaaucuccacacuguuuuccauagcggcuguacuaguuuacauuccuaccagcaguguagaaguguucccugauugcugcauucacaccaacaucuacuguuuuuugauuauggccaugcuugcaggaguaaggugguaucacauuguguuuuugauuugcauuucacugaucauuagugauguugagcauuuuuucauauguuuguuggcuauuugcauaucuucuuuugagaauugucuguucauguucuuagcccacuuugugguaagauuguuugguuuuuuucuuacugauuuguuugaguucauuguagauucuggauauuaguccuuugucagauguauagauagugaagauuuucucccacuccguggguugucuguuuacucugcugacuguuccuuuugccaugcaaaagcucuuuaguuuaauuaggucccggcuauuuaucuuuguuuuuauugcauuugcuuuuggguucuugaccaugaaauccuugacuaagccaaugucuagaaggguuuuuccaaucucaucuucuagaauuuuuauaguuucaggucuuagguuuaaguccuuaauccaucaugaggugauuuuuguguaagaugagagacgaagaugcaguuuaauucuccuacauguggguagccaauuaucccagcaccauuuguugaaaagggugucuuuuccccacuuuauguuuuuguuugcuuugucgaagauuaguuggcucuaaguauuuggguuuauuucugaguccucuauucuguuccauuggucugugugcuuauuuuuauaccaguaccaagcuuuuuuggugacuguggccuuuacagaauaguuugaaaucagguagugugaugccuccagauuuguucuuuuugcuuagucuugcuuuggcuaugcgggcucuuuuuugguuccauaugaauuuuagaauuguuuuuucuaacucugaagaaugaugguguuauuuugauggggauugcauugaauuuguagauugcuuuuggcaguauggucauuuucaccauauugauucuacccauucaugagcaugggauguguuuccauuuguuugugucgccuaugauuucuuucagcaguguuuuguaguuuuccuuguagaggucuuuugacuccuuuguuagguauauuccuaucuuucuuguuuauuuauuuauuuauguauuuauuuaugcagcuauuguaaaagggguugaguucuugauuugauucuccacuugguugcuguugguguauagaagagcuacugauuuguguacauuaaucuuguauccggaaaccuugcugaauucuuuuaucaguucuaggagcuuuguggaggaguccuuaggguuuucaagguaaacgauaaucgucagcaaacagggacaguuugacuuccucuuuacugauuuggauucccuuuauuucuuuuuuucuuuuucuuuuucuuuuuuugagauggagucucgcucugucgcccaggcuggagugcaguggugcgaucuuggcucacugcaagcuccgccucccggguucacgccauucuccugccucagccucccgaguagcugggacuacaggcaccggccaccacgcccagcuaauuuuuuuuguauuuuuaguagagacgggguuucacuguguuagccaggauggucucgaucuccugaccucgugaucugcccgcucagccucccaaagugcugggauuacaggcgugagccaccgcacccggcccagauccccuuuauuucuuucgucugauugcucuggcuaggacuuccaguacuauguugaagaggaguggugagggugggcauccuugucuucuuuccguucucagagggaaugcuuucagcuuuucuccauucaguauuauguuggcuauggguuugucauagauggcuuuuauuacauuaagauaugucccuuguaugucgauuuugcugaggguuuuaaucauauagggaugcuggauuuugucgaaugcuuuuucugaaucuauugagaugaucaugugauuuuuguuuuuaauucuguuuaugugguguaucacauuuauuuacuuguauguguuaaaccaucccugcaucccugauaugaaacccacuugaucaugguggauuaucuuuuuggcauguuguuggauuuggcuagcuaauauuuuuguuaaggauuuuagcaucuauguucauugaggauaauggucuguaguuuucuuuuuuggucgugaucuuuccugguuuugcuauuacggugaugaauagggaugaauuagggaggguuacuucuuucucugucuugugggauagugucaaaaggauugguaccaaugcuuugaaugucugguagaauucugcugugaauuggucugguccuggacuuuuuuuucuugguaauuuuuaaauugccauuucagucucgcugcuuguuacuggucuguucgggguaucaaauucuuccugauuuaagcuaggaggguuguauuuuuccaggaguuuauccaccucuuguagguuuucuaguuuaugugcguaaagguauucauaauagccuugaaugaucuuuuguguuucaguggugucaguuguacuaucuccuguuucguuucucagugacuuuauuuggauuuucucucuucuuuucuugguuaaucuugcuaauguucuaucaauuuuauuuuaucuuuucaaggaacuagcuuauuguuucauuuaucuuuuguauuuuuuguuuuguuuuguuucaauuucauuuaguacugcucugaucuugguuauuuccuuucuucugcuggguuuggguuuguuuuguuuuuguuucucuaguuccuagugaccuuagauugucuguuugugcucuuucggacuuuuugauguaggcguucagggcuaugaacuuuccucuuagcacugccucagcuguaucccagagguuuugauaggcugugucauuauuguauucagguggguguauucagcucccacgcaaaccgaaaggcuggucuugucucacucccaugguguaccgcacccccuaccccuccagcgccgaaacagccccgaguguguuugagucuggcuugaaaacuuguccccggcuuuccaccuccaagcugcaaaagaaaagggcuuuaguucaucccccaccugugaagucugcaaucuggauuugcgcccuccccggaguucuggccaggaggcuucuugccccauucaaauuguuaaaaaguucagcuagagaaguccuucucccuguggaguuuuacccucugcucugauggccauccuccugauggaucccuguguugccaggcaggaaugggcugcuuggggauccagcaagcucccagugccuuucugcuacuuccucuaccccuguauuucgcucggcuuggcuuucuaacuugacucaacuccagcuaaagucaggaauuucuccagcaaacagaccuucagcuucuccagugggggugugucuaccucauuaauuuuaacucugugacuuauuccauuaucccaugguuuaagccccauuuaccagauccccucugacaaauuuuuagguuguuuucaauuuuccuccguaacaaaccgugcugcagagaacauucuuuuauguaucuuugggugccuguggaagaguaucuuugggaccaauuccuagaaauugaaauaugggucaaaggguuuacacauuuugcauuuugauaauuauuguaaaauugacuuccaaaauuuuugauacuaauuuagacucccacagaguguaugagaguacccauuucaacgcauccucauggauaccgaauauuaagugguaaaaccauuuaaaucacugcuguaaaaggcauuuuuuucucuguagaaaauguuuucagauucaaaguaagggaugcauaauuuuuaaauacaaagcuagagauuuuaguuuuacaaaauauuaguuuuuuuuuguuguuguuguuguuguuguuuuuuacuauuuguguagccccaacugaauacugaauaacaguuguuauuauuugaucugucauacugaagcuguuacuuuugaagucauguaaaaguugcauuuucucuaaugcuuaccagaugggagauaguuugacagcugcuuuguugaaaucagcaauuaaguaauauguguguauauguuaaccagcaagcaaauagaguauguauuaugcccuggaaaaaauauauaucagcugggcgugguggcuuaugccgguaaucccagcacuugggaggccaaggcgggcagaucacuugaggucaggaguuugagaccagccugaccaacauggugaaaccucgucuuuacuaaaaaugcaaaaaaauuagccaggcaugguggcgggcaccuguaaucccagcuacucgauaggcugaggcaggagaauuaccugaacccgggagguggagguugcagugacccaagauugugccacugcauuccagccugggcgacagagggagacuccaucucaaauaaaaaagaaaagaaaagaaaaaaaauauguauguuauuuuaacaaauaagccuuuaguauuucuucuaaaagaguccacagaugcuguggaacauauuuguucagguacaaaugcauuccauaguaauaaaauguuguuauuuuuuauauugcaaucccaaauauuuucugaguuuaagcuuuuaagaucuuuuauagcuuaaaagcuguucucccuacccuccauacccauguaacaaccaguuucacuuucuuuuaucaguuaaaauuuuuccccagcaaugaauguuaguuauuuggacuaagugggaaguauuauauggucuguugugacauauauuauucuuaaaguguaacuuuugaaauuugucuuuucauguauauauacauugcucuuagucuuugcugauaguuuaaguugauauacuaaugcugaaauagcuuuaaagacuuuucaauuuuaaaagacauuuuuaaaaauaggcuaugucuguugggggaacuuuuucccucuuguuguuuuuauuuuugcuuauuuuuguaaacucagaggacccugacuaccauuuauagugguauuucaaugcucuaccauuuggauauaauuaauauaguuagugcuguauuaaccaaauacgggagcagauaaaauauguuuauacuuacaacgaugucauuuuaucuuccuguaagaucagcacuuuaaagggauuaacuuuauuuacuuaaauggaucacauuuucaguuuuauuauauauuaauuguguuauuuuucuguuuauuuuuguaggcccugauuuuguuguuugugaugaaggccauauucuaaaaaaugaagcaucugcuguuucuaaagcuaugaauucuauacgaucaaggaggaggauuauuuuaacaggaacaccacuucaaaauaaccuaauugagugugaguuaauaucucugauuaugcaguagaauauugguauuuccucagauauauuuuuguaacguuaccauuuaccuuucuucuacuuauucuaguauaguccuagaccaugaucuacauagguucaucuuagucugcugugaaagaauaacauacuuuucaaaugagaugcuuuauaaaugagugguaaaauacaguuaagagauacgcuauugugaauguucauauauaaauauggaaugugaauuauugcaagaguaucagaagucuuaaugauugcuuuagaaaguacauaagcauaugugauuacuccagauaauuuuaaggggauauuccaguuuuggggcauguacugucaagaaaucagaaagaaaugggaacugugaacauuuuaguaaaguggagaugggagaaggagagguuugcugaauccauggcaggacaguuugcugaggcuaaagguaguugaugugaaccuagggaaaugacuugugaauuacccucauuuucguaugucuguggugacacuaaagaagggaacaugagauuauucagcaaguaacuaauugaaauuuccuguuauaaucucucacuuuuuuucuuuuucccacuguaauggcuuuuuguuauuuuucucuguguuacauuccuuuaguguauuuaugguaacuuuuugcuauuuuauuauuuguaauacuagucauuucacuuuagccuauacuuuauguuuguuuuuaucuguuccaguuuuccucuuuucuauucuguuacccuauuuauagaaaugcuguuucauauugugguccuauauaguaugggacaagugauggcucuguuaauuuuuacaaaauggguuagucuuacaaaauacauuaguaauuaauuuuuuuuuuuuacuauuuguguagccccaacugaauacugaauaacaguuguuauuauuugaucucucaaauauuauuugguuauucuggaaaugaaucaguuaauauaaauuaacuugcuuaguagcuuauuaccuccuauuuauuguuuugacuuaguaucuccuuucuucacaagauagccucacugaccauaaaaucaugguuagauuaauggaccacuuguuuuauacuucauaucucuuauaaagaauaauagugaguuugaauaaacuguccuuagguauuuuuaaaaaacguucaugucuaguauuuagggaugguuuuuacuucaauuuucucucucguuuugguaauucacuuguagaucagacuuauaaccauguuuauucuauacuuagcuugauauucuuucuuuauagcuuaauucuaaugcauguguuuuugacaugagcauuucauuggggaauuuuucuaagucuuuuuaacgauuguuaauguuguuaaugaauaaugucuucucucuuagaucauuguaugguuaauuuuaucaaggaaaauuuacuuggauccauuaaggaguucaggaauagauuuauaaauccaauucaaaauggucagugugcagauucuaccaugguagaugucagagugaugaaaaaacgugcucacauucucuaugagauguuagcuggauguguucagguacaaauauguuccauaguaauaaaauauucuuacuuuuuuauauaacaaucccaacauauuuucugagcuuaaaguuuaauaauuuuguguuuucuuucccgcucuuucaguagauaguuuuacaguuauaucuccuugcguugucuuaaaaaauuucugcugcauucaacuuuuaaaaaagaaguuccgcugaguuuaaaacauaguugauucauuugccagguguaaagccucauaucuuauuauguuaauguuuagauuuuucauccuuaagauagggaguuccuuaagaggaacauagcuacuaugaugaaguuccuaugcucacccuaauucuguaguacaguauuauaaaucucacuuuuuugaaaugguuauaggagaggccaguaugaauuaagagaggagccacuuuuaaaguaauccuggagaaacaguuuuguuacuuucaaguauauauaauaaccugaacagacuaguggugucguuuacauacagauuuucagugaaucuauauuaaugaauggauaagugucuagagacugagcuggcaguuaauagaucucaagauacgcacuuucucuguagauguuagguacugaugauagccucaaagauguuuuaacaaaugagacaggcuauucuuuugguuggauauacaguuugcccuccauaucugcagguucugcauccauggauucaaccuaccauggaucaaaaauauuuuuuuaaaaaauagauaaaauggacagaggcuagguacaguggugcacaccuguaauuccagcacuuuaagaggccaaggugggaggaucacuugagcccaggaguucaaggcugcagugagcuaaaaucaugccacuacacuccaggcugggugacagagcaagacccugucucuaaaaaaaguuuuaaaaaauuagccagccacgguggugcgcaccuauagucucugucacuugggaggcugaggcaggaggauugcuugagcccaggaauucaagacugcaaggagcuaagauuaugccacuguacuucagccucaaugauagaguaagacccugucucuuaaaaaaaagaaagaaaauaauuaagaaaaaaauggaugauugugucuguacugaacauguacagacuuuuuucuugucauuauuuccuaaacaauagaguauagcaacuauuuacauaguauuuguauugugugaggcauuauaaguaaucuggggaugauuuaaaguauaugggaggauguuuauauguuauaugcaaacacuacauuauuuauauaagugacuugaacuuucauggauuuugcuaucuguggaggugggguggguucuggaaccagucucccauagauacugaggcaugacuguacuugccaucauuauaaggaguaguuguuccguuuggucagguuggcuacaugugcuagcaaguacccuguuucuguauugcugcuacuacccaggcagcauuuuucuuucugguuuaaggaguaauuucuauuuagcacauugguguucuguuuuucuacucuuacaauaaaaugguuucaagagugcuuguagagggguugcuuucuuaauugggcaaauauucccucuaaaauuauauguuauuguuugacauauuagcauaucuuucuaagaagccaacucagacugcauuagacuuugauuccuagguuuuauuacaugauuaaagcaaggcauuuugcucacacuaccuacuacauccccuccauaccuuuuguuauuuuuuuuucuguacagagaagacuauuuugaaaacuuaaauugcucacuugguaaugugauugcuucaauuuaaaaccuaccugguguguugcagugucuuuuuaccaguguaccauauuguauagucauaugaaauacauuguguagauaauuguggguuuagaaaggguaaauauauuuaagaaaauguuuucuuauauguuuagugccuauuuauuuauguguauauuucaguuauaagcaaugagaacuuguaguucauuccuguuaaauauuuagauuaauuuucauucucuuucuuguuaauuacagaggaaagauuauacagcauuaacaaaauucuugccuccaaaacacgaauauguguuagcugugagaaugacuucuauucagugcaagcucuaucaguacuacuuagaucacuuaacagguaaacaauacaccuuguugauuucaucuucucuauaaagacauucuuuuuccaaagaagauuauuucagucaucuuacuaugucuguuguucuuuuucaguuuugcauuugaauaaaauggguaugcuuaaaagcauaaaauauuucuaauuaaaacacugaugcugucaaaauuaaaaucaagaagcaaauugaugaaaaagauauacagcacauaugaauaaugcccuuaauuuguaaagagcuuuuauuucagaaaaauuaugaaugugaauaaauccauaaaagaagauauacaaaauuccagaguauuuuuuuaaaaaguauuuacccacauuaauaauaaaagguguauaaguuaaauucaugaguuuguuucucaguuauuuaauuaacaaagguugaaggcaaaaguaaaauagaaggcaaggcauguaguaugccuaaaauacaccaaaaugcuaacagaaguuguuuucugggugcuuuuguuaugaagaccuucuaguuuauuucuuguauuuuucuaugcuuuaaaauaauacaaugaauaguuuuuguuuuaccaucaauaagcuuuuugugugugugugugugucugugucucucugugccugaagaugucugucuucacacaacaaaaccuaaucuuuggacuggagugagauuucuuacuuguugaucacuuauucugguaccuuuccccaaaugauauuacugauuuaauuaggagauacagguuagagggugcucuuuggccaauugugaauacaguaauugaucaaaaaaaaaaggaggauggaaguacguacacacauauuaacaugauaauuauagcuaaagugguacucuuuuuuaauagcagugcauccuagagaguaaaauaugaugguucucaagaaacauucugcuggggaaaacaguguuugaaucuuaguauuuuauggaacugcuuuuuugcuuuuauaaaagcaauuuuuguauugacuuuuggaagaaaaucaguuccaauaaagcacacauuuucauuuguauaucugucagaagcugauagauuuacuauacuauucuguuuugaauaauaaaaauugcaggcauaauuaaauaaccaaauaguuaucccaaugagagaguugcuguauaguuuaagagacagauguucagaucugucuuuaauuaaucucugaguaauaaggaguaauaaauuuggucauuuaauauuuuuuccuuuuaaaauguuuuauauuagggaaaaugcucacaauaguguuuucagguuuuauagaauuaguugucuuuaauaaccaaucauaggcugagcauggugguucaugccuguaaucacagcacuuugggaggcugaagugggaggauuacuugagcucaggaguuggggacuagccugggcagcauagugaaaccuuaucuccacgaaaaaucaaaaaauuagccggguaugguaaugcacaccuguagucccagcuacuugggaggcugaggcgggagguuugcuugauccugagaggucaaggcugcagugagacaugauugugccacuggauuucagccuaggcaacagagcacuaccuugucucaacaacaacaacaaccaccaccaccaaucacaaaugguaacagcucagguauaaauguuaagcucuacucuuuugaguugaccucauggagguagauagaaugauagauacccgaaucugggaaguauguguguguugagggagggauagagagagguugguuaauggguacagacacauaguuagauagaaggaauaaguucuacuguuugauagcagaauggggugacuguaguuaacaacagugcauuuuauauuucaaaauagcuggaagagaggacucgaaauguuuccaacauauaaaaaugauaaauacucaaggugauggauacccugaauacccugacuugaucauugcauauucuaugcauguaacaaaauaucacaugcacucccaaaauauguaaaaauaauauguaucaauuuuuaaaaauuuuaaaaaaacacucuuuuugagagcaaugcaauuauuuaagaauuuagggggcuuugcuuuauucuuugugacuaucauugauaggaguaaauaucuaaagcacuaauugccauagcuaaaaucuaaaagauaugauuguuaaauuaucaccugguaccgugaaucuuuaaguuuuagggugugggguuuuccccuuaccaaaugcaauauuacccauagaguagaauaaccugaguuaaauagccucuuugaaaaacauucauaaaaggccaaguggguuauaugaauggcuacucugucuugauucucaguacaaaucuucacaguauuucucuugaaauaucaccugccuauuuuacuugcauuuaaaauguuugguauuuugucuguuaaauauuccagaaauuuuuuguuucuacauuaggcuuuuuuagacugugguuacuuuuaagaaguucacccaaauuuuguuuuuaacauuagcagcaguuucauauuaauuuuagugauaauuuauaauauuugcagaaugaaaguccuaagggacuggcuuuuaaagaauauugaggaaaucuaaaauccucuuaauuuuucuuaguuuucuuuuuuucaguguaauucuaugguuugccuuuuauugucagguaucagaaguuuauaauaacauguaagccucugcaauucaguaaacacuuaagguuuuauaagcauguagauacuuaauuuuuuaauaacuaaauauuagucuggcuuuaaacuuaaaauccacacacugucuuauuuugacaacugugcaaaaaauagaacacaggaaaagauagcccauggaaugugagaaaauauugcaaaacauauaucugauaagggauucacaugcagaauauaguugucccuugguauaugugggggauugguucuaggaccugccuguguauaccaaaauuugcucauacacaaaucccgcagaaccugcauauaugaaaagucaaacauagguuucacauucugugaauacuguauuuucaaucaacauuugguugaaacaaagucuguauaaguggacccgugugguuuauaccuuuggugcgcaagggucaacuguauguaaagaacuccuacaacucaacaacaaagaaacagucuguuucaaaaagaagcaaaggauuugaauagacauuucucuaaagaagauauacaaauggccaauaagcacauaaaaaaaugcucaacauaucuacucauuagaggaaugcaaaucaaacguacagugagauaccauuucacacccauugugguggccauuauaaaaaaaaaaaaggaaaauaagugcuuaugaggauguggagaaaguggaacccuguacauugcuaguaggaaugucagaugauguggcuacuauggaaaaacauuguaguaacucagaaaguuagacauagaauuaccauuugaucuaauaguuccacuuauagguauacccagaagaauugaaagcaggaacucaagcagauacugggacacuuauguuuauaguugcaucauucauaauggcaaaaaaagguggaagcaacccaaauguccauugauggaugaaugcauaaacaaaaugugguauggacauacuucaguggaauauuagccuuauaaaggggggaaauuccgacauuuacuaccacauagaugaagcuugaagacauuaaugcuaagugaaauauaucagacacaaaaaggcaaauacuguauacuucugcuuaaagguaccuagaguagccaaacucuacgaguagaaaguagaauggugauuaccagguucugggggacgaagggaaugggaaguuacuguuaauggguacuaaguucuguuuggaaugaugaaaaaguucuagaaauagagagugaugauguuuguacaacauugugauuauacuuaaugccacucaauuguguacuuaaaagguaguuaaaacaguaaauuuuuuauuuuauuuuauuuuuauuuuacuuuaaguucugggauacaugugcagaacgugcagguuuguuacguaaguauacaugugccaugguggugugcuguaccuaucaagccaucaucuaguuuucaagccccacauggauuagguauuuguccuaaugcucuuccuccccuugccccucaccccccaacaggccccaguaugugaugugccccucccuguguccauguguucucauuuaaaacaguaaauuuuuaaaauguauauuuuaccagaauuuaaaaaguacccccaaauggagcacaguaauaugcuuuugucucuaaaaaugcauggacccaagugccacucuuuagagauugauucaaaaggucuggaguagggccgaugcaucuauaguuuuaugagcccuacaggugauuuugauggaccaucagcuuaagaaccauugcuccaaauuuuuuucuuugguaaggggugagcugagaccugagaugagugaacuagacaaggggaacauggagaaaugacacugaaauguuaacuuugauggguuucucuaagugguggaaauauuaauucuuuuguauuuuacuuguuauauacauuucugcaaaauuacaaaauccaagaaauauacauauauguaaaacuuccauaaucagaaaaauacuuuaaaguuucauuuuguuuuuaauugacacaugguaauuguacauauuaaugggcacagagugauauuuugauacauguauacauuguguagugauaaaauuaggguaauuuagcauaacuaucacuucaaacacuugucauuucuuuguggugagaacauucaaaauucucuucuagcuguuuuuuaaaauuauauuucuuuuaauuaaaaauauuuauuuaaacauuuuuuauauagagagauggggucuugcuauguugcccaggcucgucuugaacuucugggcucaagugauaccccaucacagccucccaaagugcugggauuacaggugugagccaccaugcuugcaugaaauagccucaucuggcuauuucaauaaguuauuaaguuaaauuuaguguuuaaaaauauuaugacuaacauuggaauaguguacuucaagcugggaaaagaauguauaauaguaauuuccaaaugugguuguacugucagaaucaccauuaaaugcagaacacuacuaaauuuacaaagauaaaaugauacuaaguguuucugaggcuauagagaaaugagcccucuugaugguaacauaaauuggacaguaauuuggaaagggacgucaaaauuaauuucaauuguaugcuuuuuuccaaaggaaauggucagaaauguaugcagagauuuauauuaaaagauguuaaucucaggguuuguuucaaaacuuaguuuucuggcuacagaaauagcaauguguguucauugugaaauauauaugaaauauugaaaggcacuaauacaauaaaaacuaccuauaaucuuauaaacuagaaguuggaacugcuaguuauuuaauauuuaauaucuugcuuuccaguuuuuaaaauguaugugugacacuuaaaugucauaaacacacacuacauaaacacacaauacauauacauuguguuuauauacuauauauauauauuuauuuauuuauuauuuuuuuaauggcuggaauuauauuauccagcuugugaccuaaagugaacuguuacuuguuguggcauuauuuauaauaaugaaaaauugaaaauuaacccaaauccucaacuuuuggggauaguuuauauuaugguauaucaccauaaucuaauaccaugcaggaagauacauuaaauauuauaacauagaauauuguguguuaauauuuaggaauauauagaauauauuauguaauaaagaugaaauaguacccauuucugugaaauaaaaaggauauguaugaaaaugcauagcaaugugaucaaaaagauaaugccacaaaauauuuuuuaguguacacucuaauauuuucaaauuaguagaauuguguuuauaauguguauuaaauuaccucuucaaauuggcucuauccccuucucucuguuuugauaugacauuuaucagcucuucugacuccaucaaccacgucucaagaucucuuccacauuccugaucauuuuaacucugcugcauuaaguuaguauauucugacauaucuuccagcuaaguaguuuuugucuuuggaugugugucuuaugcuauuaagaggaauuuaauugaaauguaaaacucaauggcuuucuccugaggucaggaacaaaacaaggaugucacuuuugcuucuuauauuuaacauuuucuagagguucuggccaggacaauuauaccagaaaacuaaaaguaugccacagugucauggaagggguaaaacuauuucaguuugcaggugacaugauauuguauagagaaaaaauuuauuguuuuaaguuuuguggguacauaguagguauauauauuuaugggguacaugagauauuuuaaugcagccaugcaaugcauaaucacaucaggguaaaugagguauccaucucaagcauucauccuuaaaugacaaacaagucauuuauauuauuuuauuuauuuuaaaguguacagcaaauuauuguugccuguagucacccuguucuauaaaauauuagcucuuauucauucuaccuaacuauauuuuuguaccuaauguccaucucuccuuucccccugcccuacuacccuucgcagccucuauuaacugcuguucuacauucuaucucugugaguucaguuguuuuaaauuuuagcuccuggacggguaugguggcucaugccuguaaucccagcacuuugggaggccagggcagguggauggcuuaagggcaggaguucaagaccagccuagccaacauggugaaacccugucuauaaaaaaaaauacaaaagucgagguggcaugugccuguaauccuggcuacucaggaggcugaagcaggagaaucgcuugaaucugggaggcagaggcugcagcaagcuuuggucaugccacugcauuccagccuuugugacagagcugccucaaaacaaaaaacaaaaaacuuagcuccccaaaauaagugagaauauguaaaauuugucuuucgugcuguuucauguuguuugaaaugacaggaucucauucucuuuuauggcugcauaguacuccauuguguacauguaccauauuuucuuuauucauucaucuguugauaaacuuuggguugcuuccaaaucuuggcuguuauaaacagugcugcaacaaacauaggagugccaaucucuucaauauacugauuuucuuucuucugaguauauauccagcugugggauugcaggaucauaugguagcucuauuuuugcuuuuuugaggaaccuccaaacuuuucuccauagugguuguacuaauuuacauucccaacagcaguguauguggguucccuuuucuccaccuccucgccagcguuugucugucuuuuggauaaaagccacuuuaaagggugagaugauaucuuauuguaguuuugauuagcauuucucagaugaccaaugauguugaguaccuuuucuuauaccuauuuuccauuugcaugucuucuuuugagaaaugucuacucagaucuuuugccaauuuuuuaauuagguuguuagaauuuuuuuccauuugacuuguuucagcuccuuauauauuguggucauuaaucccuugucagaugcguaguuugcagguauuuucucccauccuguggguugucucuucacuuuguuggauuguauucuuuccuaugcagaagcuuuuuaacuugauaugaucccaucuguccauuuuuuuguguugguugcuucugcuuuugagguauuacucaaaucuuugcccaguccaauguccuguagaguuucuccagugguuucucuuaguaauuccauaguuuaagguauuagauuuaaguuuuuaauccauuugaauaugauuuuuauauauggcaauagauagguguccagauucauucuucugcguauggauauccaguuuucccagcaccacuuacugaagagacuauccuuuccccagugcauguucauggcaccuguguagaguaugcguucacuguaggugugugaacuuguuucuggguuaauuauucuguuucauuggccuaugugucuuuuuuuuuuuuuuuuuugagacggggucucgcucuguuguccaggcuggagugcaguggugcaaucucggcucacugcaagcucugccuccuggguucacgccauucuucugccucagccucccaaguagcugggacuacaggcacccaccacugugcuggacuaauuuuucguauuuuuaguagaggcgggguuucacuguggucucgaucuccugaccucaugauccgccugccucggccucccaaagugcugggauuacaggugugagccacugugcccggccggccuaugugucuuuuuuaugcuaguacgaugcuguuuugauuacaguaguucuauaguauacuuugaaguuauguaaugugauuccuccaguuuuguucauuuagcucaggauagcuuucacuauucugggucuuucgugguuccuuauaaauuucaggauaguuuuuucaauuucugugaagaauaucauugguauuuauuucauagggauugcuuucaauaugaagauugcuuuaggugguguggacauuuuaacaauauugauucuuuugauccaugaacauggaaugucuuuacauuuuuugguguccucuuccauuucuugcaucaauguuuuauauuuuucauuguagaguucuuuuacuucuuuuuuuuuuuuuuuuuuuuuugagacagagucucugucacccaggcuggggugcaguggugcgaucuuggcucucugcaaccuccaccuccugguuucagugauucucaugccucagccucccaaauagcugggauuacacgugugcaccaccaugcuccgcuaauuuuuguauuuuuaguagaggcaggguuuugucauguuggccagccugcucuugaauuccuggccucaagugauccacccgcauugaucucccaaagugcugggauuacaggcaugagccaccgugcccugccucgcuucuuaaauuccugaauauuuuguuuuauuuguagcuauuguaaauaagauuacuuucuugauuucuucaaauuguucacuguuggcauauagaaaugccaaugauuuuuguauauugauuuuguuacuugccacuuuacugaaauugcugaucaguucgaauaguuuuuugguggagucuuuaguuuuuuuucuuucccaaauauaaggucaugucaucugcaaacaaagauaauuugacuucuuccuuucccauuuguaugcgcuuuauuucuuuaucuucuuugauuacucuuacuaggacuuccaguaugauguugaauaacaguaaugaaagugggcauccuuguuguguucaagaucuuagagcaaagacuuucaguuuuuucccauucaguaugauacuagcugucgguaugucguauauagcuuuaauauguugaaguauguuccucugauacccaguuuuuuagggcuuuuuauuaugaagggauguugaauauuaucacaugugcuuccagcaugaauugaaaugauuauaugguuuuuauccuuuauuuuguucauaacgauguaucacauugauugauuuccauauauguguguguguauauuuauauguguguauguauguauuuuuguguguguguggguuuuuuuuuuuuuuuuuuguagagaugaggucucuauguugcccaggcuugucuugaacuccugggcucaagggauccuccuucuucggccucccgaagugcugggauuacaggugugagccaucacacucagcugauuuccauaaacugagccaucguugcaucccuaggauaaaucccacuuggucaugaugaaugaccuuuuuaauguguuguucaauuuguuuugcuaguauuuuguugagguuuuuuguaugaaugaucaucaggaauauuggccuguaguuuucuuuuuuugauguguccuugucugguuuugguaucauuguaauacuggucucagaaagaauuuggaaguauuccuucucuauuuugcagaauaguuugaggaggauuggaauuaguacuucuuggaauguuugguaaaauucagcagugaagguauuagguaccuggcuuuucauuuuuuaauuuuucuuugggggaugggguuggggcuuuacaugccauaauauguuuauuuuauuuuauuuuacauuuucauuuuagguucagggguacaugugcacauaaauugggguaaauuuacccauacauguacccaugaaccuaaaaugaaaauucuuuagguaaauuggggucucuagguuuucuuugcuuuggagacuuuuuauuauuacuuugaucucauuacuuguuauuggucuguucagguuuuggauuucuuccugguucaaucuuaguagauugcaugugucuaggaauuuauccauuucuucuagguuuuccaauuuauuggcauauaguuggucauaguagccucuaauggucauuuaaauuucugugguaucaguuuuaaugucuccuuuuccauuucugauuucauuuauuuggguauucucucuuuuuuuucauaaguagucugacuaaaaguuuguugaguuuaucuuuucaaaaaaccaaguguuuguuucauugaucuuuucuacuuuucuacuuuuaaacuuuuugauguguuguugaauuagguuaguauuuuauugaggguuuuaauaucuauguucaucagugauauuggccuaugguuuucuuuucuuucagcaucuuugucugccuuugguaucagggugaugcuuaccucacaaaaagaguuuggaaguauuuccuguaauucuguuuuuuggaagaguuuaagaauugguauucgugguuuuuugaauguuugguagaauucaguuuugaagcuaucugguucugggugauuuuuguugggagguuuuuuuuuauuacuacuuauuucuuuuucuuaauucuauuuuuaauuuaauuauuuuguuuuguuuuauuugagacagaguauugcuccaucacccaggcuggagugcaguggugcgaucucagcucacugcaaccucugccucccagguucaagcaguucuccugccucagccucccaaguagcugggauuacaggcgcccaccaccaugcuuggcuaauuuuuuguauuuuuaguagagacaggguuucgccauguuggccaggcuguucucgaacuccugaccucaggugauccaccugccuuggccucccaaaguucugggauuacagacgugagccaucuuaauuuuauucguauaaauuuaugggguacauguguaauuuuguuacauggauauauuauaguggugaagucagggcuuuuaguguauacacagaauaauguacauucuacccauuaaguaguuucucauucacucuucucguuucccccgacccuuccaagucuccauugucugucauuccacacucuacauccauguguucacauuauuuagccccacuuauaagggagaacaugacacuauuuaucuuucugugucucaauuguuucacuuaagauaauggccuccaguuccauccauguuacugcagaagacaugcuuuuguucuuuuuuguggccaaauaguauuccacuguguauauauaccacguguucuuuguucaucuuuugauagacacuuagguugauuucauagcuuugcuauugugaauagugcuacaauaaacauguaagugcaaguaucuuuuuuuuuauguuuuugauauaaugauuucuuucucuuuugguagauaccuaguagugggauugcuggaucaaauguuaguucuauuuuuaguucuuugaguaaucucuguacuguuuuucauggaguuugugcuaauuuacauucccaccaauaguguaaacauauucucuuuccuccgcaucuuugccaacauuuauuuuuugacuuuuuaauaauagccauucuaacuggggaagauaugucauugugguuuugauuugcauuuuucugacguuuagugauguugagaauuuuuucauaugcuuguuggccauuuguuauaucuucuuuugaaaaaugucuauuuaugucuuuugcccacuuuuuaauggaauuauuuguuuuguuuuguguuguuguuugaguuccuuguaaauucuagauaucaguccccuguuggaugucuaguuuggaaauauuuucucccauucugcagauuguuuguucacucaguuaauuauuucuuuugcugcuuuuuauuuaagucccauuugucuguuuuuguuuuaguugcuuugcuuuugaggucauagugaugaauuauuugccuaggccaauguccagaaugauuuucuccagguuuacuuucucuagguuacuucucuagguuuacuucuaguauuuuuauuguuucagcucuuacauuuaagucuuuaaucuaucuugaguugauuuuugcauaugguuagagauaaugguccaguuucauucuucugcauaugggaauccaguuuucuuagaaccauuuauugaaaagaguguccuuuccccaguauauguuuuuauugacuuugucaaaggucaguugacugucaguaugugucucuauuucuguguucuguauucuguuccauugaucuuugugucuauuuuuauaccaguaccaugcuguuuugguuacuguagccuuguaggguaauaugaagucaaguaaugugauaccuucagcuuuguucaagaauuaauauuauuggccaggcacgguagcucacaucuguaauccuaguacuuugggaggccgaggcaggcggaucacuugaggccaggaguucaagaccaaccuggccaacauggcaaaacccugucccuacuaaaaauacaaaaaaaaaaaaaaaauuagccgagcaugguggcaggcaccuguagucucagcuacucgggaggcugaggcaggagaauggcuugaacccgggaggcggagauugcagugagccgagauugcgccacuguacuccagccuaggcaacaagagcgaaacuccaucuaggaaaaaaaaaaagaauuauauuauuaaaaugaccauacuacccaaagcaaucuacagauucaaaccuaacucuaucaaaauaccaaugucauuuuuuauagaauuagaaaaaacaauccuaaaagucauauggaaccaaauaagagcccaaguagccuuggucucuuuauuuguaauuggucuguugaggcuauuucuuuuuuauucaguguugauauauuguauguuuguaggaauuuauuuccuguagauuauucaauuucuugguauauaauuuuucauacuaguucuuuaugauccuucuuuauuucugaggcauugguuguaaugucuucaugucuauuuuauuuauuugaguccucucucuuuuuucuuaauaggcuaaggguuuguuggcuuggcuuauuuuuuucaaaaaaacaacuuuucccccuauaucuuaucuauuauuugauuuacuaaugcuuugauccuuauuuccuuccuucugcaagcuuuggguuuagcuuauucuuuuucuagcuccuagagguauaaagauagguuccuuauuugagaucuuuuuuugacauaggcauuuaucauuaaaacauuccucuucuuacuaaaguauuuucuuuaaccacauucaaaugaaauuagaaaccaauaacugaaggaaaguuuaaaaauuuacaaauacauguaaauuaaacaacauauaucuaaauaaccaauggaccaaagaagaaaucacaagggaaauuaaaaaaugcuuagagguuaaugaaaacaaaaacacaggguacuagaauaugggauauaacuuaaguaauacuuagagagaaauguauggugguaaauaccuguauuaaaaaagaagaaagaucucaaauuuauaauucaaccuucuacuuugcaaauuaaacccaaaacaagcagaaggaaggaaauaauaaagaaaugugaggaacagaaaaacaguagggaaaaucauugaaaccaaagguagguucuuugaaaagauuaacauaaucgacaaaccuuccuucacuuacaaaguaaugaaaaaaaaaggcacagcuaaaauaagugccgacuacagugggucaugccuauuaaucccagccuuucgggaggccaaggcagaacaauccuuuaaagcuaggaguuuaagaacagccuggucaacaaagcgagacccugucucuacaaaaaauaaaaaaaagaauuagccaaaccugguggcaugugccuguaguaccagcuuuugggaggcugaggcaggcagauggcuugagcccgcaggaguucgagguugcaguaagcuaugauugcaucacugcacuccagccugggugacaguguaagacccuguaucaaaaaaacaaaaacaagaacagaaagaaaaaugaccuaaaguaaggaaugaaagaguaucacuacuaaccuuacagaaauaaaaagaauuauaagugaauauugugaacagcuguaugccgagaaauuauauaccucauuuucauagcagugauuucuguuacacaauggaaauaaccucuaucaggcaaaauaauacucagcagauuuuuaugcauuauuaauguuucauaucacuacuaaauuuucucucacucguggaggcaaaauuugcuaauuauuuaaacaacuuacauaguuuaaaaccguggauaggaaaauauguuauugcuuaaaugcuguuuuuuccuuuuaaucaguuuuguucuuuugcauauuaccuucuugauaauuuuauuauauuaaugaaacgugcauucauuuucuuuauguuuuauaggaaaaugauaauucuguugaaauuauucuggauagagcagagcuaauauuuacauuuuauacaucaaaaacauaauuuuuggaaggucuuuuuuuuuuuuuuuuaagagacaagguuuugcucuuucauccaggcgggagugcuguggugcaaucauaguucauuguaaccucaaacuccugggcucaagugauucucccacuucagccucccaaguaucuaggguaucuagggcuauaggugugugccaucauaccuggcuaauguuuuuguuuuucuugguggagacagagucucgcuguguuguccaggccugucuugaacuccuggccucaagcgguccuccugccucggccucccaaagugcugugauuacaggugugagcuacugucacuugccuagaaguaauuuuuuugagugagcauaguuggcgagagucaguaaaggacuaucugcauggagcaaaguuuauuuauaacaggaguuuguaaucuaggguccauggauagaauuuaggggauuauauguaccuggauaagaaaaaaauuauauauugauuucccuuaaccucuagcuaaagcagcagcauuuuucccagugaugaauagaggcaacaaucuauaguaguguuagugauaaccaugacuuuguuaccaauagaaaucagaaauauuuuuacauguuguuccugauaccucaaaaucauuuauguuuaucaauacuucagaauuuuagguauuuauuaaaccugugcauauuuuguuacuuaaugcauuaauuuuaaaaagcacauauuucuguaguacaaauucuuuaauauuuugauaauuucuauaugauggguuucuuuuguaauccuauuuguuuuauguguuucaaaacgauauuccaagagaauuuauaagcuucucuacacugccaaaaguguuuaugucacaaguaagauuaaaacuccuaaucuagaaacuugguugauauagacaauuuuugugucuuuaaccauauuucuuuugaucaggugugggcaauaauagugaagguggaagaggaaaggcaggugcaaagcuuuuccaagauuuucagauguuaaguagaauauggacucauccuugguguuugcagcuagacuacauuagcaaagaaaauaagguaagucagguaacuuaguuuaaaagcaucuauuggaagcagaauaaacuuagacaaaaaauugaccuacagacuguauauucaaauuuucuauugcuuuguucuauucuaugucuuauuucuaauuucuauaugucuugcauguauuaugauuauaggaguguuaaauguuauuuuauugagcccauuuuaaaaaacuuuuuauuuugaaauaauuuuauacuuauagaaaaguugcaaaaauaguucugagaauuccccuauaccuuugacccaguuucuucuaauaucagcauguugcauuaguauaguaaaguuaucaaaacuaagaaauuaacuuugguacaauacuauuaacuaaauggcagacuuuauuuggauuucuucaauguuuuuacuuaugucuuuuuuguuuuccaugauccaaucuaggaccucccauugcauuuaguaagcauaucuguccugucuucuuugucuacuaaaaucuguaauaguuccucaguccuuccucagcucgugccaauuaacuuauucuuaaaugaacaucaauauaauuuccaguguaaguugagauauucuauuaaaauaguggucauuuuuuuuucucuaggguuauuuugaugaagacaguauggaugaauuuauagccucagauucugaugaaaccuccaugaguuuaagcuccgaugauuauacaaaguaaaucgaauacuuuuucgugccauccuguauugacaaaguuaaaaccccuacuugcugauugaccucuuauaauugacguuuacaucuuuccuaugcuuuucuaacaaucugaauguguuuuuuuguuuguuuguuuguuuguuuuuagaaagaagaaaaaagggaaaaaggggaaaaaagauaguagcucaaguggaaguggcagugacaaugauguugaagugauuaaggucuggaauucaagaucucggggagguggugaaggaaauguggaugaaacaggaaacaauccuucuguuucuuuaaaacuggaagaaagugagucuaaugaauguugccuuuaucauggaacaguaauuuggaaaaugucaugucguuaguccuuuuuucagucacuuaccugacuaauugacucaaaggaaucuuuccucaauugaugagucuaaucaaguacucauaauuacaguaaauaucugaugaaucuuuaauuauaagcaagcuacucugugcucucugguauuugggggaaagguaaaaagaaaaacuaauguuuauuuacuuguauauaccuaaacucuauuauuuucacuacauguguuagcuaacugaauucuugagcaggcuugcaauguaguugauaguuuuaaaaaugaguaggagaacugguauucagaccuaaaaaugucuaaucucaaagccaccaugauauuuucacuuaacuguaugggaauaaauggaaacauuucagauaaucaagugugauuguaguuaauuuuuagucaguaauauacaguaaaacuaauuuuaaucauuuaguguuuuuccuuugugauucuucauaaucugcaauuaucuacuuuagguuuccuguguauuauguacaguuucuaucaccucuuuuguuuucuuucugucucucuugugcaugaaagugaagucuuagauugaacucugcagugguuuaaguugucuuuaccuauauguaaguugaaggauuaguguugagacacuguauccuacuagugcagccuguaugccuaggagcuuaaaaacugggaccaaaugucugccuauuugaaauagcagauuaugaagagagaacaagguaguggcucuaaauauuuggcauuugggaguuguggagcaaagcaguuaacugucuauaaggagaagagaguugugggggccaccuagguuagugauccugugaucagauaaacuuggcuggucucaggccuacagcugaaauaacuuggugauuaauuauuuuaauuuuauuuuuauaauuucaacuuuuauauucggggguacauaugcuaguugauuaacauggguauauugcaugaugcucagcuuugggguaugauugaucccauccccagguacugaacauaguacucaguaguuaguuuuucagucuuugcccccuuucucucuccccacucuaguaguccuccgugucugucgcucuccucuuuauauccauguguacccaguguuuagcucuuacuuauauguaagaacacgccguauuugguuuucuguuucuguguuaauucacuuaguauauaauggccuccagcuguaucccuguugcugcaaaggacaugauuuuguucuuuauuguggcuguguauauucuaugguuuauauguaccacauuuucucuauccaauccacuguugaugggcaccuggguugauuccauguuuuugcuguugugaauagugcuguaauaaauauaugagugcaugugucuuucuggcagauuuauuuuccuuuuguuuuauacuuguaaugagauugcugggucaaauugcaguucugcuuuaaguucuuugagaaaucucuaaacugccuuccauaggcggugaacuaauuuacaaucccaccaacauaaauguucccuuuucuuugccccuucuccagcaucugcuguuuuuugacuuuuuaauaauagccauucugacuggugugagauugugucucauugugguuuggauuugcauuucuccugugguuaaugaugaugagcauuuuucauguuuguuggcugcuuguauguucucuuuugagaaguaucuguucuugucuuuugcccacuuuuuaauggaguuacuuguuuuuuugcuguugaauuaaguuccuuauagauucuggauauucauuguuggauacauaguuugugaguauuuucucucauucuguaaguugucuguuuacucuguugauaguuuuuuuuuuguuauuuuguguuuuuguuuuuuuguuuguuuguuuguuuuuuguuuuugcugugcagaagcucuuuaguuuaauuaggucccaguugucaauuuuuguuucuguugcaauuguuuuugaggaauuagucauaaauucuuucugacucggugauuucuuuauaaacauuucucucuucaguaccuccauggaauagacagauggcagucuaacaguagacucugacuucucuuaagaaaucaggggaauaguaaaaauuaaacuacaaaauuucucuucucauucuucucuucuguuaccccauaaaacaguuuacuaucaauguucaucuucuggauagauauaaagaauauuuuuaucagaauaauaaauuauuauaguguaauuuaaggcaaugagaaguuccuguaucuccuucccugcugcugcugccccaaucugccuuuuccacauaaauuccucagucucucaucucauaauuaaaaauauauaaaguuuacauguuccuggaaauuauuuucuuaaaauacucuuguugaauuuuuucucauaacuuauggcuaacaggagcagaagaguagaccagucagugugcaucauccugugcuauaaauggguuacguaagaguauacugagauuuuuuuuuuaaaguguacugagauauugauccuuugucacuugggaauacaauuagaaucugaggcagcugguuugccuccguaaaugaguagucucuucucuuuuuccugguaugcuauauaagcauuaacguuuuuuacauaugccauaaugugaauggguuggaaagcacugggggcagaauguaggaggcuacauguugugagcccaaaaacacacagggaaggccaucaguuccaaaagacaaauuuugaccacuugucuaggauuuuuguuucauuuuaguugugugcagucaaauauaagucauuuguauauggauauauuuuauauauuuuuguagcuuauauacguguauaguauauuagaagcauucuccagaacuaauagauaauaaaauuuauuuuuuucuuugcaucuaaauuaacuccauauaaaauggaguauaucauaauguauggacauacguagcugguauuguauaacuuuaaaaaaaaugacuuucuuacaguaaauauaagaaaaucugaauaggaaguauuaaggggcuagucugccuccuuagcgcaguaggcagcacaucggucucauaaucugaaggaaguauuaaaggguuaacaauguuguaccuggaauuugaaauggauauuaaauaauuaauuaccuauaauugagcuacaauaugauuuuugccacauauuuuauuuucacgucaaagaguuacuguuugcuuuaauccuuuuguaguagcugucucguuuuucugagaagcagcaucuugaaugagucauuuaaguuuagcuuacaucauccccauuucuguguuuuaaauguuuuuuauuagaaggagaguucaugaucacgaaaugacuauguaaauuacuucaaaguguuagauuuauuauuacuuaaguauuuuuagaguaagcuucauugguaagcauuugcauuuuaaaacguauguaauuguauggauauaaaguuuugugacagaauccuuguauaugauguagagccguaauauuaguacuaauauaccauauuuauucacucaacagauauuuauaaagugcuuacuauaugcccagacauaaggagggaacugauaagccuaaaugguaaauugaagaagguaugcuauggaaauccuagggagaugcuagucuugagacuagcagcuuugauuuucauuuauccagggacaggauuugagacuucgagcccucuauaaguuggagaguucugugaccccuucucaaagcugaaucccuuuaaaguuuacaaucccaucgacaauccagggaguugacaaggaagcuuaucuauuucagccagggcucuugguugggaaaaauaguuacauugaauuuacggucauggccuucaccucacauacuuuaugguuugaauuuauauuacucauauagucuaaaagauccgaaacugaaauauuaacuucacaaguaauucugaguuggugauucccuggagaccugguagaagcaaauguagaaucacucuggagauauaugaccuuaaccaaggcuacccagaaauuucacagauuguagcuacaccugagaaaauaaccuuaggaaaagcuaggaacagaaaguauuaguagucaaccugaggaaaguuagcauacaaaauaaauggcaugauuagauucucaagaacuucugauaauagaaguauuugauaaagacuauaaguaugucuaaaaugauauuuuuaaaauuccuaaucauaacuuuaugccagaaaauuuaaaacuuaaaauacacaauauuuaagaaaaauauacucagcaaugagcauucguugcaguuauuucauauuagccaaaaacaagaaacaaucuagaugucuaugaggagaacuaauaaaugauaguguauucaugcaguggaauacuacaugguaguuagaaugauugaacgggagcuccaugucaagcaugaguaaaucucgcuuugagugaaaaaguaauuuguaggauuuuacaaacaguauagccauuuguacaguuuagugauacacaugcaguaaaaaacauaaaacacugcaaaaaaugguaaauauauaauuuagggguuuaguuaccuauuggaaaggaaggaaggaaagagaaugggaucauguaggaucauauauuaggcuucagcuucauccgaaguuuuaacaguguuaaaauuugaugaagauggaauguggaagcacauuuguuucuuauaucuuacauacuuuucugagcauuuaaauuuuuguaacaaaaauauauuuuaaaauacuuugcauuaaaaagcaauugagaaaguguauaaacaugcuaaaccugcauauuucuuauuuugaaucaaacuauguuuaaaucuuuuaauaaauuauuuuaugcuacuuucuccuuccaccuuucauagucaaaguuuguggggaaaauauauaagaacgaaaucauuuaauaugauaugcugauucuggggucaauucuuguuggcgguuuccagauccuaguagcacagugaaauguuuucuacccccaaggucuuuucucucgugguaacugagccuuuccaucucuguugauuccugucucauggaguauguuugggggcauuuuacucucuuagggccuggugggaaggggaugguuucucuucucuuugggucucugucuuucugagcuccacuccuaccccgaggguuugucucuuacacuugcacucucucagagucaaucucuugcuuguucucuuauuuggcaucuccuuccuuucucuuuuucuaucuagagcucacucuucugggauagucucuguccuucugugcuguaugugcgugugccugccuuucucuuuuuucccuccccucucccaaguccccaucaguuucuuucuuacucuccccauggguaggucuuuuucugucucucuugcucucuuuccauuucuuuucuaauuuaccuacuuauguuccauuugucuuauuuagguaaagcuacuucuucuucuaauccaagcagcccagcuccagacugguacaaagauuuuguuacagaugcugaugcugagguuuuagagcauucugggaaaaugguacuucucuuugaaauucuucgaauggcagaggaaauuggggauaaaguguaagugcuuuaccauauuuauuauauaaauuaaccuuuugauuauguuuuuauugcuuaaacaauguauuugaacaaaucuguugcuuuuccuuccuuccuaaagaugugauuuauuuggucauuguagugcuaggccaauacaagcaacuaucuuuuuuguaagccacuaguucugauugcauauucagguuauuucuucaguguaaauuucugcuucuaccuguugcaacuugaacuuauuuccuuggguagagcucuuaguugaaauuuguguuucuccaucuucaaaaucauuuuucgguuuauguagugugacuucuaccguguugcuuuacugagauuucccccuguaaagucacuagugaccuucuaauccucaaaucuaguggacaucucucaggcuuuauuuuauuuuaccugcuugauuauucuuucuucuucuucuucuuuuuuuuuuuuuuuucauuaugagacagggucuugcucuguugcccaggcuggagugcaguggcacaaucacagcuuacugcagucuugaccucccaggcucaggugauccucccaccucagccucuccaguagcugggacuacaggcgcacaccaccaugcccagcuaguguuuuuauuuuuagcagagauaggguuucaccguguugcccaggcugaucucgaacucuugagcucaagcaauuugugcgccucagccucccaaagugcugggauuacaggugugagccaccacaccuggccugauuauucuuucuuuaucauuuauucuuuguuuuuuguuccacuucuaacauuuuugccaccauuccuuucuuugcaucuucaccccccuucaaauuacuuuuccaaaaacauuauuuuuuuuuuuuugagacggaguuuugcuguuguugcccaggcgggagugcaauggugcgaucucggcucaucgcaaccuccgccucccagguucaagugauucuccugccugagccuccugaguagcugggauuccaggcacgcaccaccacgcccagcuaauuuuguauuuuuaguagagaugggguuucuccauguuggucaggcuggucucgaacuccugaccucagguaaucugccugccucagccucccaaagugcugggauuacaggcgugagacaccacgcccggccuccaaaaacauauuuuuaaaguuuugaacaagacuuacugucuaggcugcuaggucccaacaucugauuauaaacgauuuuuaaaaguaucugagaugcuuuuuuuuuuuuuuuuuugagacggaguuuugcucuugucacccaggcuggagugcaguggcgcaaucucagcucacuaaaaucaccuccacuuccuggguucaagugauucuccagccuugccuccugaguagcugggauuacaggcacacaccaccacgcccagcuaauuuuguuuuuuuaauagagacgggguuucaccacguuggccuagcuggucuugaacuccugaccucaggugauccacccgccucagccucccaaaaugcugggauuacaggugugagccaccgcgccuagcuugagaugcuuuuaauaaaaauuuuaaauaaggcuaaaauaaaauaaucuuuuauguuuaaaaaaaucucaaaauauggucugaaacaaaagaguucuucauguugucugcaacuggaaaagguuaauagagagaaccauuaguauagacauuuaauccuaacaacuuuuuuccuuuucuacuguaagacuucucugaguucagugguucccagaaccagccuuaauugcuaacugacuaaaaucaaccucuuuccaguauaguaacccagauugcagauuaauuccaauuuaauaauuaguauuucuaagacuuuaauuuuuucacuuacgggaacuuucaagaacuuaauuuguagcacagaaagaauugauucaauuauguuuuugauuuugggaaagauaaacuacugaggggucaaagcauaggccuuggucauuugagcugagcaccaggagucaauucauuuucuuaccaacauucuagaaguaguuaacugggagauaguagacuccaacaguguggagcucaggaagucauacaauaaaaaacacuuaagugguuaacuccaacagccguuucauagcuucaauuguuuucaguucuacuaaaucugaagauauguagcagggaauguugaaggaucuucaggagucauaaguaccuucuucuccuauaguauagcuuuuagaauaaaaauaaaacuuaaagcauacuugccacagguauauuguuucuuauauacugaucuacuuuguuugcauauauaaagggcaauagaagaccucuuauauucucuuucuagauuuuauuucuuuucuaguguguaaguauguuauaaauucuguccaguggguuagaccagaauagucauuuuagaacuauuucucagagccccugcaaauuggugaccgaaaggagaggguaagggaacaguaacauuuuuccuccuucucccguaaugccuaaaacagcuugcuuuuauaauuuauuuuauuugaacucuacacaaaacuugaugugaccaaauaguuuucauggcuaaaaaggaguuagaaaauuacuagggcagagaaugaggaauuugcagacauacuugaaauguaaugacaaaguguuauagaaugcauguaauuuuaaauuacugaaauacuuguaauagggaaacuuuuuacauucucuaaaacagugucuuuuauagagcagaaguuuuaaauuuugaugaagucuaauuuaucaacuuuuaaaacaaugauacuuugugucauguguaaauaauuuuuuaccuaacccauguuaugaagauuuucuucuguguucuucuaaacauucuguucuuacaguuuuuacaguuagauuuaugcuccauuuuaaguuauuuuuugcauaagguaugcaguuuagguugaaguucacuuuuuuucauguggauguucaguuuugcuaagaccauuguuuuugucauguggauguucaguuucgcuaagaccauuguguagguuuuuuuuuuuuuuuuuuugagacagagucucgcucugucacccaagcuggagugcaguggugcgaucuccacucacugcaagcuccgccuccuggguucacgccauucuccuaccucagccucccgaguagcugggacuacgggcgcccaccacagugcccagcuuauuuuuuuuguauuuuuaguagagacggaauuucaccguguuagccaggauggucucgaucuccugaccucgugauccacccgucucggucucccaaaaugcugggauuacaggcgugagccacugcgcccggcuaccaagaccauugguuaaaagacuauccuuuuaccauugaaaugccugggcccuacaauuaauuauccuauguggcucucuaucuggacucuauucuguucuauugaucugugccugucccuuuacuacacugucuugguuacuguaacuuuguaaguaaugaaaucaugaagagucagcccuccaacuuuguuuuucuuuuucagaauugucuucccuccucugagguggcauucucauauacauuuuacaaucaccuuguaauuucuacaaaaaaauccugcugggauuuuuguuacaauuguguuaaauuuguagaucgauuuaggaagaagugauaucuuuacuaggaaucuucuaauccauaaacacuaaucuguuuuuuuagccuuguuuucagccagucccucauaucucuggacuugauugaagauuuucuugaauuagcuaguagggagaagacagaagauaaagauaaaccccuuauuuauaaaggugagcuacaaauauuucugugucguaauuuuaaaaauacugauuuaaacauaccauacaaacauuuuagcaacaaaagaaacaaaacuacccagucucacaacucuaucauaucaaaauuuuuuugcaaugucuauuuguccuuauccauauauauguauagucuuuuucaaaauaaaauuguauuguuuauauuugagguuuacaacaugguguuaugggauacauauagauaguaaaauggcuacuguagugaagcagaugaacauaucuaucaucucacauaguuuuuuuuggugacaagagcagcuaauaucaacuuaagaaaaauuccuaauacagcagucuuuguuguugaaauuguuggauaaauuaaaacuuuuugguuucuaaagcaguuuuauugagagauaauucacauccuguacaauucacccauuuaaaguguagaacucaaugguuuuaauauauucacagagauguacaaacaucacuagagucaguuuuugaacauuuuaaucacuaccaaauaaaacucuguacccuuuaacuauuacuccccuauccagcccaaaacucccucacauaagcaaccacuaaucuccuuuauguuucuaauagauucauauauucuggaccagucacauaaauggaaacauguaauauguggucuugauagauauuaggguuguucucaccuuucagcuguugugaauagugcuguuguguacauuuguuacacagguuuucauuuauuuaaacaaacggcaauaccaaacuguuuucuacacugccuguacuauuucaguccuaccagcaauguacaagcauuucaguuucuccacauucuugucaacacuuguuauuuuucauuuuuguuuuuguuauaaccauccuaaugguugugaagugguaucuuaugauuuuaauuuucauuucucuaaugacuaauaauguugaacaucuuuuaauguacuuguugacuauuucuuuaucuucuuuggaaaaaauguuuauucagguccuuugcccauuuuugaauuggauugcuuaucuuuuuguuguugaaauguguuuuaaaaaauauauucuacauacuaggccccuaucauauauaugauuugcaaauauuuucucucauucuguggguuaucuuuugcuuucauuaaaaaaaaaauaguuccggugaucuguaucacuuucuuuuauuuauuuauuuuuaauuuuucguagagaugaggucucccucuauuugcccagacuggucuugaacuccugggcugaagcaguccucccucguuggccucccaaagugcugggauuaaggugugagccaccauaccuggccaucuguugcuuucuugaguguguccucugaugcgcaaaaauauuuuauuuuguugacauccaauuuauuuuuucuuuuguggcuugugcuuuuacugucauagcugagaaaccauuucgaaauaaaaagucgugaagcuuuaaccccuguguuugcuuaaaagaguuuuauaguuuuaguccuugcacuuaggucuuugauccauuuugaguuaauuuuuaugcaugauaugagguaaaggcucaacuucagucuuuugcugugguuauccauuugucccaggacuguuuguugaaaagaauauucuuucuuuauugaauaguuuuugucacucuuauuaaaaaggaauugaugauggagacacauguuuguuuccugacccucaauucuauuccauugaucuauaugucagucgcugugcuaauacugcacuauuucauuaccauugcuuugaaagugauguugaaauuggaaaguguggcuauuccagaucucuuggaauucaacaucaaccuuagaaucuccuauaaauuucuacaaagaagucagcuuagaugcuaauagggauuguguugaauguauaguuaauuuuaggaaguacugccaucuuaauauuaugucuuauccaugaacaugggguguuuugcuguuuauuuaggucucuuauuuauuucaccaauauuuuauaguuugcagaguauacauuuuacacuuuuguuaaauguauuuguacauauuuuauuucugaggcugagugaaauuuguucuuagugaauucuuuaggauuuuuuauauacaagaucaugucaucugcaaguacagauaauuuccuuucuaaucugaauggcuuuuauuuguuugcuuauccaguugcccugguuaagaccucaaguacaauauugagugaaaguggcaagagcuggcauccuugucuugucucuaaucauagugugaaggaauccaguuuuucaacauuuuguaugauguuaguuuuguggauacuauuuaucaaguugaggaaauuaucuucucuuucuaguuuguuaaauguguuugucaugaaagagugugacauacuaucuugauuucucugcagcuauugagaugaucaugucauguuuuuuuuuuccccauucuauuaacauaguguauuacuuugauuuucacauguuaaaccaaccuugcauaccugggauaaaucccacuugucaugguguauaauucuuuuuauauggugcuggauuuaguuugcuaguguuuuuuguuguuggcaauggaauguuuuaauuggcuuuuuuuguccugauuaugaaaguauuauuauaucuugcauauauaauauuggcuguauaauauucugucauauggcuguacauaacuuauuuaaucauuugauugcuuucucuaauuuuucaacuuuuuuuuuuuuuagagacagggucuugcucugucacccaagcugaagugcagucgagcaaucuuggcucacuacagccucugccuccuggguucaagcgauucuugugccucagccuccugaguagcugggauuacaggugugugccaccaugccuggcuaauuuuuguauuuuuuguagagaugggguuuugacauguuggcugggucuugaacuccuggccucaagugauccacccgccuuggccucuuaaagcacugggauuacaggcgugagcuaccacaccuggccuaauuuuucaacauuuuaaauuuuuguacauaaguuuauaucugcguuuuaaacuuuuuugcuuaagauagauuccuaagaggagaaaucauuuaccaacagguaugaucuuuuuuaggacuuuugaaacauugucaacuuauuuuccagaacaguuggauuaguacuccuaguaggaauccuugaaugaucacuacaccauugccauaauaacuaaaaccuuucuuaauagaugaauaaugauaucuuguauuuguuuuaauuugcauuuauuuuauaaccaguaacauagauugucucugcuaaucucuuuuugcuuuuacugcugacugauggcuauguuucugucugccugcaaugcucucuccacccgcacuaucuucuucaccugauuaauuccuauccauucuucaucuuucauguccagugacacuccucaguacugacuucccuccuccugacuccaaugucugauuuuuuccuuuuaauuuuugugggugcaugguagguguuauguauucauggguuacaugagauauuuugauacaugcaugcaauagauaauaauuacaucaggguaaaugggauaucuaucaccucaaacauuuauccuuugugauacaaaaaauccauuuauacucuuaguuauuuaaaaauauacaauuuuuaauuauuuuugacgguagucacccuguugugcuagcaauuacuaguuuuuauucauuccaacuauauauuuguaccugcuaaccaucaguacuuccaccccaaccacccacuacccuucccagccugugguaaccauccuucuacucuguaucuccaugaguucaauuauuuuuauuuuuagaucccacaaauaaaugacaacaugcaaaguuugucuuucucugccuagcuuauuucacuuaaugaccuccaguuccauccauguuguuguaaaugacaggaucuuucucuuuuauggcugaauacuauuccauuguauauaaguaucacauuuucauuauccauucaucuguugauggacacuuagguugucuccaagucuuggcuauugugaacagugcuacaauagacagugcagauaugucuucgauauaccgauuuccauuauuuuggguauauaccuaggagugggauugcuggauccuuuuuuuuuuuuuuuuuuuuuuuuuuuuuuuuuuuuuuuuuuuuugguggggggagacaaggucuugcucugucacccaggcuggagugcaguggugugaucuuggcucacugcaacuuccaccuccugaguucaagggauucucccaccuccgccuccccaguagcugggacuacaggcauacacuaccacgcccagcuaauuuuuguauuuuuuugguagagacaggguuucaccauguuggccaggcuggucucaaacucuugaccucagguuaucugccugccuuggccucccaaagugcugggauuauauaagugagccacugcgucuggcugggauugccggauucuaugguagcucuauuuuuaauuuuuugaggaaccucugaacuguucuccauagugguuuuacuaauuuguguucccaccagcaguguacaagaguucccuuuucuccaaauccucucuaguauuuguuacucccugacuuuggauaaaagccaaguuaacuggggugggaagauaucucauaguuugauuugcauuuuucugauaaugaaugauguugagcaccuuuuccuauaccuguuugccauugguaugucuucuuuugagaaaugauuauuauuuuguccauuuuaaaaucagauuauuaaauuuuuuuuccuguagaguuguuugaguucuuuauauauuccgguuauuaaucgcuugucagauggguaguuuucauauauuuucucccauccuguggguugucucuucacuuuguugacuguguccuuuguugcgcagaagcuuuuuaacuugaugaaaucacauuugucuguuuuugcuuuuguugccucugcuuguuggguauuacucaaaaaaucuuugccuaguccaauguccuggagaguuuccccaauguuuucuuguaguagauuugcaguuugaggucuaagauuuaaaucuuuaauccauuuugacuugauuuuuauauauggcgagagauaggggucuaguuuuuuucuccugaauauguauauccaguuuuccccagcaccauuugcugaagagacugucuuuuccccaggguauauucauggcaacuuugucaaaaaugaguucacugcagauuuauacauuuaucucaggguucucuauuguguugaucuauguguuuuuaugccaguaccauaguguuuugguuacuauaguucuguaguauaaagucagguaaugugauucuuacacuuuuguucuuuuggcuuaguauagcuuuggcuauuuugggucuuuugugguuccauauaaauuuuuaggguuguuuuuuguauuucugugaagaaugucacugguauucuauacagauuguaaugaaucuguagauugcuuuggguaguauggacauuuuaauaauaucgauuauuccaaucccugaaccuggaauaucauucuaugauuuugugucuucaguuucuuucagcaucuuuuuauaguuuucauuguagagaucuuucacuucuuugguuaauuccuaaguauuuuauuuauagcuauuguacaugggauuacuuucuugaugucuuaaaaaauuuucuuuuaauuuguaaguuucuuuauuucucuuucagguuguuugcuguugguauauagaaaugcuacugauuuguguauguuggguuuauauccugccacuucacagaauuucuuuaucauuucuaauaguuuucugguggaguuuucagauuuuuccaaguuaagaucagaucaucugcaaacaaggauaauuugauuuuuuucuuuccaauuuugaugccccuuauuucuuguucuugucuaauuacucuagcuaggacuuccacuacuauguugaauaagugauagaagugggcauccuugucauguucuugaucuuagaggaaagccuuuuaguuuuucuuucuuuaguaugauacuagcuaugggucugucauagauggcuuuuauuauuuuugagguauguuccuuauguacuuaguuuuuuuaguguuuuuucauaaagggauguugaauuuugucaaaugcuuucuuaccaugaauugaaaugaucauaugguuuuguuuuuuguuuuuuuuuugagacggucucacucuguugcccagacuggaaugcaauggcgugaucuuggcucaccgcagucucugccuugcagguucaagugauucuccugcuucagccuccugaguagcugggauuacaggcgugugccaccgcgccuaacuaauuuuugcauuuuuaguagagacgagguuucaccauguuggccagacaggucuugaacuccugaccucgagcgguccaccugccucggccuuccagagagcugggauuacagacgugagccaccacaccccggcgaucauauggguuuugucuuucaugcuguugauaugauguaucacaucaauuuguauauguugaacuauucuugcaucccuggagauaagccccaguuggucaugauggaugaucauuuuauuauugaauuccguuugcuacuguuuuguugaggauuuuuacauuaguauucaccagugauauuggcuuauaguuuaauuuuuuuauguguguuuaucugguuuuguuaucaggguaauacuggccuuguaaaaugaguuuggaaguauucuguucucuacuuuucagaauauuuugaguaggauuugucuuauuucuuauuuaaauguuugauagaauucagcagugaagcuauuggguccugggauuuuccuugcugggugacuuuuuauuauggcuucaaucucauuacuuuuuauuggucuguucagauuuuggacuucuucacgguucaaucuugguagguugugugugucuagaaauuuauccauuucuucuaaaguuuuccaauuuaucggcauauaguugcugauaauagcaacuaaugauucuuugaauuucugcuguaacaguuguaauaucuuuauuuucaucucugauuuuauuuuuuugggucuucucucuuuuuugcuuagucugucucaaaguuugucaguuuuguuuauuuucuucaaaaaaccuguuuuuuguuucauugaucuuuuguauuguuuucuuuauuucaaguuuauuuauuucugcucugaucuuuauuucucuucuacuaauucugggcuugguuuguucuugcuuuucuaauucuucucuucucuucuuuuuuguuuuuuuuuucuuuuuuuuugagacaaggucucguuuuguugccuaggcuggaauacaguggcgcaaucucggcucacugcaaccucugccucucagguucaaaugauucuuccgccucagccuccugaguagcugagauuacaggcgcccgccaccaugcccagcuaauuuuuguauuuuuaguagagacaggguuucacuguguuggccaggcuggucucaaacuccugaccucaggugauccacccgccucagccucccaaagugcugucauuacaggcaugagccaccgcgaccagccucugauucuuuaagaugccuuguuacauuauuugcaguuuuucugcuuuuuugauauaggcauuuauagcuauaagcuuuccucuuaguacugcuuucccugugucuuauguuuuuugguauguuguguuuccauuaucauuuuuuaaagaaaauuuuugauuuccuucuuaauuccuucauuggcccacuggucauucaggaauguguuguuuaaauucuauguauuuguauaguuuccaaaauaccuuguuauuaauuucuccuuuuauuccacuguggugagagaagauacuugauauuauuucagguuguuuuugauguuuuaagacuuguuuugugaccuaacauauggaugauccacaugcugaggaaaaaaauguguauucuguagcuguuggaugaaauauucuguaaauauguauuagguccauuuggucuauaguguagauaaagugugauguuucuuaguugauuuucuguguguaguguugaagucuccagcuauuauuuuauuggggucuaucucucucuuuggcuguaacaguauuugcuuuguauaugugggugcucccaggguugagugcauauauauuuuaaauuguuauauccucuuguagaauugaacuguaucauuauauaguguccuucuuugucucuucuuacaguuuuuaucuugaaaucuauuuuguccuauauaaguauagcuguuccugcucuuuuugguuuccauuggcauggaauauccuuuuuuaucccuuuauuuucagccuauguguauuuuuacaggugaaguguguucuuguaggcaacagaucauuggguauuuuuuaaaauccauugagccccucugucuuuugauuggagaguuuaguccauuuacauugaauguuauuauugauuaguagggaccuacuccugccauuuuguuauuuguuuucuaguuguuuuuugggcucgucuucuuuccuuccuucuuaucuuccuuuuaaugaaggugauuuucucuagugguaugguuuaguuucuuccuuuuuguuuguuuguuuauccauuauauguuuuuugguuuguggcucccaugaggcuuggaaauucuaucuuaaaacccauuauuguaagcugauaacaacuuuacacuguuuuuauaaacaaagaaagaaacaggcaaaaagaaaacuaauaaaaauucuacaccuuaacuuuguccacuuuuuagcuuuuuguuguuucuguuuauaucuuauuguacuaugucuugauauguuguuguaguuauuuuuguugcuucaacauuuagucuuucuacuuauaauaagaguaauuuauacaccacaguuacgcuguuauaauauucuguauuuuucuauguacuuacuguuuuuagugaguuuuguaccuuuagaggauuucuuacugcucauucauguccuuuucuuucugauuaauuacuuccuuuagccuuucuuguaggacagguuugguguggauaaaaucccucagcuuuuguuugucuggaaaguuuuuauuuuucuuuuauguuuagagguuauuuuuuccauuuauauaauucuagggugaaaguuuuuuccuugagcacuuuaaauauuucaugcuacucuucuccuggccugaaagauuuccacugaaaagucugcugccagacauauuggagauccauuguauguuacuuguuucuuuucucuugcugcuuuuaggauccuuucuuuauccuugacauuugggaguuauuaagugccuugaaguagucuuuuuuggguuagaucugcuugauauucuauaaccuucuacuugaauauuaguaucuuucuuuagauuuggguuucucuguuauuaucccuuugaauaaacuuucuacgccagucuuucucucuaccuccuguuuaagaccgauaucucuuagauuugcuuuuuuuguagcuauuuucuaugccuuguaggccugcuuuauucuuuuuuauucuuuucucuuuugucuccugugacuguguauuuucaaguagcuuaucuucaggcucacuaauucuuucuuuugcuuuaucaauuuugcuauuaagagacucuuaugcauucuuuaguaugucaguugcauuuuuugacuccagaaugucugcuuuguucauuuuaauuauuccagccucuucauuaaauuuaucugauuggagucugaauuccuccuguguuaucuugaauuucauuguuuccucaaaucagcuauuuuguguucucucucugaaaggucacauaucucugucuuucccggauuuucccgauucccuguuuaguucauuugaugaggucauauuucucuaaauggucuugaugcuuauggauuuucguuggugucuuggcauugaagaguuagguauuuauuguagucuuugcagucugggcuuguuuguaccugucauuuuugggaaggcuuuccagguauuugaagggacuuggguguugugaucuaacuuuuuagucacugaagcuguguccacauuaggggucacccuaaggccaguaacgcuguaguucuugcagccuuguagagguaccauuuugguggucuuguauaagauccaaaagaauugucugcauuaccagauggagaaucuuguucucuuccuuuacuuucucccaaacaaauggagucucucugugcugaguugccuggagcuggggguggggggugggugacacaagcaccccugugacuaccacugcggguauagcacuuggucagaucuuaagccagcagagcaaugggucuugcccaaggcccacuguaaccacuaccugguuacugccuauguuugcucaaggcccaagggcuguacauucagcaaguggugaagccugccaguacugggucuuucccuucauguuggcaaauucucuuagucccugggcggguauagagaugcuuucuggagccagggccuggagccagaaauguuagaaauauaccuagugcuuuauucuacuauggcuaaacuggcacagaaauaacaaaacaaaguccuuccuacucuucucuuucuuuuccucaggcagaggagccucucuucguggccaccaccaggacaggcccgcagagaguacugccaguguaccgccaguguucacuuaaggccuaagggcuauuuagucagcuuuuggugaaugcugccaggccagagacucacccuucagggcagugggcuccacucugccccaggcucaguccacaaauuccauucaagagcuaaggccuggaauuggggacccaagagcccguuuguugcuuuuguccgcuguggccaaccugguagcuacacugcuagauaaaguccccuuuacucuucccucuccuuuucucaaacaggaagagccucucuuuguagccaccacaacuucuaauaagcugggucucaccauaaccuaacacauuucugucuaauccaugccccacaauguguacuaccugguuauugcugcugaugauucagggcccaagggcucuuuggucagcaggugaugaauccugccaugacugggucccucgauucaaggcaauggguugccuucuggcccagggagcuagggccuggaaugggggcuucacgauucugcccagggcccuguccuacugugacugagcugguauccaaguugcaaaacaaagugcuuuuucucuucccuuuucucuccucaaguagaaagcagaggucucuuuuggagcucuaagcugcgcuaccuggaauuggaggagugaggagugguggcauaagcacucucuuagccgccccagugguaucugacuaagucaagugcccccauuuuacuggcuccaagcccuuuacagcacuaggacuugcccagaaguugcaguccuuguggccuagauagccuuucaguuuuauuuagggccccagugcacuuuagcccacuguggcgugacuuacuaaaacucaacuucugaucacugugauggaugauuccccucugguuugggcagguuuauaugcucccuucauguguguaggcugaguuccaauucaaaguccuaugaucacugcacucuccuucccgcaagugcacugauucucucccuaugacacguggccacuucuggggguugagguagcaguggcauuggcgauucaagauugucuuuccccuucugugccucuuucagugauaugaaguuaagaucagguacuauaauugcucaccugauuuuuguuucuuaugauggugcuuuuuuguguagauagucauaacauuugcuguuuaugcugggagguugaucaguagcagcuucuauucagccaucuuauuccaccuccuuccccaguacugcccugauugaaugaguugguauuuguuccuguuucuguuuuuuggaauuguuuguaaagcauugagcuuaauuauuuaaauguuuguuagaauucagcauugaagccaucuuggccugggcucuucuuauagguaguuuuuuuucuuuuuaguauuaugguaaauauauauauaacauaaaauuuacuauuuugacaguaaaaaggcaaccuaccauaugggaaaaauauuugcaaaucauacaucugauaagggguuaauaucaaaaauacauaaaggauuccuacaacacaacaacaaaaauaauaugauuuaaauaugggcaaaagaguugauagacauuucucuaaaaaugauauacaaauggccaagaagcacaugaaaagaugucuagcaucacuaauccuuagggaaaugcaaaugaaaacuguaaugagauaccaccacacacccauuaggaugggcuacuaugaaaaaacaauaaugagaguuggugaggauauggagacauuggaacucuuguguacuguugguuagaauguaaaaugguauagcugcuguggaaaacagugugguguuccucaaaaaauuaaaaauaguauuaccaugagauccagaaguacuacuucuggguauauacccacaagaauugaguucagggugucagagaaguauuuguauuuguacgcccacauuauagcagcauuauucaugaccaaaucauggaagcaagucaaauguccaucaacagauaacuggauaaacaaaaugugguauauacauacaguggaacauaauuuagccuuaauaaggaaggaaacuuugacacaugguggaacauguaugaaucuugaagacaauaugccaagugaucuaagccagucuaaaaaggacaaauauuacaugauuccuauuaugagguuccuagaguagugaaauuuguagagacauaaaauagaaugguguuugccagggccuguggguaaggggaaauggggagugugagagaacagauaacuccacggggcuucccagagugcuccauguuguauggggauuaugucugucucauaaauauauguaucauuggagacagguucauuacuacccauuuuuguauacucuuugucuagcaccaagcuagacauguaguagguccauaguaaauacuuguugaacugguaagggaauaaauuacccuuaucuguaacuucccuaguuuuuuuauacagagaaugaugcucuaguuaggcauuuuccuagguauauacuugcacuuuuuaucuuucucauuuccccgcuuucuuuguuucuagagugaguuuuuggcauaucuuuaacauauauauguguaguauauauguguauuuuuacauuugacuguaguuaaauauaagcuuaaauauauuuuuuuucuauuaucacuauacauuuuauuagauucuauguucuggcaguuuuucauuauugaaaagccuauguuacaaaaacauaccaauuuacuaccaucaauaaauggaaaaugcuuaucuuaauauguauuguaacuacauuuucuucaucuuuaauggguaaaaacaguugucauuguuuucauuaauaauuuuuugaccacuaguaggguuguacuucuuuuauaugcuugcuaguuuauuucugauuuuguaaauuaucuuuagcaaauguuuacuaaucagauuggucugccuuugaguuacugcuauuaccacuaccacuaccauuaccauuaccacuguguauugagcacugagcaagauuuaagggguacuacaggaaaucaugguguagaagaggaacagacacauauauuaugugccauaauagaggcagguguaauuugucaugggaucuugagugauaauauuaagaacucaguaagcuuuuaauuaccaugugacaggcaccauucuaaguaguuuuuaaaauauuaucucauugaauccucauaacaacccuaugcaauagguacucugauuaucuucauuuuacagauaaagaaacugaggcacaaggaguuuaauuacuugccauaagugaaaauguuaguaaauggugaaacugagauuaaacucagggagugucacuccaaagucuguguucuuaacuacuaaccuauaaugacucuaucaguuuuuaaguguuggauucaucgaggugguauuagagauauucauuugcauuauaauaaaaggugaguauguugaaaugcuuuuuaaaauagucauaucauuuuccauucauuuaugauuauuuauuuuaauaauuauccuguucaagugaacaauuaaugcaaaugugacuccagccucuuaccuuuuuaugcaaguauccaucucaaauucuuuuuuucuuggauguguaugccuuuuuuucuaauugaaaaaaaaaucauaaauaaaaugacuuucuuaagcauuaaugaauuuuuaacaaggaaauucuggguuuucuauaucagugaagauauagguaagaaacauggaaaagcaucuuuuuuuuaacuaauguacuaaauuuaaagagcuugcuggaaagacauaaguaaaucucaguuuuguuaacuguuuuauuuuaaggcucuggggcaugauagaauuuugcuuggauuggaaauaguagcauuguguuuacaguuaaauaauuagaauagaaauuauguaugauaaaauauaaaagugucauaagcccuuaaucucuugguauuuuaguaucaaugcaagucuuggguaaaauuucaccucacuucuuccugguguagauuaaaggaaaaaaaaaacuuaaacucacugucuaaaauugacaugucauaucauuaacucauaaagucguacuccuuuacacacacacacacacauacacacacaccacauuugaaauggaaacguacacugaaauuugcagcuaccccauagaauaauuuuuggcacauaguaggcauucaguaaagauuuguucagugaaugaauaaaggcauucuuuaucucucauuuuuauuugaucauuaucaaguuguugauaaggagaaaaacguggccauuuacagauauaacuuaaaacaugccucaugagcgaaauguaaguuuaaucauauucuuuugacaguuuuaaggauucuaaucaaggaaacccuuuuaagaaauucucauguagaugaaauaggcuuuaaaaauaccugugcucaucacuaucuauuugaaugaaaucugugguuaauuuauuuauaauguaaugacuccuugauuaagaaaaguauauaauguauuuugcuauacaaauagaauauauauaacccacuuuuaaaugaugagcaagguggaaaaucuguucuuaccaguaagcagagcgauauaucaaauuccuuuuguguucuuuuguuaaauuuucaggugaggggaaguggcuucgaaacauugacuauuaccguuuagaugguuccacuacugcacagucaaggaagaagugggcugaagaauuuaaugaugaaacuaaugugagguaggaaaaauuuucuguauauguagaaacauuaaaauaauuaauuuuaaaauuuacauaaaguucacuauuuuuauuguguauuugaauguuuuuagcaaaugcaagguacagucagguugcaaaacagugucaucacucccuaaccacugaauucacuuauggaaucauauaauuuguagccuuuugagucucacuucuuucacuuagugagauuuauuugagaaucauuuacauuguugcauauaccaauaauuuuuaaaaauuguuguauagucuuccauuauagggcuauaucacaguuuguucagcuacuuccacuugagggacauuugaguuguuuccagguuuuggaauuaaaaucaaagcugcucuaagcuuucauguucaaguuuuugugugaacauaaguauuuacuuaaaugaaacaaaagccuaggauugugauugcugggucauauaguaaguguacauuuaucuuuguaagaaacuaucaagcaguuuuccaaagugacuguacaauuuuucauucccacccgcaguuguaugagaguuccaguuuccuuacauucuugucuguacaugguauugucauuuuuuaaaaaaauuauuuuacucauucuaauguauguguaguggcaucucuugugauuuuaauuugcuauucccuaaugauaaauuauguugagcaucuuuucaugugcuuauugaccauuuuaauaucauuaacuguagauacaaggcaauuuguguguguauugauauuguuuuaagcuguuaguaauugacaaaaucaagcuacauuuggaaagaaaaaguuuuauauauagucauauguugcuuaacaaccaguauacauucugagaaaugcaucauuaggcaauuuugucacuaugcaaauaucauagaguguacuguacaucaguaggcuuucugugauauagcuuauugcuccuaggcugcaaaacuguacagcauguuacuguacugaauacuguaggcaauuggaacacaaugguauuuguguauguaacauaucuaaacagaaaagauacaguaaaaauauguauuauacucuuaugagauugccuuuguacaugcugucuguuauugaccaacacauuauguggcacaugacuauacauacaucuaaacauaugcacauacgcauacguauacacauacacaaacauaagaaagcauggcauuuaagaaaaggauaaaggagaugggguuaguuuaguagaaagauggcugaaguaugccuuaauaaauauuuuaaacuauggagaauauuauacuguguguuuaaaacauguuuuaauuuuagcagcaucaugaacuagaccuaggcuuaaggcuagagaaauuucaguuacauuuuaggaagauuauuaauuauugaaaacccguagccuaagagagcuuacaaagggaugauuugaguauaguuaaauuauaaauguauaugauugauuauauaauuguuuaaagaauaaauacauuuuuauauucuguguuuuucauguuuaaacaaauuauuauuuguacaugagugugaagaaguaauuuuauugaguaacucaaauuucucaaacauaaucuaaaccuuuggcuugcuagguuucccaaauuuuaaaauacgacagaggcauauaaucugucacgugacauuuauacuugaugacuaguagggaaaaacauugaaauguagauguugagcugucagcuuggcuuacucacuagugaauuaccccuaaacauaugccaaaaagcaugucauucaaauucaugcuucaggcauauacugguugaguauuucuuauccaaaaugcuugggggugcuagggacccgaagaauuucagauaugggauuuuuuucagauuuuugaauauuuguauuauauucuuaccuguugagcauaccaaaucugaaaaucuaaauccaaaaugccccaaugagcauuuucuucgaguguuacguuggcacucaaaaaguuuuggaguuuggugaauuuaggauuucagacuuacagauuugggcuguucaaccuguacauguauauuauggauuuggggaguugcucuugaguagcugaacccauacacaugaaauccacagauguuaugcugucucucaaaaugcacaaacaaacagaaaaugaaacaaaaaacaaaaugaaaagagcaaggaaaaaauccacaaauguuuuagauuauaucucuguaaauucuaauuuuucaugacucaguaauuuucaguaaauaggauauaaauauaauccuuguuuaugccaaagcaaucugaaagacacauuaaaauaaacuuuaagauaaugaccauuuguaacguuguuguuuugugugaccuggaaguaguuuucagcagucucagagugccucguuagcuugauacuauuuuugguuuguuucucuuuuaauuuagaaaugauuauagauucaccugaacuugcaaguacagagagguccugugaacccuuuaccuaauuuuccccaaugguuaaaucuuauauuucaauaucaaaacuaagaaguugacaguguuucaauguuugcauauaucuuuuuuuccacauauacacaaucaagauacagaaauauuccaucaccacaaagcucgcucucucucacuacccuuuuauagucacacccauuuuuacugccaaccuugucacuaaccuuaaccccugacaaugacuaauuuaugcuccaucucuauuauuuuaucauauuaagacugucauauaaaugguaucauucucuauaugugaccucuugagauuggcuuuuuucagucagcauaaugcccuugaguuccauccaaguugucacauguaucaauaguuuguuccuuuuuauuacagaguaguauucuaugggauggauguaccacagauguuuaaucauucacuuauugcaggacauuuucauuuuguccagguuuggcuauuauaacuaaagcugcugugaacacuguguuccagcuuuuuguguggaccuaaguuuucauuucucuaggauaaaugcccagguaugcuguggcuaggucauaugguaaguacuuuuuuaggaaacugccaaacucuuaauuagaauggcuguaccauuuuauaguccuaccaagcagugugugagaaaucaaguuucucuacauccucaccagcauuugcuauuaucacuguuuuuuauuuuaggaguucugauagguauguagugguaucuuauuguggucuuaauuugcaguucccugacaaccaguuauauugaacaucuuauguguuuauuugccaucaaauauuguauauccucuugggugaaaaucucuuuaugucuuuuuguccauuuucuuauuggauugcuuguuuuuuuauuguaggguuuugagaguucuuuauauaaucuagauauguguccuuugucagauauaugguuugcaaauacuuccugccaguuuauggcuugucuuuucauccccuucacagggucuuucagagaacaaagauuuuaauuuugaugaaaucuaguuugucaauguuuguuucuuuguuuugaucaugguucugaugucaagucuaagaacucuuccucaaagcccuaggucuugaagacuuuguccuguguuguauuuuacaaguuuuauaauuuuaccuuuuauguuuaaguccauguuguauugaguuaauuuuuguauaaggugugaaguuuaaagguucauauuuuuggcuguggauguucaauugcugcagcaucauuuguugaaaaaaacuaucuguggcagugcacaguggcucauacuuguaauccuagugguuugggaggcugagcccaggaauucaagaccagccugagcaucacagcgagacccugucucuaaaaaaaaaaaaauacccaggcauggugaugcacaccaguacucccagcuacucuggaggcugaugugggaggaucacuugagaucaggaggucgaggcugcagugagccaugauuguaccacuucacuccagccuggguaacagaggaagacacugucucaaaaaaaaaaaagaacgaagaaaaaaccauacuuccuuuacugaauugguuuugcaccuuugugaaaaaucaguuggcuauacuuguuuugggcuguuuuucaguuugcuauucuauuccuuuauuccauaugucuuucucugcaucauuacuacauagucuugauuacuguagcuguguacuaagccuuaauaucacauugaaugauucuucccacuuuguucuaccuuucacagauuguuuuagcuauuuuuauaugaauuuuagaauaaucuugucuagaccuacaaaaguuuugcaauaauuuuaauagguauuguauuaaaccuauuacuaauuuguagagaauugauaucauuuuucaacuguaauacuuuuagcagcagagaauugauaacuuuauuguuuucugaucagugaacacaguguaugucuccauuaguugaucuuugauuucuuccaucaguguuuuguaguuuucaguauacagguccuguagaucuuuuguuagauuuacacccagguauuucucuuuuugaguuauuguaaauguuacuguauuuuuaauuuuuguuuccauguguucauugcucaaauauagaaaugcaauugauuuuuguguugaucuuuugucuguaaucuugcugacuucauuuguucuaggaguuuguuuuauagauuucuggggauuuucuaaguagaucauuguacuauccacaaggagggauaguuuuauuucuucuuuuaugaucuguaugcuguuuguuuccuuuucuugucuugcugcaagaaaagucuccaacuauaauugugaauuugucuguuucuccuuuaaguuaugucagguuuugcuuccgauauuuucagcucuguuuauuaugcauguuuaguauugcuaugucccucccuauaccucauacuaguuaaaacuuaagaguaauauaguuaguagcaauggugagaguggacauccuuaccuucuuccugaucuuaggagaaaagcauucugucuucauuaacuaugauguuagcuguaagguuguuuuuuuggguggggggguuguuuuuguuuguuuuuguuuugagacaagguuucugucuaucaccaugacuggaguucuguggugugaucauaccucacugcagccucgaacuccuaggcucaagggauccuccugccucagccucuuugaguaggaaugcacagccauguuguacuuuuuuuguaauuacucuucaucaaguugaggugguuccccucuauucuuaauuuucugaguuuuuaugacgaauagguguuuacauuugacaaaugcuuuuucugccucaguuuguaucaucuguuauuucuucuuaaucuguuaauauggugugcuauguagauugguuuuugaauacugaaccaacuuuucaugccuggaauaaaacuccacuugaucguaaggauaauucuuuugauauaguacuugguucuguuugcuaauacuuuguugagagauauuuaugagaguuacucuuauauauucaguuguuuucguguugucauugucugguuuugguaucagguuaauaucgaccucauaaaauaagucaauaauuguuuucuauuuucugacaaaaauuauggggauuuguguuaaucuuaaauguuugguaaaauuugccagugaaaccaguucuggccuugaagauuucuuuuuuugggaguuuaaaaaucacuaauuaaauuuccucaguaguuuuaggauuauucaaaugaucuauuuuauauugaauguguuguuguaguuugugcuuuuguaagaauugguucauuucaucguaauuucaaauauauguguagaauuguucauagcauuuucuuaauauccuuuucaugucuuuagggucuauagugauagcuucuguuucacuucugauacugguaauuuguguguuuucuuuuuacuagucuugcuagagguuugucaguuucauuaauuguuacaaauaacuaguguuuuauucccuugauuuucuuuuucuuuuuuuuuuuuuccuauuuuaauuucaucuugcuuuugguuuguuuugcucuuguucuacuuucuggagguagaagcuuagauuacuaauuugauuugagacuuuuuuucuuuucucauguaagcauuuaguguuauaaauuucgcuuucagcacugcuuuaguuauacaaacuuugauguguuauauuuucauuuaguucaguauauuuuuauuucagaauucaucuuuggcucagcuagaagcauguuguuuaauuuccaugcguuuggagguucccauuauuuuucuguuguggauuucuaguucaauuauguucaggaaauauaaucuguaugauuucaauucuuuuaaguuuguuaugcuuuguuuuaugucucaaguagacuggcccuugaagagaauauguacucugcuguuguuggguggaguguucuauaaauacugauuagauuuuguuuuucgaugagguucuuguauuuuucuuuacuuuugcugauuuuuuuuuuuuggcuaugugguuaucaguuuuugagaggaagguugaaaucuccaacuauaauuguggauuuuucuguuucuccuucaguucugucagguuuugcuucugauauuuucagcucuguuguuuauuaugcacauuuaguauugcugugccccugucuaucccucauaaucuucuuugcucugaaaucuguuuuaucugauacuaauauaaccacucuuguuuuauuuugauugguguuugcacgguauauaguuuuucauccuuuuacuucaacucaccuauguuguuguauuugaagugaguuucuuguagacagcaugugauugggucauguuuuuuguuuuauuuuuuauccacuuaauuuuucuuuuaaaugguguauauagaccguuuauauuuaauguaaggcuucagucuaccauuuuauuuuuuuguucaguugguucucuuucauuuuauuuucuuuuguuuaugauuucuuuuuccucccuuccuguggguuaguuuuauauuuuugaaauucuauuuugauucaucuguaguuuuuuuuaguguuucucuuuguauagcuuugauagugguugcuguagguauuacaucauaccuauacacacacuuauuacagucuacuggugucauuuugccaguuuaauugaugugcagaaaccuuaccucuuuauauccuuuugauucccuuuuuauaauaugacugucucaaguguuuaaccauaucagucaguguaaucauucuuucuucaaccauagaauauaauuuagaaaacacaacagaaugaaauuguuguauugacuuauauuuauuauuugcuguuacuucucccuaauguuucaguauuccuuuuuauaucauuugcuuuguauuuagagaacuuauuguagccauuccuuuuuuuuuaagcagggucuugcucugucacccaggcuggcauacaguggugcaauuucagcucacugcagccuugaccuccuaggcuuaagccauccucccaccucagcgucccaaguagcugggacuacaggugggcaccaccacaccuggcuaauuucuguauuuuuuguagagaugggguuguaccauauugcccaggcuggucuugaacuccugagcucaagugauccaccugcuuuggccucccaaugugcugggauuacaggcgugagccaccaugccuggccuagccauucuuuaacagcaaguccgcuggcaacaaaugauuuccccuucauucuugaaugguauuucagcuggauauagaauucuggguuggcaauucuuuccuuucaguacuugaaaaauaugugucacuaccuucucgucucccugguuucuuaugagaaaccugcuguuugaauuguuuuuccccccuuagauaaggugucguuucucucuucuuucaagauuauuuuucuacguuuuuggaagaugacugauauauuuugucacguauuuguuuggguuuauccuguuugugguucauucagcuacuuaagcugcagguuuauguuucuuaauacauuuugguaauuuucagucauuauuucuuugaauuucagccccuccuuccuucuccucuucuuuuaggacucuaaugacaaaaauauuaaaucuuuuguuauagucccauggguacaugagucucuuuuccauuccauuuuucucuguuguucagauuaggccauuucuguuguuuagucuucaaaaucaccaaaucuucuguucucugcuuucuacugaacacauucugaguuuuuaauuucuguuauauuuuucaguucuaauuuuuuuuuuuuuugagacagggucucacucucgcccaagcuggagugcaguagcaagauuucagcucacugcacacuccaccuuccagguucaagcaauucucaugccucagccacccaaguagcugggauugcaggcaugcaccaccacacccagcuaacuuuuguaauuuuaguacagacgggguuucaccauguuggccagacugguuuggaacuccugaccucaaguaaucugcgugccuuugccucccaacuugcugggauuacaggccugagcugcugugcccagccuaaaauuuucaguugauucuuuuuuuaugucuucuuguuucuuugcugagacuguuuguuucauuugucucaaguauguuaauaauugcuuaugaggcauuuuuauaaugacuacuuuaaaaauccuugucagacaauucuaacaucuaugucaucucaguguuggugucuguugauugucuuuucucguugaacuugagauuuuucugguucuuauuaugagaaaguucuauuuaaacugggcauguugguuacuauaucaugagaugcuggauuuuauuuaaaucuuuugguauaguaggcaucuucugacaaauguuuuggcagggcaugagacgcccuaccacauuguugccaguugauagugggaguucagucuccucacuaggccucuacugguauuaccuuggcuggguggggggacagaggcucaagauuaccuguuuacuucuuuccagauggccuccacugacaucacagggggugacucauuaguuauuauuggauggugguauaauuccaguaggaagggaagggguuuucuuguaacugcuggguguggguggauguauuguuucccuacauggucuucauugacacuguugggucacagggaggaccuugugaaaucagacuugucugaccccacccugguagugccuuguuauaacuugguuacgguagaaaggugaggauucagcugcauuuuuugcuguacuguuugguuggaauugagugguuauccuaacauuuucugucuugcugugcugccccuuuccugguccuuuggcuggaggguaggcuuuucuuggagauuuuuuugacagcaccuucuggaguucuucagcaaccaaucuaggauacaugaggcagaaagaaagucuguaacagcugggcucgguggcucacaccuguaaucccagcauuuugggaagugaggcaggaggaucacuugagcccaggaguugaagaccagucugggcaacauagugagacccuaucuccacaaaaauuuuaaaaauuagcugggugcauuagugcauuucuggagucccagcuacuugggaggcugaggugggaggagugcuugagcccagcaagucaaggcugcagugagcugugaucaugccauugcacuccagugugggugacaauucaagacccugucgcaaaaaaaacaagcuuuuaaaaauaaaaagguagcccaugaaacucaguaccacauuauccuuuauauccugagggcccuacccaucugccucauccuucugacuuuucagagcugccuucuguuccuuguauguauacaagauugguaauuugggcuucauuaaaauuaaggacuucuguucaccaaaggugugauaguuaauuuuaugugucauuuugacugcacuaagagaugcccaugcagcugauaaaacacuucuggauaugucugugagggugcuccugaaaggguauuugaauuaauagacugaguaaagaagauugcccucaucagugugagugggcaucauccuacccauugagggccugaauagaccaaaaaugcagaggaagggcaaauuugcucucucuuucuuugagcugggacauccaucuuaucgagcccuuggagauugguaaucaugguucuucagccuucagacucagacagacuaggacuuauaccaacugcccccacccacaacccuacccccggauuuucaggccuuugaacugggaccaggauuuauacgauuagcucccugguuuugcagcuugugaacaguacauuguagcacuucacagcuuccauaaucacagugaggcuaaugccguaauaugucuacacacacacacacacacacacacacacacacacgcauguacacacaaguucuuaacuccuuuugguucuguuucucuggaaaacccugacuaauacaaacgucauuucacauuaagaguguaaaggcaagccacaaaguuggagaagcuauuuccaauauauagauauaaaaaggucucauccaggauauauaaauaacucuuaaaaaucaauuggauaaacuagacaacccaauagaaaaaugggcaaaaacuugaacaggacuuuacaaaagacgauaucugaauggccaauaaauguaugaaagcauggugauccuuauuaauuaucagagaaauucaaguuaaaaaugguuuugacaaaagaugcaaaagcaauuaaauggagagagcauagccuuuucaaaaacugguauugaaacaauuagacuuucauaggccaaaaacaaaccuuuacuuaagccuuacccauauuuuaaaaaaucaagucaaaaggaaucauaaaucuaaauguaaaacuauuauacuuguauaagaaaacagaagaaaaucuucugcaucuaggguuagucagaguucuuagucaugaugccaaaggcauauaacccauuaaauaaaaaaucaauaauuggacuuaaucaaaaauaaaaacuuuugucugugaaagacucuuagggaaaggaaaagacaacuuauagacuuggagaaaauauuugcaauuugcauauuuaacaaaggacucauucagaauguauaaagaacucagaaagaaaacaacccaguuaguaaaugggcaaaggacuugaacugacacuucucugaagaaggcuaugcaugucaaauaagcauaugaaaagauagcaucacuagccauuagggaaauguaauuuaggugaggcuaguggcucaggccugcaaucccagggcuuugggaggcugaggugagaggaucacuugaggccauggguucaagaccagccugggcaacauggugagaaucugucuuuacaaaaaauuaaauacaauuagcugggcaugguggcacaugucuauagucauaacuacuuaggaggcugaggaaggaggaucacuugagcccaggaauucgagguugcagugagcuaugauugugccacugcacuccaaccugggagacagagugagaucuugucucuaaaaaagaaagaaaauguaauuuaaaaccacaugaguugucacuucacaccuaucagcauggcuaaaauaaaaaauagugacaacauuaaaugcuugugaggauauagagaaacuagaucuauccuacauuacuagugggaauauaaaauaacaaccauucugggaaacaauuuggcaguuuaaaaaaacaaaacuaaacaacuaaacauacuugucauauaaccuugcaauuacacucucagaaauguaucccauggaaaugaaaacauuuucacauaaaaaccuaaacacaaauguucacagcagcuuuuauuuagaaugguccucaacuagaaacaaccaaauguuauuuaacaugugaauggauaaacaaauugugguauaucuauguaguggaaugcugcucagcuuacugauccaagcaacaacuuauauggaucucaugcuaacuggaaaaugccauucuugauuugacagaaguauaaugauagagaacugaucuguaguugacaggguuuaggguuaggggaagggcaugaauacgaagggauaacacaaggaagguguuuuuuugugaugacagaacaguucuguauccugcuaugguaaugguuaugugauucuacaugcaugauaaaauuuuguagaacuauacaucaaacaaaaaacugaugaaacccaaaugagcucuguacuugaguucauaccaacaucaauuuccugguuuugacaauguauuguuguuauauaaguuguagguuaccauuggaagccgagagugaaggauauaugggagcucgacugcuguaauuuuugugaaccuuaaacuguuuuugaaagguuauaauaaaaacaaaaagauaguaccaugaguugucaaggaccugaacaacuggaagccucauauaaugcuggugggaauaugaauuggaauaacuacuuuauagaacaauuuguucaguuuaacagugcauguaaauacccuaugacucagcaauuccacucuuagauauguaccugacagaaaugcuuuuaucaaaagacacguauaauaugguuuauaggagcauuaugcaaauaaugcuuuauauuuuaauuauguuuguuuugagcauauacuuuaauacuaauacuuaguauuaagaauaucuaaaaaagguauuggguaguuuaucucaauauggacuugcguauugaaguucuuuaagguuucauguguguuguguguguguguauguauguauguauguguguuuuuuaaccuacauaguuuauaccauucuauaugcuugauucuuuuguauagcucuaugccaucuuuugcuuaugugggauagauauuaauaacuggaauaauuuuggaccagcauuuacccauauaccuucaaguauguccucuaaugaaagaugcuacaguuuauucucuguaaugacuauguguuauagagguauaaagaugaaacuugucaucauaaucccacugaccacagagaaccacuauuaacauuguguuuauauguuuuguuuuuaaugcauuugcaauuguauuuaguaaggcucuauauucugcuuuucuuccgcauaacauaguauuuuggauuuuuaaugguaacauagccagaguguaauuuacuucucuauguuauacauauuguuuaauuuucaaccuuaugcuacuguaaaauaacacugugauaaauacauuuucuucaaaauuggucaacuuuugugauaauuucuauagucuguauucauagaugugugguagcuccaaauugacauaaaacaugaauuuaguaucucuauuuauuuuauaccaggauuuuucuuuaguauauaauaugauugguagacuaaauuguaaacuuuuucccaucauuuaaauuuagaguuucuuugcauucuaguguauagugaaugcuauaaauguaauuaguauggcauuuuagucauuaauuuucuuucaugaaagaaaagaaaaacauuuuguguugauuauugagagcuuauuauauuccagggauuuuugucacucuguaaguuaccagcaauaagcaaauuauuaaauaaauuacuguacaaucauccaaugaaauacuaugcagcuaccaagcaugauguuuaccaagaaauuuggggaaauguucauaauacauauuguauauacaguuacuauccugacugcaaaauuuaaaaaguauauauuuagaaaaaaagaaaacuguaggaaauauaucaugauuugaauggagguuguuucuggggaguggaacugaguaauucuuuuccuuagaguuguuuuuauuuucaaaaaguguuuauccaaucuuuuucaaauuaaauuuucauuaauaucaaaguaauauauuuacauauuuuuaaaaaacagauaguuuuacaaggcuucaaauaaaaaccagucccgugaccaaaccucuuucuaccugugauuucuacuuucuggagguaaccaauuucaacucuuggcaauucuuacuuacuuacauacauccuuucuaaaguguaagguaguaauuuaccacaagcacaggcacacuuuuccucauucguuuucccaguauaauuuuucauaauauuugccuaaauuaauuugcaguauuuucuuuauuguggcuacguaaauauuuguaagccacuugaauacugugauuguuuuuccuuuuucguguacuuguuuauuauauuuugcugaaguauucauucguuuuuaccauuugcuuaguuuucuauauaccuaucaccaauucauuccuaaauuauccuguagaaauauuguaaauccuggccaggcaugguagcacaugucuguaaucccagcacuuugggaggccgaggugggcagauuaccuuaggucaggaguucaagaccagccuggccaacauggugaaacccuaucucuacuaaaaauacaaaaauuaaccaggcauggugguguuccuguaaucccagcugcucaggaggcugaggcaggagaaucacuugaaccugggaggcagagguugcagugagucgagauugcgccauugcacucccgccugggugacagagugagucuccgucucaaaaaaaaaaaaaaaaaaaaaaaaagggaaagaaagaaagaaaccuuauaaaugcuuguguuccaacaaaucagguaaucuaucaguuucuuuuuuuuuuucuuuagacacccuuccuggagccccgugucugucuucuugcuucuguuuuaucuaccucaguaccuugcaucugucuaacgccucuccuuacauucuuuaugcuguauuauaaauguugagucaccccuacauauucaccuacuuuugcauuuuccuucauuuugauguacuuagugccccuagcuguacccaauacaauauagacuuucagguuacauauaaauucucuaaauuuauucagaaaucuguagauaaaaccuugacuacauuguaaauauuugauuuuucauuucaucuuuauucuuaaaucagacgauuuuauuuuccaacaauaggauucuuccugggcauauguauuaucauccugacuccuuagauaauauauuauuuucuucaguaaguaagaaaugaauucucugaacucuugauaguuaaaaaaaaacuaaguaucaaaaagucauauuguaauuaaaauauuuguaaaguacuaauuacugaagcauuuauucuauauuuucauuuucagaggacgauuauuuaucauuucuacuaaagcaggaucucuaggaauuaaucugguagcugcuaaucgaguaauuauauucgacgcuucuuggaauccaucuuaugacauccagaguauauucagaguuuaucgcuuuggacaaacuaagccuguuuauguauauagguucuuagcucagguagguuuauaauucucuuuuucauauugaaaguuuaugugaaacugauaauauuuuagagauauggaacauauguguauuacagagagggaaacaaaguuggaaauaccauuucuguacauaaagcagcagaagucaguuuuggcuuuucuugauuuucuguuuuguaguguauccauuucugugaugucaucuuucucagguugagauuguuuugcaugaacacauuuagcagaugcuacccccagcagaugcaaccccucucagccugccuccaaaucugggcuucuuaaccagaaacuggguuuuuuuugguagauccuugcuuauuugaucuucuuuaguacauaaguugauugacaacuuuauguaaacucuuuccuguuauuuguuuauuuauucaauuuucuuuuauuuuuuucuuuccuguuaaguuuaaaacuucuguacauucucauuuauaauuuguauuauauuuaauauacauuuaauauaauguauacauuuaauuaauguaguuuauauguaauggauaugguauuuuauauuuguuuucugucuugaaauuauagaaaauaaaacgauauaaaggcauuuuaugguguuuguugauagcuuauuauauuacauugaaaaggaaucaaacugcucucuugcauucuaacuucaauauuuaccuaaauguuuuuugugucugucccuuuauuucuguuuacucugguaucugccugcuguccuccuccuacagaguacagaaauaaauaaagcaacacuugaaugcauuuuggucaguuaauauagaauaauuaucaguaauguaauuuuauuuauuaugguaaacuaugcuaaacagaugaaaucuuucaugaauuaagcaaaauugcugaugaguuuuucuuuauggcaauauacuaccauaaaguuuuaccauuucauauuaaccaguaaccguauuuauccuugauuaaguuucaugcuuacaaaauuuuauuuuuuuguauauucuuccuucuuuuuacaaagggaaccauggaagauaagauuuaugaucggcaaguaacuaagcagucacugucuuuucgaguuguugaucagcagcagguggagcgucauuuuacuaugaaugagcuuacugaacuuuauacuuuugagccagacuuauuagaugacccuaauucagaaaagaagaagaagagggauacucccaugcugccaaagguaaacauauuuagauuauuggcuuaacaaaccaacguggacuaaggaaauuuuacuacugauaucaaauuuagucaucugauuaaggcuauauuucagaauuuuucaaggauaauaaaaugauauuuaaugaauuuugucuagaaaauuauaaaugauagggugcuugaucuguucuccauauagcaccacaaaaagauaguauauucugaaacacauauuuuaugccacauauaauauaucuaauuagcauauuuucuaauauacuuuacacuucaacuuuuauaagaaguagcagacaaauuuuccaauuagaaaaggggaaauuacuucgaauuuauucauauggugaauuucggguugcaggaaaccaguuaauuuuauaaacguguauuauuugcugacuuugagagguauacugugagagaauacuaagaaaaacaagacauuguucagauuaucucccucaauccagcagcugaaaagcagauaguccuguuuucauuuucaagaugaggaaacugagguucagagaggcuagguaacuuacccaaguuuacacaccauauuguaaagcuggucuucaaaucauaucugaccaacucaaaagcauuacucuuaaucauuauaauuuuuuguccuccaaauggagauuagaaaguuauuuucaaauacaagaagcaaagcagaggaccugggauuuccagaauugaaugacauuuaggaugcuuuauuuuaguuuaaauaaaucuggacuuuaaaauauagaaugcuuucacagucaguaauauugugugauauaacuguuaagaugguauaauauagucaguuuagcuuaugucuugugaagguuaaauacuccucaaauuuauggaaaacuuuaagguuuacaaaggccugucucauauacauuaucucaggaagcugagauuuagaguuugugauuacacaaggguacaugaccaguaaguguuacagcuagaauuugaacccaguaguuuucuuucucucuucuccccucccccucucucccccacccccaccucccuccuccccucucucccucucccucuuccccucucucccucucccucuuccccucucucccucucccucuuccccucucucccucucccucuuccccucucucccucuuccccucucucccucucccucucucccucucucccucucucccucucucccucucucccucucucccucucucccuuucccccucucccucucccucuccuucuaccucuuuuugagacagucucacugugucgcccaggcuggagugcaguggcgcaaucucagcucacugcaaccuccaccuccuggguucaagcgauucuccugccucagccucccaaguagcuaggacuauaggcgccugccaccacgcccagcaauuuuuuuuucuauuuuuaguagagaugggguuuuacuauguuggccagguuggucuugaacuccugaccuugugauccacccaccucagccucccaaagugcugggauuacaggugugagccaccgcgccugguccuuuuuuuuguucuuuuuucuuuuuuacuuuaaguucuguuauacgugugcugaacaugcaguuuguuacauagguauacaugugccauggugguuugcugcaccuaucaacccgucaucuagguuuuaagcccugcauacauuagguauuuguccuaauguucucccuccccuuuccccccacccccugacaggccccagugggugauguaacccuccccauguccauauguucucauuguucaacugccacuuaugagugagaacaugcaguguuugguuuucuguucuuguguuaguuugcugaggaugaugguuuccagcuucauccaugucccugcaaaggacuugaacucauucuuuuuauggcugcauaguauuccuugguguguaugugccacauuuucuuuauccagucugucauugaugggcauuuggguugguuccaggucuuugcuauuguaaauagugcugugauaaacauacgugugcaugugucuuuauaguagaaugauuuauaauccuuuggguauauacccaguaaugagauugcugagucaaaugguauuucugguucuagauccuugaggaaucgccacacugucuuccauaaugguugaacuaacacucccaccaacaguguaaaagcguuccuauuucuccacauccucaccagcaucuguuguuuccugacuuauuuaaugaucauuauucuaacuggugugagauggcaucucauugugaacccagucguuuucaaacuguguuacaaggaaccccaggagaugcuuuagggacugcuaccauguggcuaagcaaguacagaggggccaggcaaugaacacucugaucccgacaucccauuucagucagagccccucuuuuaucuuuuuaauguauuggacuucaacauaagauuuaauucaaagagaggacgugccugcuuuuuaaaaaaaaguuuuuaaaacacaaugccauguugccuuucuaucacaguaacuaaaaacugugagagaucuauccaggaaguacaaucagauaccugaaggagcugauaauccgguuggggagaaaaaaguaacauucuuaaaagggaaagaaugaagugcugaugugacuggugcugaguaucuuugcuuauaauaggggaaggauggagcauucagauacaauuuugaugggagaaaaaucagacuugguuggccuauaaaagaugguuaguauuuaauuggauaaagggaagaaucaagugugaaugagagauugaacaguuugggcaaagggacagagguaagaauuuauguaccaggcuuaagggaugaugaaauuggccuggcauugaugaagaguggagguuagauaaguaggaaagccaugaaaggcaaauggaggcauugcgcuuuaaaauaauguuuacuauaaguucuugaaugggacuguuguaugaugaaucugggcuuuuagaaaauuagccuggagugauuauugugggcucgaucagacauuucaugaaaauaaaugguagaacucaacugauaauagacuagcuuuuaaagggauaggcagcgaaaauguuuuuuuuuucuuugagacagagucucacucuguugcccaggcuggagugcagcggcaugaucucggcucacugcagccuccgccuccuggguucaaaugauucuugugccucggcuucccgaguagcugagguuauagacaugugccaccacacccagcuaauuuuuauauuuuuaguagagaugggguuucaccauguuggccaggcuggucucaaacucccgaccucagaugauucaccugccuuggccucccaaaaugcugggauugcagguaugagcuaccuugcccagccaaaaaauuuuaucuuaaauaaugaagcuuaguuauucauucauugauuuaaacuuuuuggggugccuaugauaugccaauuguacuggucucuaaggauacacucauaaauaagucuaggauucuguucccaagaagcuauagucuuaaaagcuuaccuuaagcaaguaauauaguaagaguuacagauccuauaauagaaaucugugcaggugccaaggaaggaauauucauuucuuucuuggaaaguuugggauggauauugaugugcuugaacagauguugaaaguagaacuggguaacuguuugcauugcuaagacggcagaagagcaaaaggccuuucaagauggggaauagaaaaaaagaagcacaugcauaacauggcaugauaaguuugaagaaccucaaguaguuaaaaauaaauaagaguauaaggagauacugguagaguaagggugagugugggaagagguaaaaguaaagacuggaaagguaggugggaaucaaaucauagaaauuaguuuguaaguuguguuauagguugugguaucuauuuaacaauuuuaagcaagagacuaccgucacauuuucauuuuagaaaaaaaucauuuuauguaucaguguggaggauggaucagagaaaagaaaauggauauuaagauacuuguuaggaugcuacuaaaaugauucaggugggagagguaauacaggccugauaugagauguuagcaguggagacagagaaguacugggcauaauauagauacucaguaauuauuaauguucccuugauuuauaauuagaauuucauguaagauuuccacuaguuuaauagaauuugaaaacuggucaucugaaauggguacguuuugauauucauggcgagggauuucuugguacguuuggauauucauggugauggauuuuuugguauuugaagcugcuuuuauucaagguauuuugaaguugguuccuguuauuauaguacaauugcaaacaccuuccuucuuguccaugauuuuuaagaugaaagacugcuaaaaaugauacauuuucauccuuucaauugcuguuaucuaaguaauaauuaaauuccaugcuuuuaugagguuuuuuugucuuuugguagucccgaaagcacuucuuuuuaacuuacuugauaugugauuacuguaucucuuucugcuucaucacuuccuccuuaggucauuauuacuuaauuccuguuccuccauuucucuucuuguucaguuuuuacuucucuacuucuaauuugauuuaauaccucagacuuaauuagccaccugacuauuuuucuugucuuuguaccucuuuaaaggcaagaacugcauucugugcuuccuucaguauccuuagugaauaaugcaaugcuuggcacuuuuuuauuauuauuauacuuuaaguucugggguacauguacacaacgugcagguuuguuacauauguauacgugugccauguuggugugcugcacccauuaacucgucgucuagguuagguauaucuccuaaugcuaucccuccccccuccccccaccccaugacaggcccugguaugugauguucuccuuccuguguccaaguguucucauuguucaauucccaccuaugagugagaacaugggguguuugguuuucuauccuugcaauaguuugcugagaaugaugguuuccagcuucauccaugucccuacaaaggacaggaacucaucauuuuuuauggcugcauaguauuccaugguguauaugugccacauuuucuuaauccagucuaucauuggugggcauuuggguugguuccaagucuuugcuauugugaauaguaaacauacaugcgcauguguuuuucuagcagcaugauuuauaauccuuuggguauauacccaguaaugggauugcugggucaaaugguauuucuaguucuggauccuugaggaaucgccacacugucuuccacaaugguugaacuaguuuacagucccaccaacaguguaaaaguguuccuauuucuccacauccucuccagcaccuguuguuuccugacuuuuugaugauugccauuccaacugguaugagaugguaucucauugugguuuugauuugcauuugucugaugaccagugaugaugagcauuuuuucaugugucuguuggcugcauaaaugucuucuuuugagaagugucuguucauacccuucacucacuuguugacgggguuguuuguuuguuuucuuguaaauauguuugaguucauuguagauucugguuauuagcccuuugucagauggguagauugcaaaaauuuucucccauucuauagguugcccauucacucugaugguaguuucuuuugcugugcggaggcucuuuaguuuaauuagaucccauuugucaauuuuggcuuuuguugccauugcuuuuggugucuuagacaugaaguccuugcccaugccuauuuccugaaugguauugccuagguuuucuucuagggauuuuaugguuuuaggucuaccauuuaagucuuuaauccaucuugaauuaauuuuuguauaaggcguaaggaagggauccaguuccagcuuucuacauauggcuagccaguuuucccagcacaccauuuauuaaacagggaauccuuuccccauuucuuguuuuugucagguuugucaaagaucagaugguuguagaugugugauauuguuuccgagggcucuauucuguuccauuggucuauaucucuguuuugguaccaguaccaugcuguuuugguuacuauagccuuguaguauaguuugaagucagguagcgugaugccucccgcuuuguucuuuuggcuuaggauugacuuggcaaugcggggucuuuuuugguuccauaugaacuuuaaaguaguuuuuuccaauucugugaagaaagucauugguagcuugauggggauggcauugaaucuuuaaauuaccuugggcaguguggccauuuucaugauauugauucuuccuauccaugagcauggaauguucuuccauuuguuuguguccucuuuuauuucauugagcagugguuuguaguucuccuugaagagguccuucacaucccuuguaaguuggauuccuagguauuuuauucucuuugaagcaacugagaaugggaguucacucaugauuuggcucucuguuugucucuuauuaguguauaggaaugcuugugauuuuugcacauugauuuuguauccuggacuuugcugaaguuguuuaucagcuuaaggagauuuugggcugagacaaugggguuuucuagauauacagucaugucaucugcaaacagggacaauuugacuuccucuuuuccuaauugaauacccuuuauuucuuucuccugccugauugcccuggccagaacuuccaacacuauguugaauaggaguggugagagagggcaucccugucuugugccaguuuucaaagggaauacuuccaguuuuugcccauucaguaugauauuggcuguggguaugucauaaauagcucuuauuauuuugagauacgucccaucaauaccuaauuuauugagaguuuuuagcaugaagguuguugaauuuugucaaaggccuuuucugcaucuauugagauaaucaugugguuuuugucuuugcuucuguuuauaugcuggauuacguuuauugauuugcauauguugaaccagccuugcaucccagggaugaagcccacuugaucaugguggauaauugcuuggcacuuuuaucuagacuuuuuugaaauucuaguugucuuuauaguguuccuuagugauccauauaucauugaaaagcaguguuggaauuagacuuacuuuucaagcaguaaaauugagaugaagauugguuagucugucacaguggguuuguggaaggaagagaauucgagcuuuaauuuauaucuucaguuagauucuuaauuugcuaucuuagcuucauucaccacucuacucauuacuuuauuauuuuuauuuuauuuuauuucauuucauuucauuucauuucauuucauuuuugagacaaggucucguucuauugccuaggcugguccugaacuccuggcaucaugugauccuccugccuuggccucccaaaguguuaggauuacaggcaugagccacuaugccuguccacuuuauuauuuuaaauccccucauuggauucuuacuguugcugcuuuucccuuuuggaaauauaauagccuugacguccugugaaccuauuuuuuaauaaguugauuuaagggccuccugaaucaucucuaccaaguaucugugcaucuuuuuaguuguucaggauaauguuucucagccauuuugaaacuguagcaugaucuagacuuauaaguaguuuaacacaaguuucuagcaauaccgauuuguuaacuuauucuuaauggcuuguguuuaaaauguuaaauuaauagcuaaccucuguuaacguuuauguaaauguuaaauugauagcuaaccuguuaacauuuauguaaauuauguuagagaaaguaccuuuucugguaauaaacuuauuaauuauacagauaucagagaugaaaauuuuggucaaggucauguuuuauuuuauuuugagacagucucacucugucacccaggauggagugcagugcugcaaucucaguucacugcaaccuccgccucugggguucaagugauucucgugccucagccaccugaguagcugggauuacaggcaugcgccaccacgccuggcuaauuuuuguauuuuucauagagaugggcuuucuccauguuggccaggcuggucucgaacuccuggccucaagugaucgacccaccucggucuccuaaagugcugggauuacaggcaugagucaccaccugcagccaagguuauauuuuauaauaugcuuaaguggguguuuuguuccucuuaaguacaguauacacagccuacucuguaccuuuuauuaagaaaacaaaagccaauaaaacuggcauagaaauguuuuuauacuucccuuuuccagcacuggacuacguaugucuuuuuaaaugugaacuacuugaugauuacagggagaacaaaauggggauuuaaauuaaaguaucuuaagugaggcuuuagguuuguuuucucuacgcugaauuugugugcaguguucuccccuuucuuuaguccuguauucaaacuuuaauacuucaaagcauaauuuacugaacagagauguuauuguacaguuuuauuagccggcagaugguaauauaagguuucaccuuagucauucuuaauaccagugugaaauacauuccauuaaaauaauuugauguaaaguaugaaauagcuaauccacuuauuucaggaacuuucugguaaccugccuacauuuacuuuugagaauaaagguucaaaauaacacauuuaauuguagagcaaguguuaguagccuaugggguaugaaccacauggugguaugugaaccuaauauuuguugucauauucuucuaggaagccaugcucauaauugaagcauauauaagguuugaugucauugucuccuacuucuuugccuuuuuuuuaaucacagguuuuggauuuuuuuguuuaauaaaacaaguuugaauauuauuccuaucuuuguauuuacuaguauaaaaugauuguuauucaucuggauaugaauagaccaccagaaaaaauaacgggcaucagaaaaauuguuugaauucuaccauuucuuugcagauuacaaaaguguccuauucguuuuuuguuggggugauugaugccaaguaaaaagagcagcuuguuuaagcccucuccuaaauaacuugccaaccacccuuuucagauguaaucuuaggcaaaccauguaagcuuucuaagccucauuuuucugaagaaaauaagaauagugccaguacuucucucacaaaggagguaauucauguaaacauacuaccuagcacauaguaaguguucaaauguuagcugcuguuuuuguuuccauaauuguuauuaauauuaccauuauaguagguucauuucucugaaauacuuauggacuuacauuuuuggaauuucagaggagucaugugagguccugauccugaguagaaaauuaagcuugauauaugacagaccaguagaaaacuaaaaacauuuaggagccagaggagaucaucucagcuaagcugcagaagacauagguauuugaggcuugcauucccccagagaucaguuguaaucaggaaggaauauauuagauauugaucuucacuuucaauaaaguuagcaugcaguugacaaagaacauugaaagggguuuuuuuucuuaaauaauauaagcaacuuuagaauaaagucuaccuuauagccagcugaugcuucuguaguaauuuuccaaaguaaagagaugcuucuauuuucccuccacaaacuacacaauaaauacuuguuaacagacugaccauacuuuauuuauagugcuguuuugucuuauuuuuuauuguaccaccuuaugacacaagaaaaacuauuaaggagccauuuaccaagucuuuuagggaaaacauuuggguuacagaaaccauggagccaaugauacccugagauggcagccucccuaacgcuggcaagcugucuuauaaauaauuguccauggaaacaucaauguagauaaggcagccuugcuggcaguguugggguggagggcagaguuggggaugguaugcaagauucuauuggggagaguuuaggauagacuuuaaaaagugucuccuuauggagaguuggaaguacuagaaauauuugcugcuuaaggucauagaaauccugaaauuuaaaauaccagguuugcauuuaauaaaugcucauuuaauaaaugaauuaaaugguaagcuuuuuuacuuuauaggcaaauuaaaauaucuauucucucuagaauaugaacuuccuauuagccuaggaaggcaagaacuauauuaaugcaucuucaucacucuauccccaauaccuggcauaauacauaauauagcacauagcaaguauucaauaaaaaugugcuaugugaacaaaugaauuuuugugcuaaaauugcaagcuaaauguugugaggcaauaguugacaugccuuugaaauaguguuuuuccuuguguguacuucuuggagaaucaccugguggcuugauuaaaaaugcagauuccuagucggacacaguggcacacaccucuaaucucagcacuuugggaggccaaggugggaggauugcuugaauccaggaguucaggaucagccuggucaacguggcaagacucugucucuacaaaaaauuagccaggcuugguggcaugcaccuguagucucagcuguuuuggagacugaguugggaggaucccuugaaccuaggaggucgaggcugcagugagcaaguuuguaccacuacacuccagccugggugacagagugagacccugucucaaaaaaaaaaaaaugcagauuccuggcuucaucuaagaccuacugaaucagaauuucuggagguaggccuugggaaucuauuuuugacaaggucuaccacucuuguguguacaagguauguaguaguauaauuugccuuuacaauaguuaucagcuaaaccuuugaauuaaaaaaacaaacaguaucuaagcuuuauugagcaauguuuaugccaggaacugugcuaaggauuuuacuagcauuaccuuauuuaauccuuacaaagcagguacaauuuuuucuauuuucugaugaaauuauggcauggaaagugguggcaccggggcuugaacucagugcugugacuccagacuccacacucuuuaaccauuacacuauacuauccugacauuaauauucuauaugauuaagcuugcggagaaguaaauugagguuugauaugacuuuacaccguuuuaaucaauacuguggguuuauggaaaggcacaguguuaucaagguguauaauauuggggaggguauggauuucaucuaguuacuacacaaucuuacagugucagagcugauccuaguccuccuugauugucuuuggugcugaacuuacugauccuuagcccuaagucaguguagcagagugguuaaggacagggguccuggggcaagaccaggguuugaaucuuuaucuuagucaaaauaucugacuucuaugccucaguuuuuucauuauacuucugagaaauguauguccauuaguucuucaaaaauaucauccuuugcauuuuuauuuuugucucuuucugagacuguuacuaucugaaugccugcucuucuagccuccauaucuuuuagcuuuucuuuugcauuccuauuucuuuauucuuucuuacuaucuucuggaagaguaucucagucuuaucuccuaauucacuaagauauucaacuguaccccgcuugcuguuuauacugaguuauuuuuucaacuguuauuuuuuuuuccuaauauuucauuuagacucuuaaauuuguuugaauuccauauugguaauaucuuccuuuauuucaucuguuucaguaacuauguuuuagauaaaauaugaugccaguuguuaccccagggaugucuguguguguguacaugcacauaugcacacauugucuauaaguuucuggaauucauauugccuuuucccuucuauaguuucugcagaguugguuuugagggcaggagcuagcagcucaugcugguuugccaugggaguaguuucguccauaauauggggaugaugauuauaugugcuucauagaguuauuaugaaaaauuaaaugaaguucuuagaacagugcugguaugcagccaugcauucaguuuagcuuuaaacaaaucuacagauggcuaaguuuccagaucccaacuuucgaauauacucuuuugaaaagcuagauuaugguuuugauuugcauuucucugauggccagugaugaugagcauuuuuucauguguuuuuuggcugcauaaaugucuucuuuugagaagugucuguucauguccuuugcccacuuuuugaugggguuguuuguuuuuuucuuguaaauuuguuugaguucauuguagauucuggauauuagcccuuugucagaugaguagguuuauucacgauagcaaagacuuggaaccaacccaaauguccaacaaugauggacuggauuaagaaaauguggcacauauacaccauggaauacuaugcagccauaaaaaaugaugaguucauguccuuuguagggacaugggugaaauuggaaaucaucauucucaguaaacuaucgcaagaacaaaaaaccagacaccgcauauucucacucauagguggaaauugaacaaugagaucacauggacacaggaaggggaauaucacacucuggggacuguugugggguggagggaggggggagggauagcauugggagauauaccuaaugcuagaugacgaguuagugggugcagcgcaccagcauggcacacguauacauauguaacuaaccugcacaaugugcacauguacgcuaaaacuuaaaguauaauaauaaaaaaaaagaaaaagaaaagcuagauuauagagcuaaucagaagggggaaggguacugacccucucuuuuagaguuugagcugucccaggauucugccauauauucuaauguuuucugucucucuuguugcaaggaaaauaugaaaaaaauuguuaauuaauuuucaaaaauucccauugugaacauauucaaaccagaaaaauauauucauauacccauccgcuagauuuaccaauuauuguuuugccacauuugccucaucuauuuuucugaaaucuuuuaaauuacaaguauauggcauuucacuuguaaauacuucaguauauaauacaucuuugaaauaguaagacauuucuuauauaauuacaauaccauaaaaugaauaacuuccuaauucccuaacaccaucucauaacacauccauauuuugauuaccccgcuuguguccaauauauauauauauauuuaauauucuaaguucugggguacaugugcagaaaguacaguuuuguuacauaguuauacacaugccauagugguuugcuauacccaucaacccgucaccuacauuagauauuucuccuaaugcuaucccuccccuagauccccaccccucaacaggccccagugugugauauuccccuccuuguguccauguguucucauuguucaccucccgcuuaugagcgagaacaugugguguuugauuuucuguucuugugucaguuugcagagaaugaugguuuccaguuucauccaugucccugcaaaggacaugaacucguucuuuuuuauggccgcauaguauuccaugguguauauaugccacguuuucuuuauucagucugucauugaugggcauuugaguugguuccaagucuucgcuauugugaauagugccgcaauaaacauaugugugcauguaucuuuauaguagaaugauuuauaauccuuuggguauauacccaguaaugggaucgcugagucaaaaugguauuucugguucuagauccuugaggaaucgccacauugucuuccauaaugguugaacuaauuuacacucccaccaacaguguaaaagcauuccuauuucuccacauccucuccagcaccuguuguuuccugacuuuuuaaagaucgccauucuaacuggcaugagaugguauuucauugugguuuugauuugcauuucucuaaugagcaguaaugaugaguauuuuuucaugucuguuggcugcauauaugucuucuucugagaagugucuguucauauacuuugcccacuuuuugauaggguuguuuuuuucuuguaaauuuguuuaaauucuuuguagauuccggauauuagcccuuugucagaugaguagauugcaaaaauuuucuccuguucuguagguugccuguucacucugaugguaguuucuuuugcugugcagaagcucuuuaguuuaauuacaucccauuuaucaauuuuggcuuuuguugccauugcuuuugguuuuuuagacaugaagucuuugcccauguccugaaugguauugccuagguuuucuucuaggauuuuuaugguuuuaggucuuauguuuaagucuuuaauccauauugacuuaauuuuuguauaagguguaaggaagggguccaguuucaguuuucugcauauggccaaccaguuuucccaacaccauuuauuaaauagggaguccuuuccccauugcuucuuugugucagguuugucaaagaucagaugguuguagaugugugguguuauuucugaggccucuguuuuguuccauuggucuauauaucuguuuugguaccaguaccaugcuguuuugguuacuggagcauugugguauaguuugaagucagguagcaugaugccuccagcuuuguucuuuuugcuuagaauugucuuggcuuugcaggcucuuuucugguuccauuugaaguuuagaguaguuuuuuccaauucugugaauaaagucagugguagcuugauggggacagcauugaaucuauaaauuacuuuggucaguauggccauuuucacgauauugauucuuccuaucuuucagcauggaauguuuuuccauuuguuuguguccucucuuuauuuccuugaacagugguuuguaguucuccuugaagaggucuuucacaucccuuguaaguuguauuccuagguauuuuauucucuuaguaguaauugugaaugggacuucacucaugauuuggcucuauguuugucuguuauugguguauagaaaugcuugugauuuuugcacauugauuuuguauucugggacuuugcugaaguugcuuaucagcuuaaggagauuuugggcugaggcgaugggguuuucuaaauauacaaucauguugucugcaaacagacaauuugacuuucucuuuuccuauuugaauacccuuuauuucuuucucuugccugauugccuuggccagaucuuccaauacuauguugaauaggagugaugagagagggcauccuugucuugugcugguuuucaaagggaaugcauucaguuuuugcccauucaguaugauauuggcuguggguuugucauaaauagcucuuauuauuuugagauacguuccaucaguaccuaauuuauugagaauuuuuaucaugaaggguuguugacuuuugucgaaggucuuuucugcaucuauugagauaaucauaugguuuuugucauugguucuguuuauaugcuagauuacauuuauucauuugaguauguugaacuagccauguauugcagggaugaagccgacuugauugugguggauaagcuuuuugaugugcugcuggauucgguuugccaguauuuuauugaggauuucauggauguucaucagggauauuggccugaaauuuucuuuauuuuguugugucucugccagguuuugguauucaggaggaugcuggccucauaaaaugaguuagggaggauucccucuuuuucuauugauuggaauaguuucagaaggaaugguaucagcuccucuuuguaccucugguagaauucagcugugaauccaucugguccuggacuuccuuuuguuugugggcuauuaauuacugccucaguuucagaacuuguuauuagucuauucacagauucgacuucuucccgguuuagacuugggagggugcauguguccaggaauucauccauuucuucuagauuuucuaguuuauuugcaccaagguguuuuuaguauucucugauguuaguuuguauuucugugggaucaguggugauauccccuuuaucauuuuuuauugcgucuauuugauucuucucuccuuucuucuuuaucagucuggcuagcggucuaucuauuuuguugaucuuuucaaacaaccagcuccuggauucauugauuuuuuuugaagguuuuuuuaugucucuaucuccuucagcucuucucugaucuuaguuauuucuugucuucugcuagcuuuugaauauguugcucuugcuucucuaguucuuuuaauugugauguuagaguguugauuuuagaucuuuccugcugucucuugugggcauuuagugcuauaaauuucccucuacaggcugcuuuaaaugugucccagagauuuugauacguuguaucuuuguucucauugguuucaaagaacuucuuuauuucugccuuaauuuuguuauuuacccaguagucauucaggaggagguuguucaguuuccauguaguugugcaguuuugagugaguuucuuaaucucgaguucugauuugauugcgcuguguucugagagacuguuuguuaugauuuccauucuuuugcauuugcugaggaguguuuuacuuccaauuauguggucaauuuuagaauaagugcaaggaguugcugagaagaaugcauuguucuguugauuuaggguggagaguucuguagauaucuuuuagguccauuugguccagagcugaguucaaguccugaauauccuuguuaauuuucucucauugaucugucucauauugacagugggguguuaaagucucccacuauuauugugugggagucugagucucuuuguaggccucuaagaacuugcuuuaugaaucugggugcucuuguauugggugcauauauauuuaggauaguuagcucuuuuuggugcauugauccuuuuaccauuauguaaugcccuucuuugucucuuuugaucuuuguugguuuuaaagucuguuuuauccgagauuagcauugcaacuccugcuuuuuuuugcuuuccauuugcuugguaaauauuccucuaucucuuuguuuugagccuaugagugucuuugcaagugagaugggucucuugaauacagcacaccaaugggucuugauucuauccaauuugccagucugugccuuuuaagugggggaauuuagcccauuuacauuuaagguuaauauuguuauguuugaauuugauccugucauuaugauucuagcugguuauuuugcccauuaguugaugcaguuucuucauagcguugauggucuuuacaauuuggcauguuuuugcagugucuuauacugguuguuccuuuccauguuuagugcuuccuucaggagcucuuacaaggcaggccugguggugacaaaaucucucagcauuugcuugucuguaaaggaauuuauuucuccuucgcuuauaaagcuuaguuuagcuggauaugaaauucuggguugaauauucuuuucuuuaagaauguugaauauuggcccccauucucuucuggcuuguaggauuucugcagagagaucugcuguuagucugugguggucguuucuguuuguuaugucucuuuuuuuuuuagcguauucauuuucucacccuccauucuggauuuguuugauuauuuccuggcgguguuugaacuuauucuaccucuuauauguucuaccucuuauauauccuguacacuagaaaucagaaauuagauguaaaggcuugauuagauuuaugacauacauuuuuggcaagaaugucuuaggaaugacauguaaaaagggguuaauauuuuuuuaaaaaccaguaugggaaagggaguaauauauauauugagugcuuauacuaucuacuuuuaaauacauugucucauuuacuccuuacaauagcucugagcuauagaugauauuauuccuuuguaguaaaggaucgcccaacuauuaaggagcaaaguggccaggugcaguggcucaugccuguaaucccagcacuuuaggaggccgaggcaggcggaucacgaggucaagagaucgagaccauucuggccaacauggugaaacccugucucuacuaaaaguagaaaaauuagcugggcuugguggugcucaccuguagucccagcuacucgggaggcugaggcaguagaauugcuugaacccaggagauggagguugcagugagcugcgauugcgccacugcacuccagccuggcgacagagugagacucuguaucaaaaaaaaaaaaaaaaaauggagcaaaguuagcauucagaaagagaagaaaauaaauccaacaaggcccuuuaccuuuacuuaaacuuaaaaauuacuaacaaaucacuuaaugucugcgccucagucucugguaaaguaagagcagcaaauuaacuuacuuccaaaguuucuuauaguuccaacauuauuugauccucacaauugcucaggcuacuguguuuuucauuuuagguaaugagagguguucuuuaugcaucagcuaacuuuuuuaauuuaaaaauuucuuuauuuuuauagauuuagggaguacaagugcauuguuuuuaaacagauauauugcacaguggugaagucuggguuuuuagcguaaccaucaccugaauaguguuaauuguacacaauacguaauuucuuaucccucaucucccuccuacccucccaccuuuuggagucucuagugucuauuauuccauucuguuugucccugugugcacauuguuuagcccccacuuauaagugagaauauguaguauuugacuuuguauuucugaguuauuuccuuaagauaauggccucucuaguuccaucaauguuguggcaaaagacaugauuucauuuauuuuuaugucugaguaguauuccaugguguguguguguguguguguguguguguguguguguguuuguguguguauacacacauuuccuuuuuuauccuucagcuuuuaaguucgggggcacaugugcaagaugugcagauuuacauggguaaacgugugccauggugguuugcuguacagaucaccucaacaccuaaguauuaagcccagcaucuauuagcuauucuuccugaugcucucccuccccucaacccucaccccgacagucccuagcguguguuguucccuucaacguguucauguguucucaucauucagcucccacuuauaagugagaacaugcacauaccacauuuucuuuauccagucauccauugguggacacuuaggcugauuccgugacuuugcuauuguguaucugcuaaguuuuuaaaaauacauauauauauauucaggacagguaauaacuauuggucuuuccaaaguuaugacagccauaugucuaggauuuucuuggacaacuccaauaucagauaauuuguccugucaaacaucucaauuuuuuauuagaaaaacuugguuaggguguaaaacaccucuguauagaaauauguuuuuuuuuuaagagauagagucucacuauguugcccaggcuggucuugaacuccucagcccaagcaauccucccgcuucagccucccaaguugcugaaucuacaggcgugcaccaccaugccaggcucuuuucuuucuuuuuuuuucuuuuuaaggugagggucagcuuucacacuauuagaaaagguguuagaaauaauagaaagugguaaauaacaccaguagaguucucccagaagccagccaagagaagagaguauuuugaugaagagagugauuaaauucugucacauguuacugaugaguaagauaggaucaggucugauaauugaccaauuagauuuagugacacaaaggucauugguaaaccaggcacuguacucagcacuucauguguaguauuuaaucuccacaauaaucccaugaaguagaugcuuaguagcccauuuuauauaccagaagacugaggguucagcaaguuaacuugcucaaggacaaagggcuaauaagugguggaacuaggauuaaaaucugcuugagacucacuguucaauacaagagccacuagcuccauauggcuacuuacauuuacauuaaaauuaaguuaaaaaaucaguuucuccaucacauuagucacacuucagauacucaguagucacauguggcuuguagcuacugucuuggauagugcaaacacagaacauuuccaucguugcagagaguacuauuagagagcaguauuccagagccugugaucuuaaucacuacaccuaaagccucccaguugacaaaguuaccaccuuuuuuuggugugugugcacgugcguguguguguguguaaguauauauaauuuaaaucauuccauuaaauuuaccucugaaauucaaaagacugaaacagaucuucuuuuuaucaaauaaguugauugcagagauuauauugguguuuacauuucaggcaaccugcucaugaaauuauccauuguagagagaaaccugggaaacaaagcuauacguccuuuaauuuuuuuccccauuuucauuuaaaguucagaagaacauaauauguuggaaugaucaaugauucugaauuaauauagauauuugaaugucacaguaucuguauauuaauauccuaaagugguguuacuauauugguuagguugacugauucauacauguaagucuuuuaacacuccuggaguaagaguagcaagaaacugaagcuaugauccuuuuaaggguuuaaguaggugaauaccucacuuuugucucuuccauuacuaguguuuucaugaccaaguuuuuuacaucagauuuauuauuuuggacccuuaaaggaauauaaauugcaagagagauuuugaucaguguaagaauuacuagauggccuuauuuauuuccuucuuuauuauuguacuucuuaucuuuuauuaauguuuucuuucucuaagauauauuugaaagccaggcauggugacacaccccuguaguuccagcuacucaggagacugaggcaggaggauuguuugagcucagggguucgaggcuauguaguacauaaucacaccuaugacuagccacugcauuccagccuggguaacauagcgagccccugucucuuaaaaaacaaaagauguggccaggcaugguggcucacaccuguaaucccagcacuuugggaggcugaggugggcggaucacuugaggucagggguucaagaccagccuggacaacaugguaaaacccuguaucuacaaaaauacaaaaaaaaaaaaacacaaaaaaauuagccaggcauguggugguggcaggcgccuguaaucccagcuacuugggaggcugagccaagauaauugcuuguacccaggaggcagagguugcaaugagcugagauugcgccacugcacuccagccugggugacagagugagacucugucucaaaaaaaaaagacauaauuuaaacugcuaaauagcugcuuucauuccuauuucauaucuucuguuuccuuuuuacauuguaccuauaauugaguuagagaauguaacaauguuugugaaauguuaacucaagauuguguagaaugaaaauugaguuucgauucaggcuauacuuggaaagcugcaaccucuagaaugucacugcagucauauaaaaucuagaaugaugacuuucuaccucacaguggcauguggcauauguaauaguuguaauggauauccaauuuuuaaagguaaauugcuaaauauaguaucuaguucuuuaaguguuaaggagaaaacauucuuaucaaaggaggcuuuuaccuuccaccuaagucauuuuggcaggccugccuuuucuuucauuuaaagugauaaguucuguaguugucacuaucuuauucauaccaacaauuugggaaucuggauauauuuauaaaugcucuuuggcaaagguuaugugcucgugaccaaaaaaucugauacaagguguuaugugaauuucauucaauaagcucucuaguuacuuaucaaauucacugcauuuuuuccagcguaguuugggaagaaagaaccuucaaauuugaaaguagaggcuuuuugaccaggaauauuaaauuucuuuacuaagaagcuagauuuauuuaagcaauaaaaggaauuuuucauagcuuuuugagugggucauguggcaguuaaguauucuggugauuuuauuuccagauauuacaaaacucaaauugaaaguaauggcaagcaaaauauuuuugaaacguggcaaacccccucccuuacccccaggcaaagccuugauuauuuuuuuagauauuuuauuuucaagguugaauuucagaauuaauuagaugggaauuuuugucagcuugccaaauacuuuaaacuucuaaguaaauuaacuuaaacuuauaauuuaucauuaauuuuguuuuauuaauugaacuagucguuuuaaaagcuuaaacuaauuuagauugugagcuagaauauagaccuugcuuuucccuguguauaagcuuuuucacuuauuuaaggaaaaaaaaguuuagacaaagaaaaguaaagguacacauuuggauguaauuuaaaucucauuuugaugacuguuggcuuagugauuauagauucugcuccacuauuguuuucaauaauaguguuacucuagcaacuaauauaaaugcaugcuuuuacaggauaaaacaaaaaccuuuccaccaguuguguuguguauugggaugaaauuuucuuuauuaacuuuuauaacuugcucuggacuuugcaaaacuguuuuuucccaaagaaauaaucugaagauccuguuacaaauacuuuuuuguccccuuaauuucauuauuuguuucuuauauugauaguaugcugcuauuaauuuaaaaggggaagauuuagaaacaguuuguaucagaaauccuaugucuuuuuuuucucuuauucaugucuuacauagcacucuggaggaaagaaagacuucugccuuccugcuuaugaacuacauaaaugauuuucaauuuaaaaaaccaguuaacuuacuugcacggucuuuucuuuguuaaaaugaaaauuauggaaagcaugcuuaucuuuagucuuugaauuuuuuggcauaaucauauaaagaagugauugaaauacauuaaacuuuauucauuaacccuuguucgcagauuugguaauaaaaacuggaagcagucuuaauguuuuaauaaacucuuaaguaagggaaugauuaaauagaugauaaaguauaacuauauaagcacugugcagcuauuagaaaugaugaagguuuggauuugauguaaaaugauauccacggaaagguauuaagagauaagaguauguuucaaaacuacauauacuucaauuccauuuuuuuucuuucaacuuuuaaguuccagaauacaugugcagcuuuguuaugcagguaaaugugugccaugguggguuacugcacagaucaucccaucacccagguauuaagcucagcauccauuagcuauucuuccugaugcacucccucccccaaccccccacaggugccaaguguguguugucccccuccauguguccauguguucucaucgaucaggucccacuuuauaagugagaacaugugggguuugguuuucuguuccuucauuaguuugagaauaauggcuuccaucuccauccaugucccugcaaaggacaugaucuuguuccuuuuuauggcugcauaguguguauauguaccaucugguauauguaccacauuuucuuuauccagucuaucauugaugggcauguagguugauuccaugacuuugcuuuuguaaauagugcugcagugaacauacgcaugcauguaucuuuauaauagaaugauuucuauuccuuuggguauauacccaguaaugggauugcugggucaaauguuauuucugccucuaggucuuugaggaaucgccacacugucuuccacaaugguugaacaccaacaguauaaaaguguuauuuuucuccacaacuuuuccagcaucugcuguuuuuugacuuuuuaguaauagccauucugauuggcaucagaugguaucucauuguaguuuugauuugcauuucucuaacgaucagugaugaugagcuuuuuuucauauguuuauaggcuacaagugugucuucuuuugagaaaugucuguucauguccuuugccuacuuuuuaaugggguuguuucuuucucauagauuuguuuaaaugucuuguagauucuggauauuauaccuuuguaauauagauagauugcaaacguuuucuuccauuuuguagguugucuguucacucugaugaucguuucuuuugcugugcagaagcuuuuuaguuuaauuagaucccauuugucaauuuuggcuucuguugcaauugcuuuugguguuuuucucaugaaaucuuugcccaugccuauauccugaaugguauugccuagauuuucuucugggguuuuuauaguuuggaguuuuacauuucagucuguaauccaucuugaguuaaauuuuguguaugguguaaggaaggauucuaguuucaguuuucugcauauggcuugccuguucuccuagcaccacuuauuaaauagggaauccuuuccccauugcucguuuuggucagguuugucaaagagcagauggcuguaggugugcagucuuauuucuggguucucuauucuauuccauuccauuggucgaugugucuguuuuuguaccaguaccaugcuguuuugguuacuguaggcuugugguauagauaaaaucagguagcaugaugccuucagcuuuguucuuuuugcuuaggauucauuggcuauuugggcucuuuuuugguuccauaugaauuuucaaauaguuuuuuuuuucuaauucugugaagaauugucagugguaguuuaaugggaauagcauugaaucuguaaguuacuuugggaaguauggccguuuucacacuauugauucuuccuauccaugagcauggaauguuucucuauuuguuuguauccucucugauuucccugagcagugguuuguuguucuccuugaagagguccuucacuucccccuugcuagcuguauuccuagguauuuuauacucucuguagcaauugugaaugagaguuuauucaugauuuggcucuuugcuugccuguuguugguguauaggaaugcuaguaauuuuuacacauugauuuuauauccugagaauuugcugaaguuucuuaucagcuuaagaagcuuuugggcugagacagugggguuuucuagcuauagggacaugucaucugcaaacaaagauauuuugacuuccucucuuccuauuugaauauacuuuauuucuuucucuugccugauugcccuggccaggacuuccaauacuacguugaauaggaguggugagagaaggcaucuuugucuugugccaguuuucaaggggaaugcuuccagcuuuugcccauucaguaugauauuggccauggguuugucguauauugcucauauuauuuugagauauguuccuucaaugccuaguuuauugagaguuuuaaacaaugaaggcaugcucaauuuuauugaagauguuuuuugcaucuauugagauaaucaugugguuuuuguguuuaguucuguuuaugugaugaaucacauuuauuuauuuccauauguugaaccaaccuugcauuccagggaugacgccaucuugaucaugguggauaagcuuuuugaugugcugcugguuucauucaguuugccauuauuuuauugaggauuuuuuugcaucaauguucaucaaggauauuggccugaaguuuucuuuuuuuguuguaucucugccagguuuucauaucaggaugaugcuggccucauagaaugaguuacggaggaguccuuccucuguaauuuuuggaauaguuucaguauucagcuccucuuuguaccugugguagaauucggcuaugaauccaucugguccugggcuuuuuuuggcugguaggcuauuuauuacugccucaauuucagaacauguuacuagucuauucagagauucaguuuuuuccugguucagucuuggaggguguguuuguccaggaaauugucuguuucuucuggauuuucuaguuuauaugagcagagguauuuauauuauucucugacgguuguuugcauuucuguggggucaguggggaugucccccuuauuucugauuuuauuuuuuauuugauuuuuauuuuauuugauucuucuuucuuuucuucauuagccuagcuagcggucuaacuauuuuauuaauuuuuuuaagaaaccacuuccuggauucguugaauuucuuuuguuauuuuuuuuuucuuagggguuuuccaugucucuguuugcuucagcucagcucugaucuuaguuauuucuugucuucugcuagcuuugggguuugauugcucuugguucucuaguucuuuuaguugagauguuugguuguuaacgugaaaucuuucuaguuuuguuuuguuuuguuuguuuguuuguuuguuuguuuguuuugagacggagucucacucuguugcccagguuggaauacaauggcacgaucucagcucacuccaaccuccgccuccuggguucaagggauucuccugccucagccucccagguagcugggauuacagguaccugccaccacgccuggcuaauuuuuuguauuuuuuaguagagaugggguuucaccauguuggccaggcuggucucgaacuacugaccucaagugauccacccgccucagccucccaaagugcagggauuacagacgugagccacugugcccagucuuucuagcuuuuugaugugggcauuuuagugcuauaaauuucucucccagagauucugauguguuuucucuuuguucacauuaguuucaaaaaauuucuugauuucuaccuuaauuucauuauuuacccaagagucauuaaggagcagguuguucaauuuccauguaguucugugguuuugaguggauuucuuauucuugaguucuaauuugauugcgcuguggucuaagagacuguuaugauuucaguucuuuugcauuugcugaggaguauuuuccuauuaugugauaaauuuuagaguauguguuguguggcaaugagaagaacguauauucuguuguuuuugggugaagaguucuguaaauaucuaucagguccacaugaugcagagcugaguucagguccugaauauccucguuaauuuucugucucaaugaucuaauauugucagagggguguuaaacucucccacuauuauuguaugggagucuaauucucuuuguaggucucuaagaacuugcuuuaugaaucugcuuuagcaucaucgugaugcuagcugguuauuuugcagacuuguuugugugguugcuucauagugucacuggacuguguacuucaguguuuuuuuuaguggcugauaaugguuuuuucuuuccauauuuagugcuuccuucaggaccucuugcaaggcaggccugcuagugaugaaugcccucagcauuugcuugucuaaaugggaucuuauuucuccuuugcuuaugaagcuugguuuggcuguauaugaaauucugggcuggaauuucuuuuauuuaagaauguugaauauuggccccuaaucucuuccggcuuacagguuuuccacuaagaggucugcuguuagucugaugggcuuucuuuuguguaagugaccuggccuuucucucuggcugcccucaacauuuuuucuuucauuucgaccuuggauaaucugaugauuaugugucuugggguugaucuucucguggaauaucuuacugggguucucugcauuucuugaauuugaaauuuggccugucuugcuagguuguggaaguucuccucgaugauauccuaaaguauguuuuccagcuugguuccacucucccugucaguuuuagggaccccagucagucguagguuuggucuccuuacauaaucacauaauucucagagguucauuccuuuucauucuuuuuucucuauucuugucugccugucuuauuucagaaagauagucuuccagcucuaagauucuuuccucaccuuggucucuucugcuauugauaguuugcauugugaaguucucauguuguguuuuucagcuccaucagguugguuauguuccucucuaaacuggcuauucuugcuaucagcuccuguauuguuuuaucgugauucuuagcuucuuugccuuggguuaaaacaugcuuuuuuuuagcccagcgauauuuguuauuacucaccuucugaagcguauuucuguuauuucauccuucucagccucagcccaguucugugcucuugcuggagagguguugcagucauuuggagaagaaaaggcacucuggcuuuuugaguuuucagcauuuaugcauugauuguuucucaucuuugugggcuuaucuaccuuugauccuugagguugcuaaccuuugaauggguuuuuuuucggggccuuuuuuuguuguuguugacauugcugcuguuguuuucuguuuguuuuucuuuuaacaaucacgccacccuacuguagggcuccugugguuagcuggggcuuugcuccagacccuaguuuccucggcuucuccagcacuugcaggaggcggcuggcaaccugcacuggaagaucucacccagucaggagggaugggaucagggacccacccaaugaagcagucugguugcuucuugguagagcagguguguugcacugggguggacccuuuucuuccucuguaccaccuguauucuccauaaccagcaagcugaaauggcugauuuaacggaagcacagagauggccgcuggcccuccccuggggagcucccucccauggagagaucagaucucugucugcaggagugggucgggaccugucaaagaagcagucuggcuacaaucuggcaaggcagcugcgcugcgccuugugcggggaaggagggggugcuccuugucuggguggucugcacucuccacaacggggaggcuggaacaacugaguccccagaaaccacagagauaucagccgccccccacccccccaccacccccagcucccucccagcgagagaucagaucucugacccugcaugggaaguccugcucaguuuggaguggguccgucugguugaagaagcagucuggcccccuuaucuggcaaggccacugcacugcgcugugggcggccccuccuccucugggccguguccacucuucacagcuggcaggcuguauuggcuauuuccccugaauugcagagauggcgaccgccccucccgcuggaacuuggucuugucucaggcggacuucagcccucugcuguuggcuagcugagauuccaagccagugggucuuagccugugaggugcgauggaaauggggccugccgagccaugcugcuuggcucccuguauucagaccccuuccuagggauguauauggauggauuuuaugccuuggcggggaucccggggcaggagcaugcagaacucccagaucucugugugcgccugagcugcuguuuugcugagacuccacacagcucuguguaucagacccaagguccugguggaauggguucacaacaggaucuccugcuccgcauguugcaaagauccaugggagaagcgugguggcuuccugagcggguugcacaaucacucacugccuccccuggcuggggguggggguuccuuuugcuccacguggcuccuggaugggccguagcccuucuccuugcucuccaugcuuuuugccuauucagucccaaugugagaaccuggauauuucauuugaagguauuggauucauucaccccuuuucaugccucucugugagugccacagaccacagcugcuucucaucagccaucuugcccuuuguccaguuccauuuuuaugcaaaggugugugugugucaauguguggaggaauaaaauaaaaaaugguacugguaguuauuuccugguuuuguaauuggauguuaguauuguuugcauuucuuuguuuuguucgguucuuugaaaagaggauuauaguagccaggauggagguaauguuuuaggcaaaaaaucugaaacuuuuuaagauagaaaacaaacaaauucacauguacuuuuccugugacuuacauuggcauuucaguugacuguaagucaaaaggaaaguuauugcaucauuagaggcugaaccuucaccauaaccugaccuuagacagucaugucugacuugauaggauagguuuuaaaucuggaauuaguggggugaauacguuaaagggguuuagaaauggcguuucucaaaauaagugucuccugaagaugaaaaugguaaaauagugcgugguauuauuuucaggcauaguauaagccugaacuggccuuucacaaguuugucuugagacuugucauuguuucaguuuuuauguuuucuuuuauuaaauuaacaugcuuguuuuaaaaaguucaaaaaguacaaaaguacuuuuagguucaguggcucaugccugaaaucccagcacuuugggaagccgaggcagguggaucacuugaggucaggaguucgagaccagccuggccagcuuggugaaacuccaucucuacuaaaaauacagaaauuagccaugcgugguagcgaguaccuguaguuccagcuacucaggaggcugaggcaggagaaucgcuggaaccugggagguggagguugcagugagcacuguauuccagccugggcaauagugagacucugucucuaaauaaauaaauaaaaguuaaaaagugcuaaaaguaagaaaauagacauaaguucccccuccccuggaaucuuucauugaauuaccuuuuuuuuucuaagggaauaguucugggaaguagaggaacuguaucucaauaaaacagacauucuuuguggugugauagaaucaucacugcauaggagccaggaaauuuaguuuccagucccagguaguccuuagcuguauaaucggaaaaaguuacuuugccucuuugggccucaauuucuacuaauucuaugaugacacaguuggacuuagaaauuuuaggaugcuaaggacugacuuaauaaagcuuuccugguaucucagacauuuuuuaaaaggcuguauaugaguuuguguauauguguaugugcacaugcauuucuggaaaggcuuccccuccaaccauuaaauauauaauuaauguuauaaauuguguuguuuauaauugagaaauaaauaccacacuugacaaugucuauuuccaaagaauuggguauuuuugugcuuuuguuuauuccugguauuuucauaucauccuguuacacacgugagcagagaauguguguaucauccauauuuaauuuacagucauagcuagacuaaguuauuauccaauguuauugaaagaaucaguagcacagauagaaaugaauuaguuccuaguauacaguuuucuuggccuuucucuuaaccaguuugcuuucuuagagaaaugaacugaucugacuaugauuaagaucauuuauugcuagacagaaguaaaauuagagauuauccauagaacauuuuaaucuuguaauuuauuugguguguuguagaacaccugacuuuucucauuguauuugguaaauguguuaaaaauguuaagucaguguuaucugguuuuauuuuaucucuugagucauguuuggcauguauguguugggggggugggcauaggaguuacacauuuaagaaagcccuaucuuuuaguagaauaaauuaaugcagauuggccugucuuccugccugccuggucaguaacaguggacuuuggagauugaucuagugaugauaaaccuauuguauguggcauaagccagagaagucagcuucgauagcaaguuucuacauuggcgugagagagaagcauuuaguuaacauuucaaaguaacuaagccuguuagcauccauguauucuaucaguagacuuuauugaguccugucauuuguauggucuuuuauuguuuuuuguuuucaacaaaggaaauagcacacacauacaucucaaaauggauuauaccuguuguaaucucaguauuuugggagaucaaggugggaggaucacuugaggccaggaauuugaaaccagccugggaaacauacugagauccuaugucuacaaaauuuuuaaaauuagccagguacagugguaugcaccuguaguccuagcuacucgggaggcugaggcaggagaaucacuugagcccaggaguucaaggcagcagugaucugugaucaaaccacugcacuccaacuugggugacaacaugggacccuaucuuaaaaaaaaaaaaaaaagaauuauaaagucucuauuaugguuguaucuauuaagaauaucaguucuguuaagaaaggaaauaauuguuucaaauguuuauugggguagcaagauaaaaaguuguuuacaagauauuaaauaucagaauauuuggaauuagugucaguauuugcuauuauauagaaaaaaaaccuggggccucaugauuugaauuuuucaucuugaguuauuuaaugcacauuugaguucuuaccacuuuuuggacccuauacucaagguguguaaaggcauaauuauuuucaaaugugggcuuugucuaugcaaaaauuuaugagugcauuaagcaucacuaggugcagauuaaauuugaauucagugugcuguauguauaccuccacuacuuucauuugaucagaaaugcacaauuuagaaaguguguucuaggaaaacuuguuaaaagcuauggaaaauccuucuguaaagugaauuaauuugccuuuuauagauccagguuuucauaugugauuucuuaaugaacaacuugugaauauuuuaaauuuauuaaaaguaacauaucuguaauucacuuuaaacccccaccccaucuaucuuugugucucacucucacagucauaauuaaacagagcaggaguuuaguuguucuuacugaguauauaaaugaucccaauuuuuaagcuuuuaauuuuuuaaucuuaaaagacuggcuuaagauaccaugauuucuuuaaacuauauauacuaugauaauaaauugaaaaauguauaucaauuuaaauuugacccaugggucuuuacaguguaauuuaacauuuacauuccugcaguuggaauauaagggcuauauguuucaguuaaacucuccuauaacuguuuagauuaauuuagauuaguuuuuuguuaauauagugguuggcaguugaaaugauugugaaaauaaaguuguuuaugauguauaaauaggaguagccuugauuucuagcacaggcauccaauauagucacuaauuuaagcagacuuauguuagcauuuaucaacucagaauuaagcacaaaauaaaaugcauauaaaaaauguuaaguugguggaaagaccuugaaaucugaaaagugguaauuaaaaaacaauggaaugccuaaaccauacuguauaaacaugaaagucuuacauaagaggcugguguuacauguuuugcugcuguuuuuuagguaaucugucauauauaucagaaauauauauagcaaucagguuuuaguuucuaguacaguugaccauagaacuauggagauauuauacuguccagaggggaaaaauaauugucucuuauuucaaccccucuaaacaggauaccauacuugcagagcuccuucagauacauaaagaacacauuguaggauaccaugaacaugauucucuuuuggaccacaaagaagaagaagaguugacugaagaagaaagaaaagcagcuugggcugaguaugaagcagagaagaagguaguugaugcaaaauguguuuuuguuuuuguuauguuagugauuugaaagagcaaugaagaagaaaagggucacauuugaaacagguaauaauaauauaguggguuuuaggaacacauuccccaauuacaagaaucucuuuauggguugguuucagcuaccuuuagugguagaguaggaggagaagacagaagaaaacaguuuacacuuaaagaguaguaaucccauuucugccuaguauuuguugaauugagaaaugagugggaagccauauauuuagcaucacuaaccucccaucaguacccucucuguaguaacaaacauacaggagcuuaguguuuggagguuguaguaaauguagcuuugcauguauaccaugaaaucuaaauuuuggcugaauaucagaacacaaaaauauuucauuauuagacauuaaugccauuugcuccagcagcaacuuuauuuaagaucauucuaugucuguuuuaaacaucaacccacuugagcaaaaaugugccugagcaugggaaaccuuauccuaauaccugaauccuuuucaaacuccuaacuuauuguaccaaacuucuuuaacauuagugugauguucagagucucaucagaauucuuugaguugcccccauucugugggaauuaucagaaaaaaaaaguacaccuuuagggguuaaagcuuuccuuguaauaagaucuugguuucgggugaaaaggguguuuuguuuguguguggaagaguguuaauaauuuccuggaucugagaauguggauucuuuucuaaaccaguaggugauguagaauuucaaguuuuaaaucacaaugugaaaagugcauaauuuuuuuguuuuuagggacugaccaugcguuucaacauaccaacugggaccaauuuacccccugucaguuucaacucucaaacuccuuauauuccuuucaauuugggagcccugucagcaaugaguaaucaacagcuggaggugaguugugaaguacaaaaguaguuugacaugaauuaaaggcaauuucaagugccuuguuguugaggguucccuaugcagaaauaucacauucuccaaaagauuaccccugaauagacgaauaaauuuuuguuuuauuuguugaccguuuugaaccaacaugauguuguaaaaugugguuuguucagagcacaaaggaaucagucggugaauuaauguaguuugaauuauuuuaauuaagaaacaauagggcugcugacucgcuugggaaauagcaccuucuucaguuauaaaauaguuauaauaaauugcuaucuuacuguuugaaaguaagauaaauauacucauuaacuucuauucuagugcauuauagaugcacaauuaaauauauaaugcccaauauuaugaaauaaaugauuuaaagcuagaaucaauuguaaauuaaauaggaaagacuggguuuuuauuauaccaauaaugacuuaauugaaucugaaacacauuauaaaaugugcuuauggauucuucugcauuauuaaauuauuggugugauaaaacucaaacuuuuuuaaucuuccuaacaagacucuuugagcauugauaugguuuacuccacuuuauugauacugaauuuugcuguucucuucaauuauuuaaagaguuuuaaaaccgacugcucuaaguuggcaaauggaaggauucccuauacuuuaacacuaugcugucuuucugccuuauauaacuuauuucuugcauucuucuaggaccucauuaaucaaggaagagaaaaaguuguagaagcaacaaacagugugacagcagugaggauucaaccucuugaggauauaauuucagcuguaguaagcuaauuggcaauugucuuauuccaaccuccaauuuguacccuccacccccuacugccauuuuuuuaaauuuuuaauuguuccuucuuauaaauugauuugcaauaguaaaauacugguaaaauggauggauaaugccaaaccguaacccagcaauuuuacauagauguuggcacaagagagaaauggguaaaauguaagaauugagaaaucaaacauggaaauguaugcauuguuuauauaaacauuuuaauuaccaguuguacaaauuaaaucuaaauuauuguuucauuccagagauagccagcccagguacagcagugaacaacuuaguacccuguuuugcaucauguuuuucuucagaaaagaauaaaggaaaagggggguuugaaaccuugggaaaucccgaauaucuuaaaauaccuuaauuauuuuuccucaauuguacaguaauaaggaguaaauagaaaauuuuucuuuuaguggaaggagaacaugaaucucucagaggcccaaguacaggcguuagcauuaaguagacaagccagccaggagcuugauguuaaacgaagagaagcaaucuacaaugauguauugacaaaacaacagaugguaagaauucugacgucugacuauuucuagguuauguuuaauuuucuugacuuuauaauaaguuuguaugacaucuacgucaguaauuauuccuacuauggagggauggauagucauugauaauucuggaagaaauguaaaaaacccaggaaugucaaguaaaaguaauauauuuuguuacaaaaaugcaacagcuaccuaaaugggaauccuugaaguuuacauaugaucuaguccauauaauuuuauuucucauauauucuggacaucuacguaggaauuuuugccagaguuuuaccacauuugccaauuguauuuuauuuaacuuuuaauuuuugugaguauauaauagguauauauauuuaugggguacauaagguauauugauacagguauacagugcauaauaaucacaucaggguaaaggauaucuaucaccucaagcauuuauccuuucuuuguguuacaaacaauccaguuauacucuucuaguuauuuuuaaaugugcaauaaauuauuuuugacuguagucacccuguugugguaucaaauacuagaucuuauucauucuaacuauacuuuuguaccuauuaaccaucccccauuaccccacucccugcuacccuucucagccucugguaacuaccauucuacucucuuaucaucaugaguucaauuguuuuaguuuuuagcuuccagaaauaagugagaacauaugaacuuugucuuucuaugccuggcuuauuucacuuaacauaaugaucuccaauucuaugcaugcuauugcaaauggcaguaucucguucuuuuuuauggcugaauaguacuccauuguauauauguaccacauauucuuuguuuauucaucuguugguugauacuuagguugcuuccaaaucuuaauguugugaacagugcuacaauaaacaugagagugcagcuaccucuucaauauacugauuuccuuucuuuuggguauaggccuagcagugggacuggugaaucauauaguaccucuguuuuuaguuuucugaggaaccuccaaaccguucuccauagugcuuguacuaauacacguuacuaacaacaguguacacaaguucccuuuucuccacauccucaccaauauuaguuauugccugucuuuuggauaaaggccauuuuaacugggguaagaugauauuucauuaucuuuuuuguuugguugguugguuuuguagagacggggucucacuauauuucccaggcuggucucaaacucucgggcuuaaacgauccucugaccucagccucccaaaguguugggauuacaggcgugagugaccaugcccagccucucauuguaguguugauuugcauuaucuaaugacugaugauguugagugccuuuuccuaugccuguuugccauuuguaugucuucuuucgagaaauaucuauucagauauuuugcccauuuuuaaaucugauuauuagauuuuuuuuccuaugcaguuguuugagcuccuuauauauucugguuauuaaucccuugucaguuggauagcuugcaaauauuuucucgcauucuguggguugucucuucgccuuguugauuguuuccuuugcugugcagaagcuuuuuaacuuagugguauccuguuuguccauuuuuuauuugguugccuguacuugugagauauuacucaagaaaucuuugccaguucaauguccuggacaguuugcccaguguuuuucuguaguagauucauaguuugaggucucagauuuaagucuuuaauccauuuugauuugaauguuguauauggcaagagcuuggggucuucuuucauuguucugcguauggauauccagcuuccacagcaccauuuauuaaugagacuguccuuucuucaaugcauguucauggcaccugugcaaaaaaugaguuuacugguguguggauuuguuucuggguucucacuucuguucucuuggucugugugucuguuuuuaugccaguaccaugcuguuuugguuacuguagcucuguaguaucauuugaagucagguaaugugauuccuccaguuuuguucuuuuugcucacuacagcuuugccuauugugggucuucugugguuccaugaaaaguucagaauuuuuuuuuuguuucugugaagaaugucauugguauuuugauaaggaugcauuguaucuauggauugcuuuggguaguaugggcauuuuaacaauauuaauuuauccaauccaugaacauggaagaucuuuucauuuuuuuguacccucuuccauuucuuucaucagcauuguguaguuuucauuguagacaucuuucacuucuuugguuaaguuuauuccuagguauuuaauuuugacuguggcuacuguaaaugggauuacuuucucaauuucuuuuucagauuauucacugcuggcauuuagaaaugcugcugauuuuguaugcugccacuuuacuaaguuuguuuaucaguucuaaaauauuuuugguggagucuuuagguuuuuccaaauaccagaucauaacauuugcaaacaggauaauuugacuucuucuuuuccaacugggaugcccuuuauuucuuucucuugucugauugcucuagcuaugacuugcagaacuauguugaauaacagugguaaaagcuggcauccuuguuguguuccaauuuuuagaagaaagucuuucaguuuuuccccauugaguacgauacuggcugugagucugucaauauauggcuuuuauuguguugagguauguuccuucuauaaccguauuuugaggauuuauaucaugaaaggaucuugaauauuaucagauguuuuuucagcaucaguugaaauuaucauacaguuuuuguccuucauucuguuauuugauguaucacauugauugauuugcauaguuaaaucauccuugaagcccuuggauaaaucccacuuggucauguucaacaacaccuuuuuaaugugguguugaauuguguuugcuauuauuuuguugagaauuuuugcaugaauguucaucucagauauugcccuguaguuuucuuuuuuugauguguuugucugguuuugguauuaagguguuacuggccuuauagaauguguuugaaguauucccuccuccucuacuugucacagcaguuugaggaagauugguauuaguucuucuuuaaacguuugguaaaauucagcagugaagacauugguuuccaggcuuuucuuugcuggaagacuuuuuauuacagcuuuaaucucguuacuuguuacugcucuguucagauuuuggauuucuuaauguuucaaucuugguagauuguaugagucuuggaauuuauccauuucuucuagguuuuccaauuuuuugcauguaguuugucauaggagccucuaaugauccuuugaauuucuuugguaacaguuuuaauaucuacuuuuugaucucugauuuuauuuacuugaaucuucuccuuuuucuuaaucuggcuaaugguuugucaguuuuguuuaucuucucaaaaaaccaacuuuuuauuuauuucugugcugaucuuuauuauuuauuuuacuaauuugggguuuuauuuucuuuuguuuuucuaguucuuuaagaugcauugguagguguuuguuuuuuuuuucuuuucugaugcacgcacuuagagcuguaaacuuuccucuuaguaaugcuuuugcuguaucccauagguuuuuguauguuguguuuccuuuaucauucguuuuaagaaguuuuucaguuuuuuucuuaauguuuucuuugacccacuggucauucaggagcauauuguucaauuuucauguguuuauauaguuucaaaaauuccucuuguuauugauuucuaguuuuauuccauuguggucagagaagaaacuugauaugauuucauuuguuugaauguuuuaagacuuguuuuguggccuaauauauggucuuuccuugagaaugauuuaugugccaaggaaaagaauguauauucugugaccauuggaugaaauguccuguaaauaucuauuuggucuauagugcagaauaaguccguugguuuuuuuuauugauuuucugucuggaugaucuguccaauguguaaaguugaggugucgaagucuccagcuauuauuauuuuggggucugucucucuauuuagcucuaauaauauuugcuuuuuauaucuggugcuccaguguugggugcacauauauuuacaauuguuguaucuuguugcugaauugaccccuuuaucauuauauaaugaccaucguugucucuuuuuauauuuuuugucuugaaaucuguuuuggcugauguaaguauagcuaguccugcucuuuuuugguuuccauuuucaugaaauaucuuuuuucaucccuuuauuuucacuguauaugugucuuuauagguacaauguauuucuuacaggaaacagaugguugggucuuuuuuaaaaauccauucagacacuauaugucuugauuggagaguuuaguccauuuauauucacuguuauucuguuuuuaaacuuucauuuuaaguucauggauacaugugcagguuuguuauauagguaaaucugugucacggguuuguuguacagauuauuuugucacccagguauuaagccuagcacccauaaguuauuuuuccugaucaucucccuccucucagccuccaaccucuggucagccccagugucuguuauugcccucuauguguucauguguucucaucauuuaguucccacuuuuuagugaaaacauaugguauuugguuuccuguuccugcauuaguuugcuaaggauaauggccuccagcuccauccauguuccugcaaaggacaugaucuuguucuuauuauuagguuuauagaagauauuaauaaaauuaaauaaauagauugacaacagucuugaaaaugugugcugagaucugggcucagcuuuacaagccgagaaugagaaaguagauuuuugaucucugagauuucuaauaguugagucagcuacuguuggaaugagaaaagcucuaguugucuauaacauguugaauuugucagacucuuugugaugagcugcguucaauaaaccaaaugcagaggcauuaguagcaggcuauggcucugcuagcugagguuuggaaaucacaggaugcaacgccucaauuuuugcuguggaacuugauaauggggcauuccguaaugaaugccguaugaggggacgugaguaugaguaggcagagggcacauguaucuagagcuucagucacuguagguaucaggaagaaaggcacauuuagaauacaccuuuacacacguggauuuuuuuuuuucaccccuccugaacuuuuucuuuauuuuuauuuuuuauuuccacauuuucuuuauccagucuaccauugauaggcauuuagcuuuauuccauguuuuugcuuuuguggauagugcugcaaugaacauauacgugugucauuauaauagaacaauguauguuccuuugaauuuauacccaguaauaggauugcaggguugaaugguaguucuguuuuuagcucuuugaggaacuaccacacugcuuuccacaauggaugaacuaauuuacacucccaccagcaguguauaagcauuccuuuuucucuacaaccucaccagcaucuuuugacuuuuuaauaauggccauucugacugguguaagguaucucauugugguuuugauuugccuuucucuaaugaucagugauguucagcuuuuuuucauaugauuguuggccacguguguguuuucuuuugcaaagugucuguucauguccuuugcccacuuuuuaaugggguuguuauuuucuucuauauuucuuuaaguuccuuauagauaauggauauuaguugcuagauggauaguuugcaaaacuuuucugcaauucuguagguugucucucuacucuguugauaguuuccuuugcugugcagaagcucugcugugcagaguuuaguuggaucucauuuguccauuuuugcuuuuguugcaauugcuuuuggcaucuucaucaugaaaucuuugcccauuccuauauccagaauuauauugcuuagguugucuuccaggguuuuuauaguuuucggguuuacauuuaaguauugaaugcaucuugaguugauauuuguauaugguguguaaggaggggguccaguuucaaucuucucccuguggcuagccaauuaccccagcacuguuuauugaguagggaguccuuuucccauuacuuguuuuugucaacuuugucaaagaucagaugguuguagguguguggccuuauuucugagcugucuauucaguuccauuggucugugugucuuuuuguaccaguaccacacuguuuugguuacuguagcucuguaguauaguuugaaguuguauagcauaaugccuccagcuuuguucauuuugcuuacgauugccuuggcuauucaaccuuuuuuuuguuguuccauaugaauuuuaaaauaguuuugucuaguuuaugaagaauaucauuaguaguuugauaggaauagcauugaauguauaaauugcuuugggcaguaugaccauuucaacaauauugauucuuccuauccaugagcauggaauguuuuuccauuuguuuugacaucucuaauuucuuuuagcagucuuuuggaguucucauuguagagaccuuuuaccucccugguuagcuguauuccuagguauuuuauucuuuauuguggcaguugugaaugggauugcaugccugauuugccucuuugcuugacuuuuguugguguauaggaaugcuacugauuuuuguacauugauuuuguacccugagauauugcugaacuuguuuaucagcuuaagaagcauuuugggccaagacuagaguuuucuagauacagaaucauggcaucugcauacugugauaguuugacuuucucucuuccuauuuggauaaccuuuauuuauuucuguuuccugauugcucugcccaggacuucuaauacuauguugaauaggaguggugauagagggcauccuugucuugugccaguuuucaagaugaauacuuccagcuuuugcccauucaguauaauguuggcugugggucuccuccuggcggaauuccagaggcccgaggcaagagccaguugcuucuugccacuucaacucacucauuccccuggaguucuugugggccaggaaugaguccuggugugcgguagccccauucaggguucccagcuuccuccuccaaccaagcuucuguuucuucccuccgcccacucucauugccuucucucugaagaucuguuaggagugugccagucauccuugucuuucgguggcagcuuuuccaccuugcugcaucuagucauccaucuugcccaaccccauuauucuuuuuuuuuuuuuuuuuuuuuuuuuugagacggagucucgcucugucgcccaggcuggagugcaguggcgcaaucucagcucacugcaagcuccgccucccggguucaggccauucuccuaucuuagccuccugaguagcugggacuacaggugcccgccaccacgcccagcuaauuuuuuguauuuuuaguagagacgggguuucaccguguuaaccaggauggucucagucuccugaccuugugauccucccgccucggccucccaaagugcugggguuacaggcgugagccacugugcccagccuccaaccccauuauucuugauaaguuaggacuuacuccugccauuuuguuauuuguuuucugguuguuuugugaucccugucuuccuucuuuucuuccuaucauccuuuuaguuaaagcaauuuucugugguuguauguuuuaauuucuuuuauuauuauuuuuuugagacggaguuucacuguguugcccaggcuggagugcaguggcaugaucucagcuuacugcaaucucugccuucccggguuugagcgauucuccugccucagccuccugaguagcuggaauuauaagcacccgccaccaugcgcagcuaauuuucacauuuuuacuagagacaggguuucaccauguuggccaggcuggucucgaacuacugaccucaggugauccauccaccuuggccucccaaagcgcugggaucacaggccugagccaccgcgcccggcaugauuucuugcuuauaguuuuuuguuuaucuguuguauguuuguuuuuuugaaguuaccaugaggcuugcaaauaauguaaugcaucauuuuaagcugaugauaacacugauugcauaaacaagcaaacaaaguaacaaacaagcaaagagaaaacuaauguucuauugccagugaguuuuauaccuucauguaacuuuucguuguuuguuaacauccuuuucuuucagauugagaaacucccuuuaauauuucuuguaggacagguuugauauugaaauuccucagcuucuguuugugugggaaagucuuuauuucuccuucacauuugaagcauauuuucaccagauaugauguucuaggguaaaaguuuuuuguuuguuuguuuguuuguuccuucaccccuuuuaaauaucucaugucacucucuccugggcuguaaguuuucuacugaaaagucuacugccagauguauuggagcuccuuuguauguuauuuguuuccuuucucuugcugcauuuaguauacuuucuuuauccuugaccuuugagaguuugauuauuaaaugguaggagguagucuucauuagguuaaaucugcuugguguuccauaaccuucuuuuucuugaauauugauaguuuucucuaggcuuggggaauucucuguuguugucccuuugaauaaacuuuauaccccuaucugucucucugccuccucuuuaaggccaauaacucuuagauuugcccauuugaggcuauuuucuagaucuuguagaugugcuucauuguuuuuuguucuuuuuucuuuugucuccucugaugguacauuuucaaauagccugucuucaagcuuacuaauucuuucuucuccuugaucgguucugcuauuaagagacucuuaauacauucuucaguaugucaauugcauuuuuugacuccagaauuucugcuugauucuuuuaaauuauuucaauaucuuugugaaauuuaucugaugugauuaucaguuucuucuccauauuaucuugaauuucauugaauuuccucaagacagcucuuuugaauucucugucacauauauucacauguaucugucucucuaggauuggucccugaggccuuauuuaguucguuuggugaugucguguuuccuggauggucuugaugguuguggacauugauucgugucugggcauugaagaguuagguauuuauuauaaucuuuguagucuagccuuguuuguacccauccuucuugggaaggcuuucuagguauucaaagggaguuggauauugugaucuaauggucacugcaucuguaucugcauuagaaggcaucccaaaccggguaaugcugugacucuuguagucuuggagacucauagagguaccgccuugguggucuuggauaagaucuggaagaauugucuggauuaccaggcagagacucuuguucucuucccuuacuuucucccaaacagaaucucucucugucugugcuaagcugucuggaaagcugguggagaggugacacaagcaccccucuggcucccuucacggggaccacacuggguuagaccugaagccugcauagcaaugggucucacccaagauccacaguaacuacuggccuccgccuuuguuugcucaaggcucuaaggcuccacauucaucagguggcaaagccagcuccucuuguguccuucccuucugggcugcagauuucccccagcccuaggccgaucccaagaugcuaucuaagauccagggccuggagucagaaucuuuaggaaucugccuggagcucuauucuacuucggcugagcuggcacccaagccauaagacaaaaucuuucuacccuucccuccgcuuuucacaagcaaaggagucucucccugugaccacuagcaccccaggcccacagcagguauugccuggcuacugcugauguucacucagggcccaagggcucuucagucagcuuguguuaaaugcuaccaggacuacgucucucccuucugggcagugggcuccccuccagcccagggaagguccacaaaugccauccaaaagccaaggccuggaauuaggguccccgagggucugcuugguacccuagcccacuguggcugagcugguaccuaagcuguaugucaaaguucucuuuacucuuucgucuucuuuucucaagcaggagucucuucccauaguguccacagcugggaaugugcuaugucacaccugaagguagcaugucucugagucucacugaaggcccacugcaaguacugccuggguaccacugcugguuauucagggcccaagggcucuucagacaacagauguugaauccugucaggauugagucauuuccuucaagagaaugaguuuccucuggcccagguuaugucuggaaaugucauccaggagcuagggccuggaacaagggccucaggacucugccuggugcccuguccuacuguggcugacgugauauucaagcugcaagacaaagucuucuuuacucuucccucuccucuccucaccucaagcaaaaggaaagagucucuccuggagcugugagcugugcugccugggguuugcgaagguguggcacaagcaaucuccuggccacccuggcuggugucucacuaggucaugugcccccccccccgccccccguccacuggcuuucagcccagcacaguacaggacuuggacucuugguggccuagauugccuuucagguuuauuuaggcccccagaacucuuuaguccacaguggcaaagcuugucggaacucggguucugccugcugggauaggugauuucccucuggcuguggcugguguaaaugcucccucugugggugccagcugaguucugccugguguuucuuuucacugugacagggcagcccugaguuccaaugcagagucccauaaucacuguacucuuuuccugcaagcacauagauucucucucccugccacacggcugcugccaggggaugagugagggguggcauuggcaguucaagacugucuuuccuacccccuuuagugccucuuucagugauaugaaguuaaaaucugguacagugauugcucaccugauuuuugguucucaugaaggugauuuuauugcagauaguuuuucaauuugguguuccuucggggaggacgaucaguggaggcuucuauucagccaucuugcucugccuccagucacauuugccauuguuaaacaaccucgaaauaguaguauacuuaucaguguguuuaauuugagaauaaaagguagagcuauggaugauacauaucaaagguuccuacuaaguuauauaauucuuuaaaaggguacuguauuccaggauccuugaucauguuucccaacacagucguuugccagccuucugccuuauacuuggaaauuucuacgcuugacaccagggaaucuauuucuguggcauauauuuuacuuagaaagcacugcaggguuaugugguuuuacaauauauuaguacauuugagauauuccuggucagaauuauuccuacugcaagugccuuucccuuugguguuugucacuaaaauguuugucugucaucaugugaaauauucaaaagaaugacaaagaaaggagucuuaacaaaaaguguuguaacuaauacuugagacuaaucacaguacagaacacauuacuauggcaacuaagcuaaaugcugcuugcaauauaauagucaagacauuaagagaauuuagcccuaaaugaucuuacuaacugguuucuacaguaaugguccugugaaugccaucacauuaguaaugguguuaacaauaauguguuuuccuuuugguaugguacccccuuaacaaauugauuuuaagucaaaacuugauaccucuuuugagacaggucaugcacuuguaaugacucccauuuuuucucuauaguuaaucagcuguguucagcgaauacuuaugaacagaaggcuccagcagcaguacaaucagcagcaacagcaacaaaugacuuaucaacaagcaacacugggucaccucaugaugccaaagcccccaaauuugaucaugaauccuucuaacuaccagcagauugauaugagaggaauguaucagccaguggcuggugguaugcagccaccaccauuacagcgugcaccacccccaaugagaagcaaaaauccaggaccuucccaagggaaaucaaugugauuuugcacuaaaagcuuaauggauuguuaaaaucauagaaagaucuuuuauuuuuuuaggaaucaaugacuuaacagaacucaacuguauaaauaguuugguccccuuaaaugccaaucuuccauauuaguuuuacuuuuuuuuuuuuuaaauagggcauaccauuucuuccugacauuugucagugauguugccuagaaucuucuuacacacgcugaguacagaagauauuucaaauuguuuucagugaaaacaaguccuuccauaauaguaacaacuccacagauuuccucucuaaauuuuuaugccugcuuuuagcaaccauaaaauugucauaaaauuaauaaauuuaggaaagaauaaagauuuauauauucauucuuuacauauaaaaacacacagcugaguucuuagaguugauuccucaaguuaugaaauacuuuuguacuuaauccauuucuugauuaaagugauugaaaugguuuuaauguucuuuugacugaagucugaaacugggcuccugcuuuauugucucugugacugaaaguuagaaacugaggguuaucuuugacacagaauugugugcaauauucuuaaauacuacugcucuaaaaguuggagaagucuugcaguuaucuuagcauuguauaaacagccuuaaguauagccuaagaagagaauuccuuuuucuucuuuaguccuucugccauuuuuuauuuucaguuauaugugcugaaauaauuacugguaaaauuucaggguuguggauuaucuuccacacaugaauuuucucucuccuggcacgaauauaaagcacaucucuuaacugcauggugccagugcuaaugcuucauccuguugcuggcagugggauguggacuuagaaaaucaaguucuagcauuuuaguagguuaacacugaaguugugguuguuagguucacacccuguuuuauaaacaacaucaaaauggcagaaccauugcugacuuuagguucacaugaggaauguacuuuuaacaauucccaguacuaucaguauugugaaauaauuccucugaaagauaagaaucacuggcuucuaugcgcuucuuuucucucaucaucauguucuuuuaccccaguuuccuuacauuuuuuuaaauuguuucagaguuuguuuuuuuuuuaguuuagauugugaggcaauuauuaaaucaaaauuaauucauccaauaccccuuuacuagaaguuuuacuagaaaauguauuacauuuuauuuuuucuuaauccaguucugcaaaaaugaccuauaaauuuauucauguacaauuuugguuacuugaauuguuaaagaaaacauuguuuuugacuaugggagucaacucaacauggcagaaccauuuuugagaugaugauacaacagguagugaaacagcuuaagaauuccaaaaaaaaaaaaaaaaaaaaaaaaaagaaaacuggguuugggcuuugcuuuagguaucacuggauuagaaugaguuuaacauuagcuaaaacugcuuugaguuguuuggaugauuaagagauugccauuuuuaucuuggaagaacuagugguaaaacauccaagagcacuaggauugugauacagaauuugugagguuugguggauccacgccccucucccccacuuucccaugaugaaauaucacuaauaaauccuguauauuuagauauuaugcuagccauguaaucagauuuauuuaauuggguggggcagguguguauuuacuuuagaaaaaaugaaaaagacaagauuuaugagaaauauuugaaggcaguacacucuggccaacuguuaccaguugguauuucuacaaguucagaauauuuuaaaccugauuuacuagaccugggaauuuucaacauggucuaauuauuuacucaaagacauagaugugaaaauuuuaggcaaccuucuaaaucuuuuucaccauggaugaaacuauaacuuaaagaauaauacuuagaaggguuaauuggaaaucagaguuugaaauaaaacuuggaccacuuuguauacacucuucucacuugacauuuuagcuauauaauauguacuuugaguauaacaucaagcuuuaacaaauauuuaaagacaaaaaaaucacgucaguaaaauacuaaaaggcucauuuuuauauuuguuuuagauguuuuaaauaguugcaauggauuaaaaaugaugauuuaaaauguugcuuguaauacaguuuugccugcuaaauucuccacauuuuguaaccuguuuuauuucuuuggguguaaagcguuuuugcuuaguauugugauauuguauauguuuugucccaguuguauaguaauguuucaguccaucauccagcuuuggcugcugaaaucauacagcugugaagacuugccuuuguuucuguuagacugcuuuucaguucuguauugaguaucuuaaguacuguagaaaagaugucacuucuuccuuuaaggcuguuuuguaauauauauaaggacuggaauuguguuuuuaaagaaaagcauucaaguaugacaauauacuaucuguguuuucaccauucaaagugcuguuuaguaguugaaacuuaaacuauuuaaugucauuuaauaaagugaccaaaauguguugugcucuuuauuguauuuucacagcuuugaaaaucugugcacauacuguuucauagaaaauguauagcuuuuguuguccuauauaauggugguucuuuugcacauuuaguuauuuaauauugagaggucacgaaguuugguuauugaaucuguuauauacuaaauucuguaaagggagaucucucaucucaaaaagaauuuacauaccaggaaguccauguguguuuguguuaguuuuggaugucuuuguguaauccagccccauuuccuguuucccaacagcuguaacacucauuuuaagucaagcagggcuaccaacccacacuugauagaaaagcugcuuaccauucagaagcuuccuuauuaccuggccuccaaaugagcugaauauuuuguagccuucccuuagcuauguucauuuucccuccauuaucauaaaaucagaucgauauuuaugugccccaaacaaaacuuuaagagcaguuacauucugucccaguagcccuuguuuccuuugagaguagcauguugugaggcuauagagacuuauucuaccaguaaaacaggucaauccuuuuacauguuuauuauacuaaaaauuauguucaggguauuuacuacuuuauuucaccagacucagucucaagugacuuggcuaucuccaaaucagaucuacccuuagagaauaaacauuuuucuaccguuauuuuuuuucaagucuauaaucugagccagucccaaaggagugaucaaguuucagaaaugcuuucaucuucacaacauuuuauauauacuauuauauggggugaauaaaguuuuaaauccgaaauaua

SEQ ID NO: 192850 - RNA, 5921 nt, Homo sapiens
uuuuguuuuucagcucacuucaaggguaccugaagcgaauuggcaccaaagcagcagcuguauugccgcaguucuagcuucaccuucacgauguuucccuuggucaaaagcgcacuaaaucgucuccaaggugagcaaaaauuaugacaaaucauuuacaacaaccuuauaucaauguguccucgcggccucucgugugcuuuccuuuuacgaacaucucggccuucuaaucuugaaugcugucugucucccaucucgucccaagucauugggaugauguccuuagcauuggcuuuaucacccaguauuucuguuucgguuuccagcucucuuucuguuaucggagugauagucuagcccugcuuuuuaauucuucaguaaccuuugauuucagggaaggacauucuugguagacaccucguuccuuaagugauguccuacauuuuagcuuuggggauauguuuacuccuaacccuguauagaaaaauaucuucuccaauuccuauuacuguaauagacggaaacuguaaaucuagcucuucaccugguuuaauugcagggaaacaacccaaaugguaucgaugcagcuuugaaguuauuuguggauuaacaauguuagcuggccaggcgcgguggcucacacuuguaaucccagcacuuugggaggccaaggcgggcggauccccugaggucaggaguucgagaccagccuggccaacauagugaaacgccgucccuacuaaaaauacaaaaauuagccgggcgugguggugggcgccuguaaucccagcuacuugggaggcugaggcaagagaaucgcuuguacccgggaggcggagguugcagugagccaagacugcuacugcacuccagccugggcaacaagagcgggacuccgucucgaaaacaaaaacaaaacaauguuagcuguccugaaggcaaucguggucauuuuuuucuuauccaaagguugggcagguacagggaguuuugagaccagcauuauguagagaaaaugcaauagauugaggagaacaaauuaauuuucauacuugauuugcaccgaaggugaccuugaguaacgugggcaguuguuacacaaugaaggugacccguaauuacuauuuaguuuguuuagccaucuuuugauuuucacuuaauagaaucauuggaggauauuauuagauuguguccuaaacucuuaagcaacuuugaaaauaaccacaaaauauuagcuggacuauuuucauauucccaaaguagcauuuauuaucucuuuuacuuugggcauaugauuuagccucucucaaccucaguuuccuucuuuguaaaauaaguaauuuguaaauaaugccuacuucaugggguuguugaggauuauaugagaucaccaaugugugguaauuaaacaguugucacagaggagaggucugaugaaauccaccagaguuacaugaguguguugaaguuaugagauguugcagaauuuuuugguagucuuaauuucuuugcucuuugagcaaauagggccaccuuguaccucaggaaagguuuuuuguuuuuuuuucagcguggaauucacaugcccacuuuuuaucuuuucuggagcagaauauauuaugaaauauuuguaaauuugccuaucccggugugacuaaaagaugaaaagggaaagcuauguaagacaguuagaagaucugauaauggucuaauaacuaucaugaaguaacccauuguaccauguagaaauauucauugcuagugaaugggcaacauugcaguuucuuuuuuuuuuuuuugagacaaaguuucgcucuuguugcccaggcuggagugcaguggcucaaucuugguucacugcaaucuccgucuccuagguucaagugauucuccugccucaggcucccuagcuuuucauuauauauguaaguaccuuuggaggcucuuuaaaacgauaagaaccugccccuuaaauuggacaggaagaaaaaaaaaaacagcuagaaacaagcuuuuuccagucucggcuguuucccaagcccuccuuuuuaguucuuccaggggccguuugaaaacuuuuguucuucucuuucuacugguauaauacuaacagcaaacuuuaucauucugcucaaaaacuaaguccuuagcuaauucugcuuccuuguacgauacugauuuuuaucuacauguguaauccucuagacuggaaguuacuugaggacaggaucucugucuuauacuuuuuuauauaccccauuucucauuuuuuauuuuuagggacagagaauugcucuguuacccaggcuggaguguaguggugugaucauagcucacugcauccucuaacuccuggacucaagugaucguccggccacagccuccugaguagcugggacuacaggugugcaugcaccaccaugcccggcuaauuuuuaauuuucaauuuuuuuguagagacagggucucacuauguuucacagacuggucugaaacuccuggccucaagcgauccuccuaccuuggccuccgaaaguauugggauuacagaugugagccacugugccuggcccauuaauuuuuuaaaaaucaagauuacucuaguuguggcgaguuuuuuuguuacuguaguaauuuuacagucauaagcauuuagugugcuuuaauuugaaguucauuugaguucauuugcccuuguauguuguaaguuguugggcucuauugaguaaacuuuaaugaaaauuuaagucauaaguauucaaauuaaucaaugggagccaaaauuucagggguuaugcaaauaccacuuuguagagaauguuacugacaucauucauucuuugcuuuuuucccccaacacuauuaugaaaacucucagacauacugaagaguuggaagaaucguaugaacacccauauacccaccacaaagauucuacaguuaacauuuugcuauuuguuuuaucauguauuuguccaucugucaauucaucuuauuuuuguugcauuucaaaguacacugcuuuaauagcuacaauauguuuuaacauuuuauugaacuacauaauacuguaaaauuaacuuccuuggcuuuccugauuggcaguaucaaucacauauguuuucuuuaccugacaauugauaauaugcuucuguauucuuuuuucguuuuccuguaaguucgaagcauucagcaaacaauggcaaggcagagccaccagaaacguacaccugauuuucaugacaaauacgguaaugcuguauuagcuaguggagccacuuucuguauuguuacauggacauauguaaguacuauugauuaauaauuucuguuucagauguuuuucauucucagucuaugcauucaaagugucuuaacauaguaguguacauaucuaguuaggagggacuugagagauuguguaaucuaauuacccacacagugcaggggauuuuuuccccccagcauucauccaucuucuguucuuaacauucccaguaauaaauugcuuacuggaucacaaggcagcccuuuccaucuuguguagcuguuuuuuuuguuuuuguuuuuuuuuuuuuuuaagaagaagucuugcugugucccccaggcuggagugcaguggugcgaucuuggcucacugcaaccucugccuccuggguucaagcacuucuucugccucaggcucccaaguagcugggaccacaggugugugccaccaggccuggcuauuuuuuuuuuuuuuuuuuuuugagacggagucuugcucuguugcccaggcuggagugcaguggcgcgaucucggcucacugcaaccucugccuccuggguucaagugauucuccugucucagccucccagguagcgggauuacaggcgcccuccaguacgccuggcagauuuuuguauuuuuaguagagacgggguuucaccauguuaguuaggcuggucuugaacuccugaccucaggugauccgcccgccuugguuucccaaagugcuaggauuacaggugugagccacugugcccagccuuguguagcuguuaaaaggaucauauggugaguuaaaaucugccuuuuuccuaugcuacccauuguucauugaagcacagaaauucugacccacuuccauauaacagccaucagauaauagaaaauugcuaucauaucuccucaauuuucuuuuucaaauuaaacauccuuaguucuaucaguaauuuuuuuguucaugguuuccaggauuuuuacugucuuggaucgccuuccuggacauaacuucacuuaacaauuuuucuuuuaaaauuuuacacucagaacuuagcacaguauucgugacagaugagauguaauguaucuuuuuauauuuuaguuucuuuacaucuuacauuuaacaaucuaucuuucagucacuguuacuuacuggcuaaaaguaggaguccugaagucuguguuuuuuuuuuuuguuuuguuuuuuguuuuuuuuuuuuuugagauggaaucuugcucugucgcccaggcuggagugcaguggcgcgaucucugcucacugcaaacuccgccucccggguucacgccauccuccugccucagccuuccgaguagcugggacuacaggugcccaccaccaugcccggcuaauuuuuuguauuuuuaguagagaugggguuucaccguguuagccaggauggucucgaucuccugaccucgugauccacccaccucggccucccaaagugcugggauuacaagcgugagccacugcgcccggcccgaagucuuaauaaaugcauaaguugguuuaaaaagauacaaauuaauccuuaauguaauaaacuuuauuuaaauaaauaggccuuuuuaguuuuuguuuugaucuuccugaaaucaaauauuaagaugugugccuaggcugggcaugguggcucacgccuguaguccuagcacuuugggaggcccuggcggguggaucaccugaggucaggaguuugguacuagcauggugaaaccccaucucuacuaaaaauacaaaaauuagccgggcgugguggugggcaccuguagucccagcuacuugggaggcugaggcaggagaaucgccugaaguuggaggggguggagguugcagugaguugagaucgugccacuguacucuagccugggcgauaaagcgagacugucucaaaaaaaaaaaaagucucaaaaaaaaaauuaaagugugcuuaauuagaaggauaaacagauguugaacaaauguuugaucagaggagcuuuuggaggugaaauguuccuuagugauacagagaauauaaaauacucuggcaguuacuuagguaguugugguugagggaaucaguguauugaguggguaguauagaaaugugaaguauaaauuugaauuaaauaaaauuuaaaaauucauuuccuuggugauacuagucauauuccagguggcuaguagccacauguagcuagugacuacuguuuuuaacagugaagaucuagaacauuuccuucagcucaagaaguucuauugaacaacaggacugcucuagaaaauuaggacagcaaucagguuuggccuauauggaggguauuagaucccaggugaguuucuguguauuuuuaaccuauagaacagaauaucugucauuuucaagaaauagucuccgagagaguguacucugguuuaaacacguaacugacagcauuuuaauucuuacagguagcaacacaagucggaauagaauggaaccuguccccuguuggcagaguuaccccaaaggaauggaggaaucaguaaucaucccagcugguguaauaaugaauuguuuaaaaaacagcucauaauugaugccaaauuaaagcacuguguacccauuaagauauggcauuauugaagaaauaaaguacauuugaaaccuuc

SEQ ID NO: 192851 - RNA, 7169 nt, Homo sapiens
gugcaggugaggcacguuuagccugagccggccacggacuccacuuccccugcucuucccccaguggcaaauccgcgccaccucgcaaacccccaacucaggcacuugggccccuuuugggcccccucucgcuccucccuuuaggcaccucccugggcccgcccacggucuccccccaguuugggacugcgucauaaguaucccagaccucggcuugcaguaguguuagacugaagauaaaguaagugcuguuugggcuaacaggaucuccucuugcagucugcagcccaggacgcugauuccagcagcgccuuaccgcgcagcccgaagauucacuauggugaaaaucgccuucaauaccccuaccgccgugcaaaaggaggaggcgcggcaagacguggaggcccuccugagccgcacggucagaacucagauacugaccggcaagguagcugucccagggcgggaugggggaggggugggcgaaagaaagaaggcugguagcagaggagaaaauguagcuucccugggagggccccucuugcuccucuuacgcugucucugggguuuacccggucgccucgguucugucuccuugcggcaccuucugcuuaccgcacccucugucacucugcauucccgcgugucgugccauguucugucuguuccagcucacaccagcuguccuggagggaggucagagagaguuugaggagaugcccugggacuccuugucauugucucuuggguaacguguagggaccuggggaucaaggaggggcaugucgcccaguccccaccuccaggggcgcgcauagucuccccagggacagaggggacacaggggggugagcaagaccgggagauuuaacauuucuuucuuuccuuuugguguggaugaaguucuaagacuaaaucuuucuaugaucucugaguguucguggagguggggugagcagcaaagggcacuuuuaacuccaagcaguauggguuggggcaaguggucugcuugagcgcgcgaauauuuuccguuucucucuggucauagguggcuuuaaacauuagauaaagaagcugucaaaauugagguggaucuuaaugccaguguuggguguucacugugcccuuuuacugcaagagccuuguauauuuuuagagugguauuuccuaaagaaaacacucuucucuuguaaaaauaaauuugaggauacuuuucaauuauuuuuaaauuuuuuucuuguugaacaacauccccuucccucuauuuagagaucugaagcagguccaguguuguaauuuaaacuacuagcuuugacaggaacuggggaagcucuuccccaaaauguuauccauuauuuauuuaguccuauuucuacuucuuuuaaacaccuacuauguuuucaggguucguauacuacuccucaguauaaucucaauuuuaaagggcaauaguauugucuucguguucuaugaaaucuggaaaguguuggcgcuugcagaucuguccugacuugucuuguucucuauauaguuuuaacuucuguguucaaaguggagauauaaaaaguccuuugaguuaaaugagaauccauguaguaaaaguugauuguacacacaauuugaaauguuaaugugcuuauccagcuuuuuauuauggaaacuuucaauauuaaauccugcaguaaaacuagcuuuuguguguuauacauuuuagagcucaaaaguaacacccucuugcauuguugagguuuugauuaaaugacagaggucaaauauguaauuguucuccugcuuaguuuguagguuaaacauggucagauuuuuugggaggucuaauuagaggccaguaguuaaauauagccacacaguaauccuuuuuuuuuuuuucuucaccgccaagcauuucaugacuuguagauagauucaguuaauaugcaagcaauacuucugccaggauugugggugcgaugaggaauaagcaaaacugagcauuugcacuuugauuauacuuugcuguuacguuuuggagaaaacuuaacaggauccuuaccuggccacuauaggacacugauaauaauauuugacauauuguguuguaauacauugaucagcuagcucauuagagguugagcaugacaaauaugaugucagacauaguguacaaucacuucgaaagaguuccaagagaaauuagcuaugguaauugauggcucacaccaaccuaaaguccaauaaauguaaaugaaaacaaaaaauccuuauuucuaggauguaacaucuuaugaaauugaaauucuaauacuuaggccuugcuuaauaaacuuccugaauuauugaaagaauaaaugaaauuacagugcaaacuguucuucucaugucucaguagcaagaaaaaauaaauuuauuucucuuagaauuucaaauuaagcuauuaugugacuuaugagcaaguuacuuuaucuuuaugaaacucauuuuagucaucuaaaauauaauuuuaagucuccaguucuagauuauuguacaguaauuccaaaucaaaauuuauaguucuaucuuuguagugcuaaucuuaguuuagguuuuuuuuuuuaauaaaaauaauuaaaaguuccugaaaauuacugggacacagaaaagccuucaagguuuauagaguacuaauuaguggaggguuugaacuuaaauaaauuuaguuaagaaaaugggaaucucaaauuucuuugaccuucaaagaaaaauauuuuuggaaaaauaaacauuuaacaaaugauuguccuuucaucuucugcauuaacuugaaaucuaugcauuuguuuucaccaaaugaauuuaagguuaguuagcucugauaaacauugcaguaguuguccugaaaaagagcuaaugaccuaaaagacuaaaacaauucgauuuauauacacguuugaaugauuuacucuuuaaugaucagggccuagauuugcuuacuucauuuauucaguccuugaguaacaaugcugcuuaggauguauugugacauacaaaaaugggauuagaaagauuggaguccacugcccugggaagggcacaaucaguugcuuguuugcuuuggaucuuucuuguuucaaucccgaagcaaaauauugauuuaacaaaauauuacagucacuguuaccacacagacaacuuuugugucuagcuaucgcaaaugcuacacuucaaaaucaaguguuucacccaggacguggaaaauauuucauucaugcaauacacaguuauagaauauugaucgauauuaagaaacuuuuauuucucgauuaaauuaggaacauuaaauuuauaucucucccuucaauauuuuaauuucuaaaauauggggaaaauggcauauaccuuauagaacuccuaccuuuaaaaccuaauuuucaaaaaucagcuuuuugaaaaaucaguuaauaaauuaaucaaaggauacuaauucucuuuuaaguugacaaacugauuuggaaaaaauaaugaagaaacagaaccauaucccagaaaguuagugauuauaucaguguacuaguucaaaaaguaauuacuucuguuuacugaguauaauuucuagagaucggcucuacugcauugugccuauuguuaauacuauauuauacauuuaaaaauguguuaagagucaaugucguguuaaguguucuuagcacaguaaaaaagaauaugacauugcauaaauaaaugguaauuuuaauuugauucuugaugcauguauuuugaaauaauuucauaucgauauuuggguuuagaaaugccaaauggaagguuaauauaaucagagacauuuuuuaacaucuauuagauucagaaauugucuugaaauaaauucagacuacaauuaaaaugaguuaacauuuaaaaaaauaucuuggguuucaagggagguaaauuguacacaaaaucaacuaugugucuaaaaguacaaucugguuuuguuuuugguuuugcuuuuuaauaaauaggagcuccgaguugccacccaggaaaaagagggcuccucugggagauguaugcuuacucucuuaggccuuucauucaucuuggcaggacuuauuguugguggagccugcauuuacaaguacuucaugcccaagguaauaauaauaauuauaauuauuauacuuuggauuacuacuugcuagacauuuaguagcaacuuaaaaaauucuguaguggugacuagagaaaagaagauuuagggaaaguuuucaaguugccuuucaguucauaaaauugauuugucuucauugugauaacuguagucaacaagccucggcuuaacacauaguacaaugaauugauaugagugugaaaagccauucaaauaucaugauagugauuauuagaagguuguaauuuucccuuuuugucuuuuagagcaccauuuaccguggagagaugugcuuuuuugauucugaggauccugcaaauucccuucguggaggagagccuaacuuccugccugugacugaggaggcugacauucgugaggaugacaacauugcaaucauugaugugccuguccccaguuucucugauagugacccugcagcaauuauucaugacuuugaaaaggugggcuucucauucuuauaaauauuccaggauuuuuuuucucucucucucucuuuuuuacuucauuggcagguauuaaauucauucaugaaugcacauguuuuugaggcaaagccuuuucauucuuuuguuguugaauacacauuaguugauuuugaaaggauguagccgcuuaaucuaaugguaguuggaaaauucgcaauguuaaugccuucugugucuuaccugacuuuuuuccccuaccuaacagggaaugacugcuuaccuggacuuguugcuggggaacugcuaucugaugccccucaauacuucuauuguuaugccuccaaaaaaucugguagagcucuuuggcaaacuggcgguauguauuuuggaagucaaauuuuuauauaagcauuuccaaguaauuuuacuuccuuguuuuuuaaaaaaauaaugaauuuguccaaaacauuuuauuuuauugaaauaauuuugaaauaaaaaacguugugaaccuaaaacugcucuagaaaauaaagauuauuuuuuacagucauuaucugguguaggaaaggauuuaaauaguguccuuaagaauuugggcaaaugacaugaacagacauuuuccaaaagaagacauacaugcgggccacaaacaugaacaaaagcugagcaucacugaacauuagauaaaugcaaaucaaaaucacaaugagauaccaucucacaccagucagaguggcuauuacuaaaaagucaaaaaauaacagaugcuggugagguuguggagaaaaaggaaugcuuauacaccauugguguugguguaaauuaguucagccauuauggaagaugcuguggugauuucucagaccuagacagaaauacuauuagacccagcaaucgcauuacuggguguaugcccaaagaaauauaaauaauuuuauuauaaagacacaugcacaaguauguucauugcagcaauauuuauaauagcaaagacaugguaucagccuaaauguccaucaaugauagaguggauaaagaaaaugcgauacauacacaccaugguauaguaugcagccaaaaaaaaaaaaaaaucacaaaaaaaaaacaagaucauguccuuugcagagacauggauaaagcuggaggccauuauccuuacaaacuaacacagcaacagaaaaccaaauaccguauguucucacuuaagugagagccaaaugcaaagaacacauggucacauagaggggaauaacacacacuggggccuuucagaggguggaagaugggggaagggacaggaucaggaaaaauaaccaguagguacuaggcuuaauaccugggugauuaaauaaucucuacaacaaaccccaugacacaacuuuacuuaaguaacaaacuugcacuuuuacuccugaacuucaaaguuaaaaaggaaaaagaauuucucauuucaaucuuugcuuuugauuuuuagaguggcagauaucugccucaaacuuaugugguucgagaagaccuaguugcuguggaggaaauucgugauguuaguaaccuuggcaucuuuauuuaccaacuuugcaauaacagaaaguccuuccgccuucgucgcagagaccucuugcuggguaaguaacuaauguauuccuuccuucacccuguguuacacaguggaagaaaguggagguagaauacaggaaaaaguggggaacaagucuggauauauuuucauuuccacaaaaauuucaaaagccacuuuuuuugcacauuuccuuacagguuucaacaaacgugccauugauaaaugcuggaagauuagacacuuccccaacgaauuuauuguugagaccaagaucugucaagaguaagaggcaacagauagaguguccuugguaauaagaagucagagauuuacaauaugacuuuaacauuaagguuuaugggauacucaagauauuuacucaugcauuuacucuauugcuuaugcuuuaaaaaaaggaaaaaaaaaaacuacuaaccacugcaagcucuugucaaauuuuaguuuaauuggcauugcuuguuuuuugaaacugaaauuacaugaguuucauuuuuucuuugaauuuauaggguuuagauuucugaaagcagcaugaauauaucaccuaacauccugacaauaaauuccauccguuguuuuuuuuguuuguuuguuuuuucuuuuccuuuaaguaagcucuuuauucaucuuaugguggagcaauuuuaaaauuugaaauauuuuaaauuguuuuugaacuuuuuguguaaaauauaucagaucucaacauuguugguuucuuuuguuuuucauuuuguacaacuuucuugaauuuagaaauuacaucuuugcaguucuguuaggugcucuguaauuaaccugacuuauaugugaacaauuuucaugagacagucauuuuuaacuaaugcagugauucuuucucacuacuaucuguauuguggaaugcacaaaauuguguaggugcugaaugcuguaaggaguuuagguuguaugaauucuacaacccuauaauaaauuuuacucuauacaa

SEQ ID NO: 192852 - RNA, 683 nt, Homo sapiens
cggagacacgugaaggucggugcggaguucgucucugcaagcuuggucgcccugggauggauuccuccuccucuuccuccgcggcggguuugggugcaguggacccgcaguugcagcauuucaucgagguagagacucaaaagcagcgcuuccagcagcuggugcaccagaugacugaacuuuguugggugaggagccuggggcugggaccugaacacuguaccuacuuucccucuguccuuguaccgcgggacucgcgacaacgucggggauucgggguggggggcgggcaccuggcagcaacccuugauuuucucagguuccuguggccuagccggaugggagaagggugacuccgcuucucuggggacugucauuccggaccucggcuuuguugguguagaggacuggguaucaaagaagacuuaugccacuggacacccagcacuuucaggcacccgagguugaagcugccuagugcuggucaccaagacugaucggagcccccaguacugggauuuuauuuuuggcagcccgagucccagagagucagugaaucagugaaucugcuauuccuggacuccucgggauuuaccuucauuacccaguucuaacccucuccgcugaaaaaugaguggcuccagcccaguaacuauaaaagugguguaaucucuuccaacgua

SEQ ID NO: 192853 - RNA, 2963 nt, Homo sapiens
cuaauguccuuuuucuguucuaggaccccacgcaggacaccaccuaacauuuagucaucaugucucuagacuccuuuggcuguggcaauuucucagacuuuuuugaugaccuugacaauuuccgcacuacuggucaaguauuuuguaaaaugccccucuugggauuuguuauuuuucucauuagauaggguuauggauuuuuagguuuaagugucauuuucaucacaccuuaucaaggguauauaucaacaugacucgugacuguugauguuaaccuugauuaccuggcugagguagugcuuguuagguuucuccacuguaaaguuuuauugcauuuuuucuuugagguacaaacaauccaauuacacucuaaguuauuuuaaaauauguaacuaaguuauugacuuuagucacgcugucgugcuaucaaauaguuggucuaauucauucuuuuuucuuuuuguacccauuaaccauccccaccucccgccaccagaaguucucagcuucugguaaccauccuucuacucucuauaugacaaguccacuuguuuugauuuuuagaucccacaaacaagaacaugugaugcuugucuuugugugccuauuucacuuaacauaacgaucuccaguuccacccauguuguuguaaaugacuggaucucauucuuuuuauggcugaauaguaccacuguguauaggugcauuuucuuuuucccuuuuuuuuuuuuuuuuuuuugagauggagucuugcucugucgcccaggcuggaguacaguggcgugaucucggcucacugcagccucugccucccagguuccagcgauucuccugccucagccucccggguggcugagauuacaggcccacaccacaagcccggcuaauuuuuguauuuuuacuagagacgggguuucacuaucuuggccaggcuggucucgaacuccugaccucaggugauccacccgccucggcuuuccaaagugcuaggcacaagccaccgugccuggccgcguauagguacauuuucuuuauccauucaucccgauggacacuaagguugcuucuaaaucuuagcuauuauaaacagugcuacaacaaacauaggagugcagauaucucuuugauauaccgauuuucuucuggguauauacccagcagugggauuguuggaucauaugguagcucaacuuuuaaauacucaauuuccuaauaagcuugccccuuuagccagaguucugcugcugcuaguuugcaguucuuaauaggccaaaaccuaguuagaaccucugucuucuaaacaaguuauccgaaugugaaaagguauaaaaaaagcauucuuuuugccacccugagaucaaaccacuuacugcauccaaaugagcacuaaagucauuccuuaauacuuucuggagcuaaacugcacaagaagcaaagugccaaaagaaaugcuguguuggagagaaugcuccguuccaaucaucgugcuaauuacuuuaagaguuagccaaaucaccuaagguuugagaguaaacagaaacucgcucagccugagaauacagaauucaggaggcuagcagaaaggccuaaauggcuauucuauaagaguuuuaagacuucacgagaacagguaguugacugcagauuucugugaugagaaacaacagaacaauucuuagugcaaccaacaagcgaggauucagacauauugacagauaaggaacaaggcaaaugaaaggauuuaccaguguacucacacuucaguucuuaggaaagcagggcacauuccucaauuuuuugccucuucagaagggaaaggauaaaaaaucguaaacacugaaauagugcaguauuguggacuagucagacaugaguugcauucccagcuccaucaccuacuagauauaucagugcagugaaaacuucgcuaaacuaacgcuauaccuauaucaugaaguguguggacuagagacaagugcauauccuuacggcaauuaacugggaaacgucaaauaguaacuaccacucaccuuuuuccggaaaaucggcuuaguuugcccaccauagccacucugcuuccugucauaacgccgcuuuccugggaaaacgaauugguauuuguuauaaaauacugaagaucagcaaguaagucuuacagguuuuaucuuaauuucgcagcagaaauauuaacgcucaagccaggcguggagggagagagacccggacucguauguuauucuacaacacaaaugucacauuaacaccaaauuaugcggaauccaucuuacccugggcguacagagaauccuugcccuucuuguacugugucacuuuaugggguuggugcuugccacacuucuuacagaaaguccggcggguuuuagggacguuaaccuaguaaagaaacaguucagaacgugcaauguuauuugaccacaauggcacaacgcccuaccuuacccagcuaaagcugaggcacuccaggaggacuccucauuacuugcuaccucugacuacagggugggccagccccaugugcuucaagcagagcuuccucccuccgucgagccccaaagagggaagagaccucauuaacuccacccccggcuaacucuaccucuuugaacccaucacuucaauuccuggccccguagcccggucccuuuaggguugaucccggcaagauuggguugcucugauauaucgaguccacacaggagccuggacccaucccggcauagcacgggcgacgaagggggggaaagauuaagcuggauguuacucggcccccaccagcaaguccuaccaugcuugcgugagcgcuaucggcgcggaaagaaagaaaccgcgaggcaaacggaaguauauaggagguucccgaucgcacuuccucaugggagucgguaggagcaaucauagaguguaaggcucagcgcagcgcccucgggcggcugagaggacuc

SEQ ID NO: 192854 - RNA, 2884 nt, Homo sapiens
cacgugaccaagagccgccuagagcacaaguccugcuagucgccuccgucuggguaccagcccccuauuacucugcaggcgugugaagaaagaaggaaacuagcucggaccgugcaggucggugcgagggugggcgcugcuugagaggagguauggguggaagagggccaagaacgccacagauccgaguucaggccgaucacagcugggucccuuucucgccuacuuucuaaauacugcuacccacccccaccccaccccgugcucauuuuaguagagagaaguggcggguuucgggugggggugaggggagugaauggcguuuccagagacuccgagaaaagaaagguucuagugucccgggugcugguccguccaccaagcacuccguccccucggucccuugucuguuugcagguuuguaggucuguuggccuguagguuucggcacaaguuucagcgagagaaggagaaaacugccuugguuggaaccuugcaggucagugugaaggugggauuagcccaggaccauggguggggguggcggaggaggggggcugggauaugagagggccagguccgagucgcccucuccuggccccuucuuucuccacacccacucccauuucagugcagggaaagggguguggcggccuuugcuggggaaauggcggacgacaaguggggcggaggaggccugcguccggaaagucaguagaguaugagaaauauuuuaaacucaagugucuaaaauucacaaaaacagaaauugggaccuguguccucaguucauccacuacacuuucauuucuccauugccgccuaccugucuuugcauuuguccuucugccagacucuauccucuaucaccguggagggaccacugacaacagaagacaagggaaaacgaaggaauuuaucugacuuugguagagguuaaugagagaaacugcccuuaaucuuuggggguggaggucugguguaggagacuaccugagagguacucacacugucacccuccuagcuaucauagcagagacccaucuccugcccuucccuguggacccaggaagagaaaugggggcuccugaggucgauagaggaagacagaaaagaaaagaacaaagaaauuguauccuguuaaucugccuuuaucaccaacucgaaauccacccugucugugaggcacaaagccaaacauagucccgagcccuaauacucuguuucacccacagauucaucacaagagagcuacaagagccuggaagaagcugaagacugcuacccuccauccuuacucacccuggaccugagagaccucuucaaucagguggagcaaggcccucuccuguccugccccaaggcuggcacagacuugagcaugggccgggcucgggaaguggguuggauggcggcaggacugaugauuggggcuggugccugcuacugcguuuacaaacugaccauaggaagagaugacagugagaagcuggaggaggagggggaagaggagugggacgaugaccaggagcuggaugaggaggagccugauauuugguuugauuuugaaacuauggcucggcccuggacugaggauggggauuggacugaaccuggggccccagguggcacugaggacaggcccucagggggaggcaaggccaaccgagcacacccaauaaaacagcggccauuccccuaugaacauaaaaauacuuggagugcucaaaauuguaaaaauggcaguuguguucuggaccucuccaagugucuuuucauucagggaaaacuguuguuugccgagcccaaggaugcgggcuuuccauuuagccaggauaucaauagccauuuggccagccucucaauggcuagaaacacgagccccacuccagaccccacuguuagagaggcuuugugugccccggauaacuuaaaugcgaguauugaaagucagggccagauuaagauguacaucaaugaagugugucgggagacugugucacguugcugcaacucauuucugcagcaggccggauuaaauuuguuaauaagcaugacaguuauuaauaacaugcuugccaaguccgcuucagacuugaaguuuccuuugauaucagagggaaguggaugugcuaagguucagguuuugaaaccgcugauggguuugucugaaaagccagucuuggcgggggaguuagucggugcccagaugcucuucucauucaugucccucuuuaucagaaauggaaacagagagauucuccuggaaaccccugccccauaaacggcccucucgaacacaaugggacggaauccacccacaacgcgcuugguuugcagaugucaaagaaucugcagagggugcuacugaagauccagccuuagccaaucaccaccucauugggugaaaguuccagggcucaauccaggaccacacucuuauuggccaggcaggggcucccacagagcuuugaguaacuucuugguugugcagucugcaggcaauguuggcauuguaaauuccucccuugcagccuccuucauguggugaggggaucacuucagcugccugcuguggacaaagaacaucaaauuacagcaucacgagugcuauuguugccugugguggucucccuguccaagcgggaccgcuuugcagagaccagaggcauaucgcggcuugagcugaaaaugcauuuguugcagcuuagguugaauuauuuuucguuugcucuuucuucuacacgcgccugauggauagugaaccuauucaucaaaaaagugcacugcucuucugucuauuguaccgacuuaaccucuuccacccaaguccgcaucuguguguaucaucaauaaaguugugugcuuugauuggcagaaaaga

SEQ ID NO: 192855 - RNA, 4596 nt, Homo sapiens
cuuaaagcccugaccgucguucuccguccuccucuggguaccaacucuauugcgcagcucgcugccgugcguuuaacccaggcgaggaggaggaggagaaaauucccccagauucgggcaggugggugugagggugggcacagucugggaccccugaauaggguaaucuagggaugcgggagucggaggccgcgggugccucggucucccccacuccuggccggcuuuccagaccugaggugcucaaacgcggcucauuuuggugggcgguggggaaagggggagggggaaacgaaaagacuuuugauagacuuuacgaagaauccgcuuacuuccuuuccagccaguguuuuuugguuuuguuuauaauauucaggcccgcaccccacauuccguccuguuuugagaggaggagggaagagaaauaaacguggcagcgcauagaaggccagcagggagguugggaaaggguaaccaggaggcggggguggggcaugcaauuugguaacaaucugggcggcacacucccacccugacuuuccccaccaccgccccggcacccucccaucccccagccgacccucugugauuugggagugcugggaaauggguguaccagcugcuguuggagagguggcggguuuggcgcugucugggcuucacgggaggugggggggaaggggcggacccugagagaaucugguauuaaaccgccuuguuaacucgcagacugcuuuccagacaccuccggcccacacagccguucaccccccgucuuuucaguccuggaaaaggaauucggguaugcaggcgggagaaauggcgguuguuggggggauuugugggaagugggagguagagcccauagcagagaaaucguggaaaaucucgacccugaacccgaaaaggcagacguugaggccccucuucugcaggcuaacgcuaggccuaggggcuggggagcgaaagaugggugauccugggaggggaacacugaauuguuuggcaggagucccccauaccgcgucccauccagcuuuugcugcacccucgccccgcuccccucccgcuucguugcaggagaagggguguggcgguguguccuggagaaauggcggacgggggcggggcaaagcggaaggagggauugagugccuggggagccugcgcaggaggaggauugaggugggagggguggggugagaagaguugaaggaauugagagguagaaucauuugacauucugaugugcaaacacgaaaaggcaguuacugagacccuuguccuggaugcugauccauccaccaggcuuucauugucuaacgucgacagucuauauuucugcucuucagucuguccuuaggaugaagcucuaacugaacugaaguaaggagaaacagccuugaaucuuuggagggucagugcugggguuggaauugucuggggcccccugguguggguguggcagagacaagaguagaguaugggaccagaggcuccuccugcaucuucucucuuuuaauuucaaagacacccuugccccaggcccuuucuuuuuggugcagagaaaggggcguggcaucugccuuaguuaauauuugggggaggagaggcugaagaggaaaagaggaucccugaggggggaaaaccuuugacccacaggggcccaaaucaggaaaagaaccagaauucguccaccaauggcucaaaaacgcccuuucugaucuguccucaggucugucuuccuuuugggcucugugcaacugcagcuacaguggaaaaaagcaaacugcucuugaucccagguugguaugugcaugagcaccauguaggggccuuggggguaggggguggggcaucauagcagaaucugagaucucuacuguuuuuccagcucucuaccagcuuuacccaugucuguacugccucucguccuuccauuuagaugcuggaaguuguaggcauuggcagagcaggcuaagguugaagauguagaaaacguuaaacuaggucugugaaucagcaaacacaggccuugacaccugugucugggugcuagcccgccaacgaagcauugugucccuaaacucuucucuaaguagaacugguuagacacgaagugagccagagcccuaagccucauuuuuauccuuuaccccuaggcccugccuaagccucagcagaacuuguaagccuaaacugaagagccucacccggacgagcaggcaucccuuaaccuuaagcaauccaguuccacgcccuggaucagugaauaaccccagcugcaccaugagccgcguucgggaugcuggcuguguagcggcggggauagugauaggggcuggugccugguacugugucuacaaauacaccagggggagagaccagaccaagaagagaauggccaagcccaaaaaccgggcuguggcugggacuggagccagggcuagagcugggcuaagagccggauucacaaucgaccuugggucaggauucagucccccaaccccaguccgugcugaagcagaggacagggcccaggaugaagccucugcucuggacacaguuggagcugaggcaguggccccagcugcauccagcgcugaggcucagaguggggcaggcagucaggcccaagaggcagauggagccgggguugggccuaaggccgaaucaguaguuggggcugcaauggcuucugcaauagcaccaccucccggggugacagaggcccuuggggcugcagaagccccugcaauggcaggggcucccaaaguggcagaagcucccagagaagcggagacuuccagggcagcggugccuccugggacaguggugccuaccgaagcggcagcacccacugaggugaccgaggguccugggguagcagcaccuaccaagguagcugaagcucccgggguggcaucgccuaccgaggcagcugaggcuccugugcccgcaacgccuacuggggcugcagcaccuacuggggcugcagagucuccuggaacuucugguuccccuagaacagcggugguuccuggaacaucagcugccaagaaagcaaccccuggggcucacacuggggcuauaccgaaagccacaucagcgacuggagcgguacccaaagguggaggcaaggguguaaccaggucccggaaugggggcaagggcaagggcaagaaaagcaaaguugaaguagacgaacuggggaugggcuuccguccuggagauggggcugcagcagcugcugcagccucugcuaauggcggacaggcuuuccuggcagaggucccugauucugaggaaggggaguccggguggacugacacagagucagauucagacucugagcccgagacccagcgcagagggaggggaagaagacccguugccaugcagaagcgccccuuuccuuaugaaauugaugagauucuggguguccgcgaucucaggaagguccuugccuugcuucagaaaucugaugauccuuucauccaacagguagcuuugcucacucugagcaacaaugccaauuauucaugcaaucaagagacaauccgcaaauugggaggccucccaauuauugcaaacaugaucaacaaaacugauccacacauuaaggaaaaagccuuaauggccaugaauaaccugagugagaauuaugaaaaucagggccggcuucagguguacaugaauaaagugauggaugauaucauggccucuaaccugaacucagcaguucaaguaguuggacuaaaauuucuaacaaacaugacuauuacuaaugacuaccagcaccugcuugucaauuccauugcaaacuuuuuccguuugcuaucucagggagguggaaaaaucaagguugagauuuugaaaauccuuucgaauuuugcugaaaauccagauauguugaagaaacuucucaguacccaagugccagcaucauuuaguucccucuauaauucuuacguggaaucagaaauccuuauuaaugcccuuacucuauuugagauuaucuaugacaaucucagagcagaaguguuuaacuauagagaauucaauaaagguucccuuuuuuacuuaugcacuacaucuggaguguguguuaagaaaauuagagccuuagcaaaucaccaugaccucuuagugaaagugaaaguuauaaaacuagugaacaaauucugauugguuauguaccgucaaaagacuugaagaaauuucaugauuuugcaguguggaagcguugaaaauugaaaguuacugcuuuuccacuugcucauauaguaaagggauccuuucagcugccaguguugaauaauguaucauccagagugauguuaucugugacagucaccagcuuuaagcugaaccauuuuaugaauaccaaauaaauagaccucuuguacugaaaacauauuugugacuuuaaucgugcugcuuggauagaaauauuuuuacugguucuucugaauugacaguaaaccuguccauuaugaauggccuacuguucuauuauuuguuuugacuugaauuuauccaccaaagacuucauuuguguaucaucaauaaaguuguauguuucaacugacaaaa

SEQ ID NO: 192856 - RNA, 15794 nt, Homo sapiens
ucaaucagaaagcccuuuucauugcaggagaagaggacaaagauacucagagagaaaaaguaaaagaccgaagaaggaggcuggagagaccaggauccuuccagcugaacaaagucagccacaaagcagacuagccagccggcuacaauuggagucagagucccaaagacauggguaaguuucaaaaacuuuagcauugaagauucaagaggacacaggaauucacaagagaauuuccaacuuugggguucggggguuccaugguuuaaaugagucguguuuuggcacuuguuuucuuuuuaaauuccuuaacauucaguuagauuaacuccuucuccgcuguacuaagcaugaugcuuuauuaccaaagaauuccagcagcacguggagagucccacagaucucuggagagagugcccagcuggauggauguggucauguguccuccuacccccucacuucccucuaucuucucuuuucccuugguuccaaggcccuggcaacgguugggucagcuugcccuccugguucugcuggaggccacugagcacugucuagcccucagauguacaaaauaacugcuugcuugaugcaaacuuugaaccauguuuggcauuaauaggaagcuggggaucgggcaagcuggacucaggcuuggcuauggcugaggaggccauucucagguucaggaaaugaaaguaaaguccucaauggcuugaccaugggaaacagauauggguaggaguguguguguguaugugcauaugugcaugugugugcacauauaggguugaucauuucuagcaaauaucacagacacagcuuuccugaaggcucuuugcugugacaaggaggaugcugggacauuagggcucuugcuaaguuggcugaguauugagggcuuuucuagguuccgugaacaaagacagaagcuaugaaguucuggugguaguuucuacucagaguaaugugugcagagcacaagggucuuugucccuauuggacuccacagaguccuguagacauugcuaacauuuggcaaaacaaagauagcagcuuaaacacauccuaaaugaaaugagacucaguugccccauguauucccuaucaaauguagcauccaguagacaacauccacagagaucaauuugcaauuauacugagcugguucagccuuuagguuguuucaucaugaaacacagagagaacacuuugaagcauguguucagguaaaacaggagggagagcacuggacagggagucggaaaaaucagauucaaaucccagaucugcuacuuaugaacuaugugaccuuggacaggucacugaaucaccacuuccucaucuggaaaauggggacagcaauaacuacuuugucuacuuucaggguugugagaaucaaguaacaauaaugucaaaguccuuugaaaaugggcaagaucuauaacaacuguaaaucaugauaauaccuacuauuagacaauaauguguauacaggcgaacucuuccucuuuccagggugguuggguuuucuuugcgugcuugggucagaaucauuugaccaauuaugugugaccagaugagaggugaauguuggaggaacucaauuccugcccuggguaacaucaggaauccuaucuaaugucagccgagcugacuggauagguugugcauuaaaaacagagagggaguaaagaaggauguugaauauuacuuccucaggggaugaaaucccugaggaaaggcaggaacaaauaaagugaccacagggacaauugccuguuauggaggcugggugguuuccuccagaggaagagugccacagauaagggcacgauugaggaugcacauugggucccagguccuaaggguggacgauacuugggccagguacauaugauggagcagccacugaguuuucauuuauucaauaacagaguaucuaaaguacuuugaauuauagaucaucucuaacaagguacuggacugccacuacuucugauguggagugcacugcuguucaacaauugcaguaaacacauuguaucauggaauccgggauuggaaggaacuuuagaaguugucugagccaaccuucaaugcgggauucauuuuuacaacaaccaauuaaauguucguacagccucugcuuaaucaccuccaggaacagggaacuuacuacuucaaccauauagaaucccuuaggauuggaagcaaggaggaacacugauucaguagugucugcacaaaagauuuauggggaaaaugauagcucauuaauuuuugccuugauuuggaaggggaauguuccaagugagucuuugggauaaugauggaaccagaaaggagcaaaagagcaguagcugauuauucucugcucugaaacacaaugccauuauugaacagcaaaacauugucugcaagccuguugucgucugagaacaguggcuguuacccugguaaccagacugugaugccuccauccaaaaguggcuguuugccaagcaguguaguuuuggcuggcuugcaguaaguggguguagcccaggcaaaaaguguggcggcagagcggggguccaguuuuauaaaaugcccgaagacuaacugagucccaucaaaauggcaagaaugccccaagaauaccaggagccaaaaauaaaccagaucccagccagcauguucaccuagucuuccuggagacacugacuaaaauaaucaagugcagccuucucuaccucacuucucccuuuggccgugcagagccagaggaguucuuggaaagccaggcaguuugaaaggucuacccugcuuuagggggccuugggcuuggcucugagcuaggaaagccagaaguuuacuuaacaggcugacaacuggaacugcucucucagagcgaucugaguaauaacaaccucaacccugggaggugggugggaggggaaauauagucuccaaacccauuaagguagaacuccagccaguaacaucacuuucccccauugcuuuugucuaucguccugaagccuugaaagccauccccuggguacaggucuuugucuugaaagaaagcaacaguagaaaugccuucccugcccacagcacuucaggucuaaagaagaccaagugaggacagugacaugaucaggaagggucacagcagccaugguaggugaauggagcagcuuuuccuuccuuuccugcuuucagagccuacucagugccaaacuuacaucaaaagcucagcaaguacugauugauuaaucccucuugccuacggcaaaauggcccugagggcuaucucucagcucugcacuggccucugagcugucugccaggcagggcucuagaaaagagucccaaggaagagaauaagguuccccaaaucagcuucacacugcaacaaggagagaggaggaaauggugggagacugaccugaggaacaagguauggcuacuauugucucuaguaccaguuacuucccuuucaucuucccauucgugggcaagguggagacaaugugccaaggauaaguuuuaacaaucaaaguccuaccucagcuucccaaugcuugcacauaaauuggaauguguacaucauucauucugucucucucugugugugugugugugugugugugugugugcgcgucugaagaggaguggggaguauaggaaacaagauaguccagaugcuguugccgugguaauacuaaaucguguccaaagaggaggcugagauuccuuuuuaguuaaccuuguccacaugauuugacuauccagcaggcuuggauucccaggccccagagacuucgggacuguuuuccagcacuugaaugugguauauaagugcugauaucaaaagggauauguaggaaagacaagauuauaggcagggcauugucugaccaggacgaggcccgaagcaaaagucuuuguuugucucuggcaccucuugauaauuguuguuuuacuccuagaacccacccacugauccccauccaucccuaguaccagucacggcugcucuagcauuucggccuugucaacuacugcaggcccugaucaaggaggccucuguucaugggguaagguuaagggguggguucugggaggaggguaagacuguagugcagauucgagaccuagggagguggggccaguuucucacucaaugagccugccuguuguuuagcucuauuguauaggguucuucuaucucucccuuugucagcuggauucaagggacaggcugggaauugugcaggguacaauuggucucuuucuaccauuccuuucgaugaaagcccuuccucuccuuccuuugaugaguucccagauucacacugaauuuccaucauggagcugguccuugaggcgggcccagggcaugggaaaggagggagggaggguugggagcucuuggugccugcuuaaagagacagcaucaggaucaacacagucccuugaugaaccuggaucuguguaagucacauugguucuguugaucucugucagaccgcugugaagagcgcuggugagaagggcuuaaaguuggaguaucaacuaucacagauugauuagacuuguuuugggaguuuguauacaaauguagccaaccaugacaugaucuuuucccuuugcuuacauuuugcccacacaacuucguuauauccauuuuaacacuugcuuauagguagcuuuagauuuugauucacagacauauguuuguucaccccaacaggauuucaaguuuucuaaagaaagggacuggccuuuuaauucccuucuguuucuccuaaugucuaugucacugcuagugugcuuaauucuuguacugaauucacauaaacagaaaugaaagaaaaacacuggagggggucauuauuuuucucuaugaccuuucaucaaagucagguggcuuaaucugacugaguugcauugagaaauguuauuacuauaugguucuuuuaugccaacucucucaucucgcagucuguacuuagacuggaaaugugagaaugucucuugagagagccaaggaacuucuccccuagaaucucuuccagccuucuugaaucaaacucacacccuuucaaccaggagggguucugaaauggagagcuuuuggcuuuaggcuauuguucacacauacccaagggacauuucuuggacugugaaaaaucaaagggagcccaauggaucuuuucucagaaugcuuugauuguccaacuacuuugaugaaaaaauaauuucuugcaggcucugaguuuuucucaguuagaaucuaaaaucugauucuugcuuggacagacugacugagauucuucacuucugcugaacuuaaaugcccccaaagcaaacauuucaucuagguugugaagagaugaacaucugaugcuuaugcugauauuacugaauuguuuauagcuuaauagugauagauuuaucuaaagucauuuauuucagacuuuacauuagaaacucauuaaagccuacuucuuucuugucccuugcuuugagcuguaguggagcagaaaaggggaugcuaaguuauucaaguucuaagaaaauagaggaaaaauggauguaaaaagaaaggcuaugaucuggugacucagaauugcuccuaaggcuuagccauuuaucacccaguaagaacacaauccaugacacucucagguuauuuggaugaugauugagggaucagauacacucaagaggauguuucccucucaucuuugcaacccuagagguggcaucaccuaacgcuuaaaguggaguucucuuuuggcuagcaagaguucaaguuccuccaucccugaccauaccugcacaagcacuuagcccuucccagaugaaaaugcugggaugagugaguaggcccaagauggucacuugcuaggguggauggcucuucuuacccucggcuaaacaaacaguccugccauuguucccugagucugacccccuccccaccccccggcugcaggccccuguggaauaccaaucaggcuccugagaucucaggaaagaacaaggcuucuuuguccgggggagcuauggagggcucuguccaagcccugacccugugcuggggagaaagggaacaguggggucacugaccuucuucuccccccauccccaggcuucagagacuuucuuuacuagaaaagucuaagaguuuggggguggggaggaguuggauaggcagagaaggaaaauggcaguacuguuuacuucuaagcuccuuuucuugacuuauaggcugaaucuaguaucuuaaccuguugagaaagaggaagaucaauuucuggaauguuuucugagaacaacaaucgauuucaguuguuguguuuuucucugugguauacauguguguaugugcacauuuguacacaugcaugcaugugcgugugcacacacacagacacacccaugggccagcucugaaaagacacucuucccaagcacguuugcaaaguucaugcugaguaaacucagccuccacucacagcagcacagcuacagauugcuucuuauagaggccaaguuuccuggcagcaaugcuuuaguucuuggaaaaggaaguucugcuccaaauguuagcugcuuacuuuguuuggcuugggcuucugaggcucaucuuuggugugacacucuuugaaggccaagaaagggcugucauuucaggggaugguggguaauaggacucacuccuuuugugucucugagaacagaggcaaaugccucuaccucgauuuucccaugacagagauaauuugaucuuuccaaaucuguucacacugaugcaauucagccauguaaaucacuagguauucaugcucucugggcuaaaaacaaacuguaacuaauguuaacagaaucaggaaaaggaguccccuuucccugguacccuauagaaaagugaguguggcuuggagaaaugcuugaauacaaaaauccaagccuaaguaauuaauacaauuuauuuuuauuguacaagcugucacaaccugcuuauucaaaaauagcagcuucccaguacauuugcugaguauuugugugugugcauguguauacuguguuuauagauauauaaaaucaguggguauauauacauauauuuauauauauacauacauaugaauuaagacauuuuuucugaagagcuuaacauucucauuucuucuacauuuuagggaucuggccgagaggccagaggaagccauucuuuuccucaucuagucagucaucuacuuggcauuugcuaagguucacuccauaugacaucuuagagcaugggacuaguacuuggaacacagcugcuuucagagccugugacuucuugugugccucuccuguuucucagcaacacuggcauagggccugggauaccaggucuggggaucucagggacucuuagcacuuuaagacacauguguucccaggcccugguguguuccucuagugccagaaagauguuucaugcuuugcugacuuuguauaaagucuguuuguagcuguuuugacagaaucucagcguauaacugaggguggggacauuagccaagcugcauuauaggaggacaaaacugccauacaaaguguccaaaaucauuaagccugcauuuuuauuauugggaguaauaucaaaccuccuauuuuccaauuuucauuucuuguccugugcuagcuccauccuguuuggacugcuccucccauauguaaacuaagaagaaucaagcauucuuugcaacaaauacacacgaugcucaaaaauguccaggagcauccaauuuccaaaguuuccuccaccuggaaugcucuucaugcuaaaauccugucugacaauaccagcaucucuggccugcacucaucccuuccuggaacuccaagugcauuuacccucuguuaccacuuacuuggcugccugaauuguuaguugaaaauauuaggucuacuuagcuaauucuuccucaggaaauuaaagacucccauauggcagagucugugucuuuucucucuucauaucccguauaacacccagcauaaugcugggcauauagugaguauuccauaaauaguugaugaaugacuaaaauaagcaagcaaacaaacagacuagaacaauaagaaagaagggacugauuucauaaucucucuggcuugcuauuugaauugcugaauuauuauuauuuauuaaauauuuuuuaaauucuggcaauaaaagguaaggauuuauuuucuuucuuucuuuuuuuuuuucuugagacagagucucgcucuuacugcccaggcuggaguacaauggcgcaaucuuggcucacggcaaccuccgccuccuccuggguuuaacagauucuccugucucagccuccugaguagcugggauuacaggcauacgcccaugcccggcuaauuuuuguauuuuuaguagagacgggguuuugccauguuggccaggcuggucuugaacuccugaccucaugugauccaccugccucagccucccaaagugcugggauuacaggcaugagccaccgugcccggccaaagauuuauuuucaagaaugaaacaaaguaaggauucugggucaaucucacaugcugaaagccaaaaccucuagccgcuccugcuuuuugacuucggagugcccacuaucuccgagccugugagcacagggccuggcagagggguuugaguggcaugagcuaccuacuggaugugccugacuguuuccccuucuucuuccccaggcuuguuagagugcugugcaagaugucugguaggggcccccuuugcuucccugguggccacuggauuguguuucuuugggguggcacuguucuguggcuguggacaugaagcccucacuggcacagaaaagcuaauugagaccuauuucuccaaaaacuaccaagacuaugaguaucucaucaauguguaaguaccugcccucccacacagacccaucuuuuuuuucccucucuccauccuggagauagagaacucuucaguaccuuaguaacuagcaggggacugggguggagccagaccggauucccgagucuucccucugugcagaucucuccugcuccacauucgaagcccauucagaaaggaggggucugccugccugccugucagccccucccacccccgcccccuuguuuucuuacacguguucugacuucugcuaggugugguucauauugcccaaguuggagccuccagcguaguagguauggagaagccaagggaggcacuaagccucuccuguuccuagaacaaguuaggcuccuguuccuucacccaccuuucuucuugucuagcucccuacuccugugaguuagcaugucugaaggguggggcagggagaguaggucccugguucuccaggucccaggguaagcaagguguggcgggaggggcauauguuucuggucacauacacccugucuucacuuauuucaacaaagauaaggugaaagcaugcaggaggaaccuggugauuccucuagaaaaucccuagccuuguuaaggugcucgcucugguguauaccucacuuaugucgggaaagaagccaggucuucaauuaauaagauucccuggucucguuugucuaccuguuaaugcaggauccaugccuuccaguaugucaucuauggaacugccucuuucuucuuccuuuauggggcccuccugcuggcugagggcuucuacaccaccggcgcagucaggcagaucuuuggcgacuacaagaccaccaucugcggcaagggccugagcgcaacgguaacagggggccagaaggggagggguuccagaggccaacaucaagcucauucuuuggagcgggugugucauuguuugggaaaauggcuaggacaucccgacaaggugaucauccucaggauuuuguggcaauaacaaggggugggggaaaauugggcgcgagucuguggccucguccccacccaaggcuggguccucucuaggggccuggcauuugagugaggaagcgauggcugcagccgaacgagaaggucaggaagaacguggugcccagcuggcuuagccucaccuuucaaagguucccuaagcaaauuucuucucaaaacagaaagcaugaguuuugugggaugcuuuguacaaucagaccauuucuaagccaucuguugguaucccuuuguucccuuccuaguagguaccacaagaguggaucuaacuggacaagagucuaaaaugcugcucaugugauugagacuugggcaccugaucugagagggaggauggauaauaaaaauuaaauaauuaacuccaaggugaaauuuacaauguucugggauccugcacaguucgaggucccagagggaauuggaguagaucugcauguugaauguuuuauugccugaggguuauccaugcuuugagugaggugcacauuuguuuucagucucuggaguuaaagauccuuuggcggcugaacauguguggguuccagcaaugucuuuuuguggccagcaguuagcuuagaaagguuuuguaucugaaauuuuaaucuccuauuggcuuuguucaauggcuagggaacaaaaauguuccuauggcaaggaacauguucuaagcucagccuaaggcacaaaauggcacgacuuucuuucaagaucuguuuugauuucuuuacaccuuaucugcccaaaaacauccucugaagccucucuaacccagggauccuccucacucuuccccuacccauuccccccacccuccguuauacuggggccaguuaucuaguagauacugccaauuacccuuggcagaggugcccugcucacuaauuucauuugaaggagagcccuggaaccugguuuuaaugucuggcacacgccacuccaggaucucccaguuuguguuucuacaucugcaggcugaugcugauuucuaaccaccccaugucaaucauuuuaguuugugggcaucaccuaugcccugaccguuguguggcuccugguguuugccugcucugcugugccuguguacauuuacuucaacaccuggaccaccugccagucuauugccuuccccagcaagaccucugccaguauaggcagucucugugcugaugccagaauguauggugaguuaggguacgggugcuuuggcucuccuacccacuauggaagcacuauauauuugguuauuuucuuaguguaaggaggguggugauuaugagaaaaauauaagaugaugaaugauugggucuuaguuuauuaauccuucccuacugaaaccagagagguuucuuccccgggaagggaacuuggaaguggugggaguuuucuuggccauucacauuggccuacucuaguugacugcuguucacaaccccaaagcagcacauuucaauaacaaacacaagguuucaccacuguucaauaccaccuucucuuuuuuguaaaccuguagaaaagaggauccugauuguugguagaauccaacuuuacagccaggauaauuagagauggaagaagggcucugggggaaagucuccauguggccccguaacuccauaaagcuuacccugcuugcuuuuugugucuuacuuagguguucucccauggaaugcuuucccuggcaagguuuguggcuccaaccuucuguccaucugcaaaacagcugaggugaguggguuauuuggguuauuuuacaagggaguagcuaauaccauacaaauuacacccauggccuucaauuuuaaggacugaaaguuucccuuugcuggauuuugaauuagccgauugccuucuacaacauguuggcuaagugugccugagccaaugagcauagaagguaaaacaccuguuuucucuagaguugcauagaaagacuuccuuuccaacccuuccccucuuaaaagagaaguuuguagcuuuagguaaagauagagccuaauggcaaaaucccccacaugaaaauuuucauuccuuuaguuaaaaaccauaucaagaaaaugggcugugcacagaggcauucauagguuuuaugaaaacauuuucaauuuggaacuucuuuaucucaaaugagagguaaaauaaguacauuugaaagggaaagcacuguauugagaacagauauuauauacaaaugaggcaggggaauaaaaguaaauccgggggagacaggcaguaaauuauuucuuugacagcaaaauguugacuuuaaauuuugggccccugggcacaacuguagggaaccaguuaauuauuuuggaguacuguacuauuucaugacuauucugugaucuggguguuaaugggccaggugcuaugguguacacugaagacugggaggcccacauuuagggaagugaaaacuuaguuagagauguggaauuagcacacaagaaagauaucaacacauucagaaagcuguauucaugauuuacaguggagcauauuacugcuguugcaagaaacaguucuuccucuuucauuuuccugcaguuccaaaugaccuuccaccuguuuauugcugcauuugugggggcugcagcuacacugguuucccuggugaguugacuuugaaugaucuuggcaaguaaauaggccugagauaguguggguacagcuauucugaaaggcaagaagguagacugcuuccauccuugaaaugcuggagggaagcuucugggaagauagcaaaggguggaggcuccguacuucuacuugcauuggcaaggcagaaagacaucacaaauuagaugggaacaagaaaagugguaugaggaaagagguaagagauucauagacacgaaugauaauauuuaguauuuauagaacauguaauguugccaaguacuuugcagucauaaauuacgguuaauucucaauacauuuugaucagaucagugacaaaacacugaaacaucacgaaacaugacuugcuauagccuggaauucuauauacuaucaauaugaauccacuuuggauacucuccaguggauuuaguuacucauauggaaauacugggaggaccuccuaacauuauuagaauuguuaugauuauaauacaaugcuaugucccaggucuugcugauagugcuacagugcccugugaauguagugugcucauugugcagauuaaaaaccuaaggcacugaagggugaagugauuuaucugaaguuauuuuauaagcagugaucagacaagaugagcucacagaacuccuggccccuacugcugagguuuccauacagagucaaguaauuucucaccuuguaaaacgaauugauucauuaaccaggggagagcucuacugcaugauguggcugugugucuacagcaagcacccuaugacucuaagucacucggacauauugauguggcaaagccaaauauuguucacuucccugaggaaaacucagugcuagaucaaacagagguguggaauaaaucuuuaugauuugauucucugggccugggccaugagacccaugaugccucagagacaucggacuuccagucaaguguauauggagaaagccaagccugggauguacugcuuuuugcagagcauggguuuuucccuuauuuaguuaugauuuuauuucuacccuuccucauucccaaagggauuugaggagggagugcuuucuuuucuacucucauucacauucucucuucuguucccuacagcucaccuucaugauugcugccacuuacaacuuugccguccuuaaacucaugggccgaggcaccaaguucugaucccccguagaaaucccccuuucucuaauagcgaggcucuaaccacacagccuacaaugcugcgucucccaucuuaacucuuugccuuugccaccaacuggcccucuucuuacuugaugaguguaacaagaaaggagagucuugcagugauuaaggucucucuuuggacucuccccucuuauguaccucuuuuagucauuuugcuucauagcugguuccugcuagaaaugggaaaugccuaagaagaugacuucccaacugcaagucacaaaggaauggaggcucuaauugaauuuucaagcaucuccugaggaucagaaaguaauuucuucucaaaggguacuuccacugauggaaacaaaguggaaggaaagaugcucagguacagagaaggaaugucuuugguccucuugccaucuauaggggccaaauauauucucuuugguguacaaaauggaauucauucuggucucucuauuaccacugaagauagaagaaaaaagaaugucagaaaaacaauaagagcguuugcccaaaucugccuauugcagcugggagaagggggucaaagcaaggaucuuucacccacagaaagagagcacugaccccgauggcgauggacuacugaagcccuaacucagccaaccuuacuuacagcauaagggagcguagaaucuguguagacgaagggggcaucuggccuuacaccucguuagggaagagaaacaggguguugucagcaucuucucacucccuucuccuugauaacagcuaccaugacaacccugugguuuccaaggagcugagaauagaaggaaacuagcuuacaugagaacagacuggccugaggagcagcaguugcugguggcuaaugguguaaccugagauggcccucugguagacacaggauagauaacucuuuggauagcaugucuuuuuuucuguuaauuaguuguguacucuggccucugucauaucuucacaauggugcucauuucauggggguauuauccauucagucaucguaggugauuugaaggucuugauuuguuuuagaaugaugcacauuucauguauuccaguuuguuuauuacuuauuugggguugcaucagaaaugucuggagaauaauucuuugauuaugacuguuuuuuaaacuaggaaaauuggacauuaagcaucacaaaugauauuaaaaauuggcuaguugaaucuauugggauuuucuacaaguauucugccuuugcagaaacagauuuggugaauuugaaucucaauuugaguaaucugaucguucuuucuagcuaauggaaaaugauuuuacuuagcaauguuaucuugguguguuaagaguuagguuuaacauaaagguuauuuucuccugauauagaucacauaacagaaugcaccagucaucagcuauucaguugguaagcuuccaggaaaaaggacaggcagaaagaguuugagaccugaauagcucccagauuucagucuuuuccuguuuuuguuaacuuuggguuaaaaaaaaaaaaagucugauugguuuuaauugaaggaaagauuuguacuacaguucuuuuguuguaaagaguuguguuguucuuuucccccaaagugguuucagcaauauuuaaggagauguaagagcuuuacaaaaagacacuugauacuuguuuucaaaccaguauacaagauaagcuuccaggcugcauagaaggaggagagggaaaauguuuuguaagaaaccaaucaagauaaaggacagugaaguaauccguaccuuguguuuuguuuugauuuaauaacauaacaaauaaccaacccuucccugaaaaccucacaugcauacauacacauauauacacacacaaagagaguuaaucaacugaaaguguuuccuucauuucugauauagaauugcaauuuuaacacacauaaaggauaaacuuuuagaaacuuaucuuacaaaguguauuuuauaaaauuaaagaaaauaaaauuaagaauguucucaaucaa

SEQ ID NO: 192857 - RNA, 29427 nt, Homo sapiens
gggcggggcgggccuggccgggccgggcggcggcgcugcgcugacgggcugagucuggcggcggcggaagcugcagaggccaccggggcgcuaacuggguggccggugggccgcuguggccucgagcagccucuucgcgcggccccgcaccccggcaagcagcagcgggccgcgacgcccagccugccagugagcugcgacgggcacaccccggagcgucggcgacugcggacagguuagagugggggcaggggcgggcgcgggagcagcccagggccagagagggagcccgagccaggccaucuccaaccauguccgacgaggccucggccaucacuuccuacgagaaguuucuaacccccgaggagcccuucccacuccugggaccuccucgcggggugggcaccugcccgagcgaggagccgggcugccuggacaucagcgacuucggcugccagcuguccuccugccaucgcaccgacccgcuccaccgcuuccacaccaacagguacgaacugcaccugagggcagggguggauuuuccacuucuggucgccccccgcuccugauccuucgucccgggcugcgcuuccagucgcccccucccccaccugcuuucgaccagcgcucauucccggccuccuucccugcccccccucccuauuuucaccccugcccuccuauuuuccuuucgaccggcguuuuacucucuuuuccucauucauauucuggcuauagcgacuccucccuucccuaccuucucccucccuugcuucccuucccuccccccaucuguacccuacgaaucccaaacccccacccuugauuuuuagauacgccccuguuugcauccaucugcaaaaguuuaaccccuuccauuuccgguacgcuguagaggaauuuggauggcucaagaucaauccauagaucuuuugaaaaguggcguugaaagguggaacauuuaaagcuagaagcuucauuuucccuauuuuuaaucugucucacaguccuguuccccccgccgccaccaccccuaccccauuuuuuuuuuuaguugagcgcuaggaaacuagucgauucucucuuuuuuuccuccuccuuuauuaacuguuugccuuagcgcuuuaggcucugccaaaauugguaagcuuaaaucuggaggauuccuucauaugacauaucccuugguuuccuuccccuuugaagagacagaguaaggcuuaggauggacugacuuacacaaauuuauucagaggguguaucuccuccuaacugauuucaguagaagguaguguucuggagacuucucucaugcaagcauuuacguguuagaucaaaucuugggggguggguugaagacguucuagauacagccucaaguuuuaacauagguggauauuugagauacauauacaaagggcugggggggugugugguuaaggcucuaggagagggguucagcuauggaaaauacuggagauaaauuaagaaaucuaguucugacuucugauccaaguuuaugaugugaguuugaucaaauucuuccauauuuuaaugucuuuagcauauuucuccccucccuucccuuaaaucagucuguagauugaaugagcuucuaccagauacaaggaauguguaaaagauguuucuuacauaaaugaaaguuauagucuauggaaacaagguguuauaguuaaauaaucagaauaucaguauaacacaucucaaaaggaaguggcaguaaauuuauuaugacuacucuaaaucgucauugcaaaaaaugaagaaacaggcccagaaagaaaagauugaguucaaggucauaaaaccuagucaagcaaauccaagacuauuccuuugaagccaaugauuaaacuuggagcagaacuaauugauccaguguuacaaauagaacuuaugguuuccuagaccaacucacagaagccuauuuaaccccugaugucacuguaaugugaauguaacauauucaugaaaucaagugugcuuaggguuauuuauguugaaaaauaauguaaaagaauaccuuuguacauauuuggcauuuaaguuuugcagccuuggagcaagucacauacccaggaaaguuaaauaauuucagaaugauccugcugugaugaugagggcaagggagugagggcagaggcuguggguaaguacugccaaaacuggguagaggugauggggagugaaguuaugagaauaauauguuucuuacaacuuguucuguuccuuccuccuccccguuuuuuccuguguuuucuuucccuuaaagacuguggugaggucaggacuguuuuucaauggggcagugaggaggggagaaggagguucuuugcaagccccaguuuuuccaagucaagcauuuuuccuaguuacugcuugcuuuuuuuuuuuuuuuuuuuaacuucccucuccuacccuacuuuucgcaaggcuuggcaugguggcagggguucuaaugcucuguauccuuuucagcagagaguaggggaagcaaaauuagcgauauucacagcacaugauguuucuguccuaggcuaccuugccuuuuaaauguauuauccuucugcaauguucugcuuucuuaccccuccucaagauggugcuugagaggaccauaggcuuccagccauuucuuuucagggagaagcacacagcuaaaucauauaucgggcaaaguuuagggaguucuuuuauuuuggaguuguaugugucacuuuuuuccuucacaucacaucauuugucaauucaggcaacaacccaaaaaucagauuucaaauaguugagugcugaaauucugccuuggguuuagugauuguaaaacaaauuuucauuggaaguaggaagcuuguuaauugguagauauuugacuuaaccuuaauuuugcuuccuucuugguaccugauaagaaaaauguggagauuuuaaaaauaaugcacuugauaaggaccuuaugauuaugacaauuuugugccuacucauuuacuggauucugggcuauauuugcaauuuucauuaacaaagacagucacagcacuaacagucccugagguugaaugguugcaauauucagauuuuuuuuuuucuuuaaagacagaguccugcucugucauccaggcuagagugcaguugcacaaucuuggcuuagggcaaccuccgccuccuggguucgagcgauucuccugccucagccuucugaguagcugggacuauaggcguguaccacuaugccuggcuaauuuuuauauuuuuaguagagacaggguuucaccauguuggccaggcugaucuugaacuccagaccucaggugguccacccacguuggccucccaaagugcugggauuacaggugugagccaccgcgcccggcccaguauucaaauuaaagucauuugugauguagguugguaugucacuggucuagguucaguagaaaauacauuacauggacacagccaguuuccuaagcauucauaccuuaagaccuacauggauuggucuagaauuuuaggaaaauagaauaaauuucaauaagccaaaaaagugaaugaauuuuuuaaaaaugugaaaugucaguguggaacauauguaguguuuaagacauuuucuuugguuuugggggcagugauuuucugauguaaauggagguuuucucuuagcacuuccaaacuauugcauaaaucuuuuacucaguuaugugauuuuagagcuccguuuucaaucaccauuaaccagaaaaaccuaaagacuauugugugccuuugguaacacccauaguuuuccuaucuagauacagaauuagaggugcagaagagcuguggguugcaggugggagaaccauguuggaggaauuugguuuggggacuugcugagacaaguugaaaaugggggguuaggauuuggagaaauauccaagcuagaaauacagauuugggaguaaucaguagaaguccgugacgugauagaaguggaacuacagguuacaaagguugagagaguggaagguuuucaauaaauuuagcagggaaagaaaggagaaggggagauguugugagaauuugaaagggaaauaaagguuucuuuuuuucuuuuuuuaacuucauuuaguuuuucuuuuccaagaauagagauguuagcuccuuagaagcaggccacaggaaagggagaaauugaaaauauaaaagaaggugggaugagagauagacaugaugaacucagaaguccaaaugggaucauuagccuuagaaaugacauagaguguuuuuuacuuccaaggcaauaaagagggcaggaaagauggguaaugaacccaacacaauugggguagcuaggaggaaaguagggaacuuaaguggguagaagaagggguuguauauucucuaacuuggaaccuugguggccuguuggacuccagaauagcagcagaagucagguuggcuauauggggauucuggcagagagucaguggugaauacaaguacugauggggcacuguacccuaagaaugaauauauagcauagacuucaaaugaccuucaucagcuuggcagaacuucauucaacagugcucauuggcuggauucuuaucuucagaaguggcagucaggcccaccugagagaaaagggggugcagaggaauguguacaugguacacaugcuuuucuuaauuuuaacguuuaaauggcuguuuaccaaaauaccauugaaaguccuuagucuguauauucuugcugaaacaccuugcagagaaauguucuuggcuuuauuuuuuuuuuuaauuaaaauuugggcagcaagccuaguuauugaguuaaacaccguguuucacuggaauucuuuucaacgucuuucaagauuuuggagaaagucucuuuugagaguaauauuauggugauagcuagagucgaaguguuagguaacuuucucuuaguggaauauaauguaagggcuuguaaauuuaaauaguuuagugcugagcacacaauggacauucauuacaaguuugaaacugacagaacagucugaaagaaucacacuuaaauuuuuauuuaaaaacuuauuauagaaaacugagggcauauaaaaaacuauagaccacucaugauccuuuuccccaaagguaacaacuaucaacauuuugauguuucuuuuaaugugucuauguacagauauaauuuuuaaacaucaggaucaguuugugaccugcauauuugcuccuauauuguuggguguuuuccuuuugaauaaucugaaaauaugauuuuuagugauuauaaaaauaccauucagauauaucauuuaauccucauauuuuaggggcauuuauuuucccuuuuggacuauuacaaauaguauuguuuggacauauuuguacacacaucuuuuuuccaaauuucuguuuggggaagggaacacaauccuagaaggggaauuacugauuccaaaugaaugaaccuuuuuaaacgucuagauguacauaguacugccaaauugcuuuuaagaaagauuaugucaacuuagacugucacuggcaauggaugaaaguacuuccuacuuuguuuuuaucuauauugccuuaaaauuaugauuuuaaaaauuugcaaauuagaagauauaaaaauuuugccaggugcauugguucacaccuguaaucccagcgcuuuggaagaccaaggugggaggauugcuugagcccaggcauuugaaaccagcccggacaacgugaugaaacccuuucucuuccaaaaaaaaaaaaaaaaaagaaaugugaaaauuagccaggcguggugguaugugccuguagucccagcugcugggaaggcugaggugagaggaugaaucaagcccaggaggucaagccugcagugagccauggucgcaccacugcacuccagccuugguugacagagcaagacccugacucaaaaaaaaaaaaggaagauauaaaaaauguuacaaucuuuacuaguaaaaaauacuguuauucuauuuuaugaaugauuuguucaauuaugagcccgguuuacuugcugcugauaauuaaaaacaaaagacaaagacuucuaagaacauucagaaccuugugaugauuacaaaucugagaaacacauugacuuugcccaaagguaagagcacaaaaugaagcaaauuccugacuccuuuggcagugaucuaaugguuagauuacuaaauauggcaucuuuuuuuuuuuuuuaaggaaugucacuauuacucauggagagaaacacauuucuacagaauuuuuacaaacuaaaaagaaauucuaauuaaaaacaauuaucuaacaguuuuuccuagcaccgaacauaguacuugguacauagaagauacugacuaaauguuuguugaaugagugaaugaauaaagggaaaaaaaucacauguaauuugaagacacaagagaaaaauaguuugcucaggacauaauguagauaaggcuuacuguguccagaauguauuuuuguuuuguuuugagauaaggccuugcuguguugcucagauuagaguacaguggcaggaucagcuugcuauaaccacagacuccugggcuccagggauccuccugcuucagccucccgagaguagcugggaauacagacaugcaccaccuugcucagcacauuuuuuaacuuuuuguagagauacugucuugcuuuguuacccagacuggucucaaaccaggguaugauuccucuucauaacuuuuauugcaagaccugggauaauuugguuaauuaaaaauuuuucuaaaaugaggauacuguucaccuagcgagcaugugaugaaaguaauauuacaagauauucuaggauucuuagaugaauuuuauuuuuuuuacuaucuauaaaaauuuauugacaucuacuuucuauuuacugaauuauaauaguguguguguguuucaguguuuuaaaauggucuaccuucaaaagaaaagguaccauaaaguuuuucagguuguccaaauuuuguauguaaaucaagaacuucuaaaagauuagccauacaaaauggaggaaguuaaaaaaaaugaagugcguaauuuaagaaacaguagauuuaaugaaggaugagacacgaccuaauaauagguaaauaacagacuuuucauaaggaagucauuacuucaggagcuuguuaguacuggaaauacuaaauaauuaucuuaaggauuaauucucuaugcuacuggcaaagcaaugaagauuaucuuauuaauaguauaaaacuaguggaaauuuacaaaggaaaacagauugauagauuucaagaccaaaaaaagauccaaccaaaaaacccugcaauaaauacuguagacaaaauguuaauauccuuaauacauaaagaacucuuacaaaauuaguaaugaaaauauuagcacauaggaaaacaccauagcgaaauagcuaaugaauauuuaaaaauuugaucuugcugguaauuaaauaaauaaaacuugauauaaaaauguuucugugcuggugcaguggcucaugccuguaauuccagugguuugggaggcuggggcggacagauggcuugagcucaggaguuugagacgagccugggcaacauggcaaaaccccaucucuacaaaaaauacaauaauuaagugggcauguugcaccuguggucccagcuacuugggaggcugacaugggagaaucgcucgagccugggaguuggaggcugacaugggagaaucgcuugagccugggaguuugaggcugcagugagcuguguuugugccacuguacuccagccucaaugagagaagugagucccugucucaaaaaagcaagaaguuucuguccuauaagauagguaaaaaaauuuuuagcaauuuuagugcuguuaagauugugaugaaaugagcacuuuuauauacugcccuggggaguauaaauugaugcugccuuucagaaagguguugacuaaauugauccuuagaaauguucauauucuuugacucaguacuuaccuuucaagcaacuguauccugagauaauauauuuugauaaauaauuauaaacaaugcucaucucaguauuauuucuaauauuaaaaaauuagaaacagcuuauguaucauuggggaauaaaguuaaauaaauuaugauacauuuagccaauggaauauuauauaggcauuaaaauguuuucaaguaauauacuuaggaaaauguuuagcauauuaauguuaagugaaaaaagcaauauacuaaaauauauauacacagaaugguugcugauucuguaaaaaauauguaugcacauaaaaauaaacuaccaaaauauuauagauuaguuauugcuggauaauggaauuauugaucauuuuauuauucauuccuuucuuuccaacaucuuugcaaugagccuguacagcauuaauaugaaaaaguuacuuaaauauaacaaauacuucuugaacaucuaccuguguagaugcuuguuagugcuuuucucugcccugcaauggccccacucuuccuuuaacaauaauaauagcugucauauauugggcacuuuuuaugugugcuacaagugcuguguaugcauucucaugugaucaucacgauaccuccauugggacacagacuuggagagaguguuauuugcuuaaaaucaauuagcuaggaagugacagagcaagaauuugaacugucugauuccagagcuuacucauaaccacuaugcuguaugcuuuguuuauggaugaagauuuuacuuuaguccuaauuuaaauacuacuuucuuuuaaaauaguguacuacaaaaauuuucagacagcuacaaagguagagagaaaaguguaauggaccccauguuccugucacccagcuucaacauuuauucauauacggcaucaugcuucaucuguaccucuauccacuccccaaccccugccuuauuuugaggcaaauccuagacauguaucauucauaaauauuuuaguauauuuccuuaaaagguaggggcucuuuuaaaaauacaaaaaaccucacauuccuuauaaauguuauaaauauguccuguuaauuauaucuuaaaauuguauggauucuguaguucucuugauuucuuucguguuguguuuuugaagguggaaccuaacuucuuguggaacaaguguugccagcucagaaggcagugaggagcuguuuucaucugugucuguuggagaucaagaugauugcuauucccuguuagaugaucaggacuucacuucuuuugauuuauuuccugaggggagugucugcagugaugucucuucuucuauuagcacuuacugggauuggucagauagcgaguuugaauggcagguaaguuuuuuuguccuuuucuugacauuguuacuaccgaaguagaaguauaaacuuuucuuuugauauuuucaucucuacuucaaaguaaauuucucuaauguuuauccaguccuggagauucucugacauguuuuaagguuaagaauuggaugggauaucuuuauuuuugcuaauguaccuuuuugaugcuauagauauccuuuuguagauuuuuauguuauuuaauacuugcguaauauuaccauuauuauauauuaucgguaccuuucugugcaugaauccaagcaaaguuacacuuccuacccuauaauaaauagcuuuuguguccuuauaggacaaauaucagucacauuauguaccuaauaucauaaacuguuauuaccauaaauacaugauuuuugguucugucaucagaaauauauaauuucucauuuuguauucuguuuguauguagacauguuuuucgccugacacuuuuuucuuguggcauauauaccauguaaaauggcuuugugguaaauuguuugaaaauccugccuuauaauaagugcaguuugucagaaaauuuagauuguguuauuacaacauucauauucugauuguaaaaacaauaaaacauuuaaagacguuuucccugccuacagcaaagauuuuauucgcuagauaaacucgaaugucugcuacauuugaaagccaucugaauacuugaaguuuuauuccaaaagagggauugaauauuauaauuucaaacagcuuucaaauaauacagaauggcaucaaauuuaaaaaagucuccaagucccacucuacuaugguuaccacuguuaggagcuuaugcagauauaaguauguuugcauacuguuaaaaacauaugggauuauacuucauccacuguuuggcccuaugcuuuuuuucagcuaacacaucucauucuuuuccauaacuggaucauaauuuacuuaauccauuuccuaauuauggcuauuucgguugguuucaguuuuuuguuguuauaaacaaugcuacacugaaaagaugagauuuuuuuuuaagaaaaaaaguaauucacaacccuuccauuuuuguuuuucauauuauuuggauuaaaacauuuuuaaacuuuuuaaaaauuugagaugaaauucaccauuuucaucauuuugaaauguauaauucaguaguuauuaauauacucacaguuguucagccaucaccgcuaauuccagggcauuucugucaaccccaaaagaaauccuauacccauuagcacauagucccaauucuccccucccccuuaucaccuggcagcuacuaaucuaauuucucuauggauuugcuuuuguggauauuucauaucaauggaugaauauauggccuuuugugucuggcuucuuucacuuggaauaauguuuucaagguucauccauguuguaccauauaacaguacuucauuccuuucuauggcuaauauuccauuguguagauguacaguaccacauuuuguucauccacucauuaccugaugaacuuuuggguuguuucuacuuuuuggcuguuauaaauaauacugcugugaacauucagguucaaguuucuauguggauuuauauuuuuaauucucuugaauauaccccaaagaguggaauugcuggaucauaugaucacuugcuauuuaacuuuuugaggaacugccaacauguuuuccagagugacugcaccauuuuacuuuuccaccagcagcguaugaaaguucccauuucaccacauccuuguccacacuuggcguugucuuucuguuuguagccauccuacuggguauaaauugguauuucauuaugguuuugagcaucuuuucaugugcuuauuggccauuuguguguccucuuuggggaaauaucuauucagauaccuugcugcuuuuaaaauuguguuauuuuacuuuuuaugguugcguuguaagaguucuuucuauauucuggcuacuagacccuuaucagauauaugauuugcaaaaauguuuuuauucugcagguugucuuuuugcuuguuagcauuuguucacuugauaguguccuuugacaccaaaguuuuuaauuuugaugaagucuaauuuaucuuuuuuuuggcuguacuuaugaugucauauuuuaaaaaccacuguguaauccaagaugaggaagauuuucaccuguuuccuucccagacuuuuagaguuuuaguucuuacauguaggucuuugaccauuuugaguuacuuuuuguauaugauauguaagauaggaguccagauucauucuuucuuuuuuuuguuuuuuuuuguuuguuuguuuuuuugagacagagucccgcucagcucaguugcccaggcuggagugcagugacgcaaucucagcucacugcacccucugccuccugggcucaugccauucuccugccucagccuccugaguagcagggauuacaggcacccaccaccaaacccggcuaauuuuuguauuguuaguagagacgggguuucaccauguugaccaggcuggucuugaacuccugaccucaggcgaucugccugccucggccucccaaagugcuaggauuacaggugcauucuuuccuuuuuuaagaacagagucucacuauguuguccaugcuggucucgaauuuuugggcucaagcaauccucucaccucauccuccugaguaucugggacuacaggcaugcaccacugcaccuggcucgcaaauuuauuauuuugcauguagguauccaguugucccagcaccauuuguugaaaauauuauucuuuccucauugaaucaucuuggcacccuuucgaaaaugaauuaaucauagauguguggguuuauuuuuggacucuaaauuauauuccauugauguaugugucuguccuuaacgcuaguaccacacuguuuuaguuauuauagcuuuucaguaaguuuugaaauugagauguguuaguucucccacuuugcuguucauuauagagauuguuuaggcucacaucuguaaucccagcacuuugauaagccgagguggguagauagcuugagcccaggaguucgaaaccagccugggcaacaaggcaaaacccugugucuuuaaaaaaaaugcaaaaauuuaccaggcgugguggugugcaccuguggucucagcuacucaggaggcugagguuggaagaucgcuugagcccugaaggugcagguuacagugaggugagauugcgccauugcacucuagucugggcaacagagcuauuugggguccuugcaauuccauaugaauuuuaggaucagguugcccguuuuucaaaaaagaguaguugggauuuugguagagaucacauugaaucuguagauugcuuuggggaguauugccaucuuaacaauauuaaauauuccgauucauuaauaugagauggaauaucuuauuuauuuagggccucuuuauuucaaugauguuuuguaguuuucaaugucuaagucuuacacucucuugguugaauuuauuccuaaauauuguauucuuuuuggugcuguuauaaauaguauuguuuucuuaauuuuauuuucagauuguucauugcuaguguauguauagaaauacaguugguguuaguauauugauuuuguauccugccaacuuugcuaaaaucauguuagauuuaauaauuuuuucccauguguggauuauuuaucguuuucuauauuuaagaucaugucaucugugacuagagauaguuuuccuucuuuuuuccuaaucuggaugccuuuuaauucuugcuuaauugcccuagcuagaucuccuguacaguguugaauagaaguggugaaagugagcauccuugucuuuuuccuaaucuuaggggagagguucagucugcuucucgaugugguuuuuuaguauuuuguuaaggaauuuugcaucuauauucauaagggauauuggucugcaguuuucguucucaguugugucuuugucuagcuuugguguccagguaauacuggccucucauaaggagguaggaaguguuuccucuucugguuaaaauuuuuuaauaagauuuucucauuuaagauacaaacuuuuucaugauauugauaaugaauuuuuccuuuuuuuuuuuuuuuuuuugagacaaggccuggcucugucacccaggcuggagugcagugaugcaaaaaugggucacugcagaauugaccuccugggcucaagcaauccucuugccucagccuccucaguagcugggaccacaggugggcaccacaacaaccagcuauuuuuuuuuaauuuuuuuguagagacggggucucacuuugcugcccaggcuggucuugaauuccugggcucaagcgauccuuccacuuuggccucccaauguggugggaauacaggcaugagccacugugcucagccagugucucuuuuuuuuuuuuuuuuuuuuucucaguacagacuuuguauuuaaaaucagacuacaaggauucuuaguaaagcauaaaucagauaggaguccugauaauucuaagaaauauuucuucugcuuauuuuaugugauuuauuuagaguuaucauccauaauguugcaagguggcaggcauuuuuaaauuuuaauugcuggcuucuucacucauguuaugaguaguuaagaguggaaaaccauccccagccauucaccguuaauguacaugagugacuaugaugucagaacaaaaaucagaccugccuuaguaauguguuuucccacuugugaaauuggaauacggauacucuauuaccauggauaucugcuauuuaaauaugcugaaagauuuaaagugcugucuuguauuugugggauuuuguaaucaugagcaguaaauuauccaagaauauaauuacaaauuguauguuaggauuaauauggauuaaaaaucauuacuauaguuaaaaaauuuguauucuguuaugauuaaaaacuacaucuguuuaaaucuuucuuuuuaacagaugcuuuaguuacuacuaaaguaaauauaaaugauuuauggauucucugggaagaaaaaugcucacuacuuaauaagaugagauuuuaaccuuagaaugaauuagcaucuuugcauuuugcuuugcugauaauuuucuuugcuuucaguccuuuuguuauuaaggauauauuugaguagucuuaagagucugagaaauuauuucuauuguugaucaggaaagcuuagaaaauuuaaacagugaguaaucagcugucacacuugaaaccuagaggugcaaucugaaauuacauaucagcuguuacagaaaugagcuuacucauaaaauucugcugcauucugcagaaaauauggcagagauuuaagucucccuauguuucacaauuacugaucauaauauaaauaugccaaauauugcccaugaaaaauaugggcugagaguuauuaaguauuuauucugaaauauaguaucaguuauaaaauggaaaauugcuggucuaauaaauauacaggagcccauacaauucuccuguacaaccgcuagucuaaucccguaucuccaguugacuacuugacauuuccacuuagaugaccuuaauauuuaauacuaacccauuauuugaugcugagucuuugaugcaguguugcaacuuccaauuacaauguuuccauggaaaaaauagacucugcuuagugacaugucuuacaacuuacugaaaaauuacuauugucuguccaaaggacacuugugcuugcuucucccguuaucacuacaaacucuuuauaucccaaauugcauuccucucuuauuacaaacuuaccagacaggcaaaacuguucagcauaguugaaagcauuagauugguguccuacuuuggauucugccacuaguuguaugacccuccccagacaucauuuuuuucuuauauguaaaaugaggauguuggacuagaagaucuuuaacauccuuucaguuaccuugcuaugaaaauugaggucuuuaaguguaucacucugaguggguuguaugaccugaaaugucaccaauuuuuuucuggucucaacaugagacucuuuauuaccuuauccauucaguuaucaaacagcuuuguaauuuuuuuucuuuuuucuuuuuuuucuuuuuuuuuuuuuugagauguaaucuuacucugucguccacgcuggaggugcaguggugcgaucuuggcucacugcaaccucugccucauggguucaagcgaugcuccugccucagccucccgaauagcuuggacuacaggugcacgccaccacaccuggcuaauuuuuguauuuuuaauagagacagaguuucaccauauuggccagacuggucucgaacuccugaccucaugaucuguccgccucggccucccagagugcugggauuacaggugugagccacugcgcucggcuuuguaaauuuucauguuauauuuuuccuaucuauucccauuuuucuuuccauguuugcuuauuuucauccacgccuagauuacaagagcuuccuaucuaauuccaaucuuuccucacucuauuuuguccccauagugcuuuuuagcugaucuucccuaaagaccaguuucaucaaguuacuucuuagaaaauguuaucggccuacuucugcauaucauaugacgguuucugguucuucuguugagcuuucaaaucccuagcacugauuuucuguguuaaucauauugacauaugauuaaaugauacgauaucuagaauauaugucaccucauacuauguuuuuuuccaucuaugacuuuacuaaauuauucuccuuaccugaaugucuuuuccuuuucccccuaucauucugaaacacugccuugugaaauuaacccaggcacuuuagcaacaugugacauucucugagggauugugcugcuuuuuuaaggguccaaaaccauggcaagggauggaaaaagaaaaguauaucucuuuauugaguguugccugugugccaggcauguuaccacauuuaaaccacucaacaauccuucgagauugaugauauugaccacauuuuacuacuaacucugaggcucaaagaaacaaacuaaccuacacaaggucacacugcuagugagcaguggagcugggauuugaacucugggaucuuuuuacuuaucccugaaaaaaaaaugaccaagguaccauuaauuaccuuuuuuacaccccucccuccccaacaaacgcauaaagagaaguaaagguacaaauuuaagugccuggcagauauucuccaagauuuaggugaauuuuuuuuauuauauuuugaaaguauagguauuucaagaguucuuccguuuaccucauuuaucaaaggaacuugauguaggggaggccuuuugucugauaagaaguaucucuuuuuuuuuuuuaggggccacagggagauuucugaugugauuugaagucaaagagaaaauagcacgcauuuucuuuuuugcaauuaaaggcugaaaaagagaugguauucauaugugcauucagcaaucauccuuucauaacaccaccuagauaacaauuagggucaagggugaacaguucaagcaguguuaguuaaugagauuuuauguuuuguuuucuuuuguuuuuuuuuuugagauggucgcucugucucccacgcuggagugcaguggcacgaucucggcucacugcaaccuccaccuccuggguucaaacgauacuccuacuucagccuccugaguagcugggauuacaggugcgcaccaccacacccagcuaauuuuuguauuuuuaguagagacggaguuuugccauguuggccaggcuggucucgaacuccugaccucagaugauccacccaccuccgccucucaaagugcugggauuacgggcauaagccacugcgcccagccguuaaugagauuuuaaaagaaguuauacagauuguugguagucacuuauguacuuggacuugucaauaacugucauagugaaaaugugguuuuuaagaguaguagcuacuuauggggguguagaaagaauggccucucucuuagacaauuucauuuuaaacaucauagucaucuuuugcauagugauugacuccuaucuuugugguuucauguauuucuuugugauugauuccccagugccugccugcaguccauugcaacucucccaaacuuuaauccugcagcuucagcccacugcuagauauuuccauugaugaccugucaucugaaaccuagcauucaucaugugcuguguuguauaauuguaugucuguguuauuguauuacuuucccaaguaaaguuuuuguguaaggacuuaacacugcuuugaauccccuguaccuauuauacugcuguguacaaaguaggaguucaaauacaugugaucacaauagucuucaugacuaaaguagcucuucgcuuuuuugguaaccgcagaagccuagaaaucauccagaguucagauacaguugcaagcucuauagaaccaaaacacagcaaaaagguacuguuuuauaccuuguaaaaaugaagucaguauauuugaaaauugucauuugcuccuuguagaagaaaagacuuuaccuuuuugaugaaugacuuaaauauauuuauuuaaaauuaaauccauucuaacuuuuggagguaauggauauauuuauaaccuuggucauggcggugaccaugcauauacuugaguauaugcauaugugcaaaaguauacauaaauauauauaaaauuauagcauguauuuuugcuguuugucuuaaauugauuuucuguauguuaggcuugcuuuuauuccuccuuugucuacacuuugucuucuaugauuuuuuucuaauuuuucucuuguaauacuucugguucuuaaaguguuuuacuuuauuuuaacagcauauuuaaaauuauuuuauuauuuauuuauuuuuugagacugagucuuacucugucguccaggcugguaugcaguggcacaaacacgucucauugcagccucaaccucccagguucaagcgauccuuacaucucagaccacaggcaugugucaccacacccaacuaauuuuuuuuccuuucuuuuuuuuuuuaauagagaugaggucucgcuauguuggacaggcugcucuggaacuccugggcccaagcgauccucccaccucagccuugcaaaaugcuggaauuacaggcaugauaauuuuuuuuuuuuuuuuuuuuuuuuuagagagacggggucucgccacauugccuaggcuggucuugaacuccuaggcucaagcaguccuccugccucugccucacaaagugcugagauuacaggcgugagcuacuuugcccggccuuaauuuauuuuaauugucuugaggucacuaauacagacuugaggucaaagaccaagauguauuugucuuuauauugacaauauguuuagcacagucucuggcaaaaagccaguuaguggcacaucauucaggucuccccagauggagaccagugcuucuuuuucauuacaguguggaggcccuagucauauucucauuauacauuaaaaacuuuaaugaugauugacucuucgguuaccauuuuaauaagucuugauuaugagucuaagcuuuucaaaaacaucuuucauugaauaacuauaugcaaagaauauauauuuauauacuuauguugcugcuuuguauaaaauaggcauggaucagaauuaauguccucugauucuauauuugccauuagucuuuuuucuuuuuuuuucuuuugagauggagucugacuaucucccaggcuggaguagugcaguggcaccaucucggcucacugcaaccuccaccucccagguucaagcgauucuccugccucagugucccgaguaacuacaggcacaggccaccacacccagcuaauuuuuguauuuuuaguagagacaggguuucaccauguuggccaggcuggucucgaacuccugaccucaggugauccaccugccuuggccucccgaagugcugggauuacaggcaugagccaccacgccgggcugccauuagucuuauauuaaaggaagcccucuuagcacagccagcagcacgucagucucauaaacuaacuuuuaaucgauguggaaaauauauuguaguauuuaaaauguagucugaacaaauuuugcuuuccuuccccacacccuccuuauuuuuauaaaguuaccaggcagugacauugccagugggagugauguacuuucugaugucauacccaguauuccaaguucaccuugccugcuuccuaaaaagaaaaacaagcaccggaauuuagaugaacucccuuggagugcaaugacaaaugaugagcagguaaagaucuugacauucuuaauuaaaagcuuuuauguggagacuagguaaagcucaguuuauugccuguuuaaagcuacuggggaaauguggauugcuuaguaaaucugaauuugagcuuuaacgguuuuucagggaacaaauauaaccuuaagugcuucugcuauguaaacacauuauaauugacauaauaaaggaucagaaguuuuagcaaugaucuuauuguaauuuuuucaucacauagguggaauauauugaguaucugagucggaaagugaguacugagaugggucuucgggagcaacuugauauuauuaagaucauugauccuucugcucaaaucuccccuacagacagugaguuuauuauugaacuuaacugucucacagaugaaaaacugaagcagguauguaaagaaaauacagauuauuuaccuauuaaaaauaccaccaucuuauaaaauguagacuaaaauaaucauguguaaauacauagauaauuaaggccaaaaucacugcugcgaaagguaauauuagaaaaaaugauggcacauugauuuaagagguuuuauguacaucucaccugccaguaccuuucugggaucaaugugaaucuagaaccugcuuuucaguuguauaggauuugaaauuuaaugucaccauuuacggagugguuagguuaagguauagauuuauucuaacucaguuuacaggagacuaauugacaaucaaaauacuaauuaaugagagcuauucuuugauaaacagcugagggauuugaguaguuuuaugcaguaauaauugagccaggcuagggugaaaccuagugaauuuucccucugcuguucugaaauacgcaucucugguacucugguaucaucuucuuuuuuuuuuuuuuugagacagagucucacucuggagugcagugacgcgaucucggcucacugcaaccuccacugcccggguucaagugauucuccugccucagccucccaaguagcagggauuacaggcaccugccaacgcacccggcuaauuuuuguauuuuuaguagagaugggguuucaccaucuugaccaggcuggucuugaacuccugaccucgugacccaccugccucagccucccaaagugcugggauuacaggcgugagccgcugcaccuggccucugguaucuucuaaauacaauuuuugcuguucuuuuucugguacguagcugagugaauacuuacguucuuauguucuacuuuugauuuguuucuuuguuuugcauuuaucauuauuuaugaaaaauuucucuuauuucaguauuucucccagcagacauacuauaauuuucuacauuccagcaaauuuuucauuaguaugauaaauugaugucuugcauuugaagacagguauuguuggccccuagcuaagauuuaggaaacaaccuaaucuuagauaaaaucagcagcuuacuuaaauugucuuaaguggagacuuuuaacaaaugccuaaucucaucuauuuuauuuuauuguuaguuuguauuuugaaugccauuuuuuuacaguccuaaauuucugaaggcgaguagccuuccauuuacugauuauauuuuaugugcuuuuaaaauccagcucuauaacguguuuucuagcuuuuugagcauuuauuuucuaguacuuauuucuaaauuuagccuuucuauucuaccuuacguaugcaucugcagcacuuuugacagucuuuuagauuaaguacaauauuauuuuucccccagcauuuugaagguagaacaucaaggugcaacacuaaccaguuuguguuugugcaucccaaggucagaaacuauaucaaggaacauagcccucgccaacggccugcaagagaggccuggaagagaagcaacuuuaguugugcaagcaccaguggagugagcggugccagugccagcgccagcagcagcagugccagcauggucaguucugcaagcagcaguggguccaguguuggaaacucugcuucaaacuccagugccaacaugagucgagcacacagugacagcaaccugucugcaagugcagcagagcggauucgggauucaaaaguaaaacgucuaaucaauacaaaacuuuaccuuucaauauuaacauuaguacuccuucauauaaauuucuugaagaguuaaaaugauccugcugucuaguugccuguggguuuuggucuuaauugaacaagcaggaugcucugcuguugaacaaagcacucuaggcugagugcuuugaaaugcuguuuugacccacaaccauauugcauucaaucuuaccugauuuuuguguauguuuuaaguaagauaaauugguggaaauaaugaguuauucucaagauugcaauauugacugcaacucacuacugagcgaaucucacuacguugcugauguugcugucuauuagcuccuaagaauguuguguaugucuuuuguguguguuaaauguuuucuuaauguuuuaaucuuaaauguuucuucuuagcuaauuuaaaaaucuaauacuuucuauaauuucugucuacucuuuucacaguugagaaaguucuguauaauauugucgggcacuuaaaaaaaaaaagaagguauaaguauauuuagaaugguccuguggcuuagcaggggaguuugauuccuugcaauggcaagaaucuggagccaguuuaaagaugauaagagaaucucucuaacucuuuagugacccaguggugacuugaagauacacaaugauucuuucccugguucuuagggaaguagcagaaacauagccaguuuuguugcuaaggaauuucucuagauauguggucauuccuuuuuauuaucaguucaccggugacaaggaugggaguauccacugaguuucugauggauuuuuaagaugguauucgccuacuacaaaaaaggcaugauuuuuuuuuuaccugccauuguaagauugcuaguguuuuuggaugaaaggcaccugagaaucauaaguauuagagauuugggcaauguucuccacagguguauucaguauugucgccuaguauuaauuauguguucauuaugcauuuguaccaauguaccuuaauggaauuuaaaaaagaagucuuugaagugacuuuuuaucuaucacuagccaaaaugaucgucucaacucuuccuaaucagaagagucacuggucaaauaccacaaaauuggaaucuuaaucauuuuuaagccuaagccaguggcucacuuauuggaacaaggaucauacuacagaaggauuugaacagcucuuaaaguuagaaaauagagaauuugauccacaaaacauuuugggguggauaugccaaaaacuaaaccaaacugauuuagaaauuuuuauuuugacagaagcgauccaagcagcggaaguuacagcagaaggccuuccgcaagaggcagcugaaggagcagaggcaggcccggaaggagaggcucagugggcucuuccuuaacgaagaggugcuguccuugaaagugacugaggaagaccaugaagcagauguugauguuuugauguaauaagggugaauuuaucaacguucuuugugagcauuaaaauacuccauccuuauggguuuacaugcaucuugaccaaaauuuugguuagggcugugcugauguaccauuaauaauuuaagccagugguucuuggcaggugaucccaagaccugcagcuucagcaucacuugagaaguuguuaggaaugcauacuagugggccccgcccccagacauagugaaucagaaaccaacagggaggcgccuagcauuguuuuuuuaacaagugcuggguuauucugaugcacagucuaguuuaagaaccacuacuuuggguaaacguuuugacuguuuaaaguuuauggcggugaagugggcgucuucaaagacuaguacuuacacaguuuagaagauuucaagguacugcugacaguaguuuauuaugucaguauacauacauguguagagaucauaauuuaguucccuucuuaauguuacaauuucuuaguuuacuuuuccuaaagggccauagcauaauucuugauuccugguggaaaucuuuucugaggugugggggugggcaagguguggauugcuguuuacgauagugccuucauuaguuuuaguucugucuguuuucauucauuauugacucaaagguauuagaacaggcccuuaucuuuuuccuauuagauuuauuuuuguuuuuuacuuuauguaaguucagaauccuuuuuuaagugaugacuacugaugaaauaauguuacuaguagcugaauuuuagacuugaugcuauguugauuaauauuuaaauggugaaaguaauuaggcaaaauaagcaauucugcuuuucuguugcuuucagaauuuuuaggcuguaaaauugucucaggcaggaagucagucuauaucucucucaaguucuuauuguaggucauuuuuuuuucagcacagcucuaauuuuuaaauauuugguauaacagcuucuggcaugugaccuaguuaauguugaaaauuaacugaugaaaacccuuguagaucugcuaaacuucucuauaaauugcuagaaauauacagagcaaugagauauagaaaacaccuuagcuuguugguuauuaauagagcucuaauuuuaacugugaaaucauggaguuucuuuaaauguuuuccuagaguguuuguuaucaugaacauuagaaauagcauuauuccuuuucuucuaccacaugucuugaacauucacauggguuaaagaagauggaaacugauacuacugacaaucaagcugcuuucugacuuucauaauuuucuuuauauuguggauagcauuuugaaggugaccgugauucuguaggaagagcuguaaucaauauuuuucaaacucuaagaguacagagguuaguaagauuucuuuuuuuuuuacuuuuuguuacgucaaguagcuuauuaagaaaaagauucaugacuuaaauucuuaauucucaguugauacaaaggcuuauaaucauguguuuuaaaauuuugauuucauuuucguuccuugaagguuaaagaauggaaacuggggauaaaaauuaauacacugcagcuuugccaaggucugugauaugguuguaaccuuuuaaagacuacuaaagucauaauuugaaauuuuuacuaaaauaaaacauaugugucuaugguuuucaauuggaguagucuuucuuacuuucccccuuccccucuuugguucuccuaaccagcuuagaggacccaaagagagcuuagggauagacaccagaauacucuguggagguggaacaacuuaaccucacuguuuucccuuccaaguauaggaagagcaaauagagcauaguaacuguaucuaaauucucuaccugcucuuagcaaaagcaaaaucccacagaaugauugccugcugucuuuaccuauucuucaaggaaaacaggccacuuuuggagaccauagagcaccauuuaucugucaaauacuuggaaacuauuuacuuaacggucaucaguaaaaaacccuaaacaaggucaugauauaauuuaagaccaauuccccuacucucccaauaaucacauagucuuauuacuuucaauuuaacuugagucacuauuaagcaaguuuaccaaagugccacaaaguugauuuuuaacguuuguaaagguuugaauguuuauagaagugcaucaugaaauuuuguguaaauccagaugaacugucauuauaguacuauaaauuagagauaguccauaaaguuggguugaaggagauugaaaauauuuccuuugauuaaaagaaaauaauuaacuaacuugggcuugcuugugauugaagagggagauuagauaguccucuguccccccaaaaaagaaacuagcagagaaagacauaaaaagcucuuuggugucuguucaugugcuguacauuuuuuccguuuuaaugucuuguguagauaauucaaaguuugaacuauuucuuucuuggaauaaguaauaauuuauucaauaugguguaucucugaguucaauuuaaaacaauccaacucaguaauauuuauuuuuaaauacaaauccuaacuaaccaauuaauuaauaaaaaggcaagacuuacuugcuguaguauugguucucaucuguagagaacugacauuggagcaaauuuuaagucuccccuuugaaaauaagccuuguuaacugagggcguaauacauuucccacagauuuauccagaaacauuuuauuagagaucuuauaguaguaucucaguuccuacuacagcuuucuaaaggaugagacuugcauuuaacaaaaugacauauauaauauuuuucuauaguuuugcaacugaauuaaaggaaggugauguauuauaauguguagugagguauaaagggcuaguucauucucucccaacaagaacuuagaauaaaauaacacuuuuuuuucaugagacuuaccucauuuuuguuaggcuauggcaguuuuguccaguuccucugucccuugagugaauuagauauuggugaauuaaucucagaaacugaccuauaaaauaaugacucauuauagauugggugaacuucucauuuuauuuagcuuuuaaaagugcuaaauccucucauaaaggaaaaauuauaggaaacuauagcgguauccagauucugaugagcuuuaaaaauuauaaaauauagcaaaugucuucauauuuuagccagaaauauuaguacacaaccaauauagaagucuuguuuguuucuggguucuccagcagagacuuuuuguuuguggcuuacucuguauagccucaugugccuuaaagguggugaacucuaguuuuugucaauaucaggcuuuucaaaacucaaaaacaauccaaauguuguaauuuguuuugcauaaugcccauggaauuggauaucaguaagcaaagccauuaaaucgaaccaaucaaugcuaauagaguauaaaaacaaaaaccuucaaauuuuaaguuucauuuguguaacuuuauuuucggccuagcuagaucauugaagagccuugaaaguuaucuaaaguauggcuuaauguauuuuuuucccucugaaaaagaucauaugccaggauacuucuucaaaccagaucacuuuuaauaucuagaaagauaauuuucaagguauaggcaaaagcacuucaaggacagagauuauguagcaaguugauucucuaggaauucuuugaacucauuuguguaauagcuggaacacacuccucuucuuuccuuuaacaaaugaacuuuuagcacuucugucuucaaggaaaaacauuuguuuggaauugaaggguacucgcaguccguuuauaguuugggacaauuaauaggaaaauccccaguugcauucaaauaauaguguugauguugagggcacugacucauucagcaugucugaacuagaaguaaauuuaauucugaaaggacuguuaguuaggaaauaaguauuuguauacauauguacugugguaacuuuggauucauuuuaagucugauaaaguaagauaaacuuugucuuaaaaauaaaauuaugcuaagugaauaaaaacugagauauuuuaagcuaggcaucuuuguuagcauaguauccggaacauaacuacuuauaaugcuuaggucuuauuucuuuggaaaauaaguuacuuauuccagaagccuuagaaggaauucugaaaauucuucuaacuggccauuaagaguaaggaaguugaaugguacugcugaagaucugaguugacucacugaaauuuuauuuucuuauuuuuuuaacauuaaaauuauuucuuuuuggcucucccucuaguuauuuuuuaaauuaagguaauuacuguuuuaaccuagagcauauaauggcaaauuaaauuuuaauuugacacucauaccgaacucagaaaagcuuguuugaucuucucuaaauucuguauguaguacuuuuuuuaauugucacauuucuuuguuacaucuuuguguccaacaaaaccuguggaaaucuguguucauuuuuguggugagggaugggggugaaaaaggggagacuugcucuaauuaugcauauacauuugacuauguaaagguaguuguagacuauauguauaaauaacaaguuaacacuuaauauucuaaauuguucuaaggaacaguggccugaagccaugacuaguuuuguggagcugcuggcucuuuuaacaguagcugaccuauuggauuuaaacugagacugaaauugacauuugugguuagguuaucuagcugaggcuuuuaacaauggagcagauaaugucuguuccuguaguggauccauuuaauuuccuauuugaguacucucacuuaacaaguauuaucuauucugaaccuuuguguugggaauuuaaggacuauugucaaaggcuauuaaugguaaacaaguauaugcaaaacaauucacauauggguaaaaauuucaaauuguggguuuuuguuuuugcuuuuuaguuucaaagauuaguuauguagcagcaauaucauaaccaaagcaaguaggaaguugacugguuuggagaaucuucaaguaguuuuaaauacuguaauguaucagauuguuaaccaggauuuuuuuuuccuguauuacugcuaaauauauuacuauauuaaugcacuuuuguauauauaacugucuucuguacauucuguacuuacuacaguguauauaaagccuguuuucccugaagcugugagggaauaacaauaguuguaucauaagucguuucuauuuugaguuccuucuuguacuugaaaguaguucaguagugaaaucuaaaugaguguguaugguuguaauuaaaacuggcaauguggcagagcugucuuuugaaacugaauaccagaaugaaaaguguuguuuugguuaagaacucuuauaauauauuauuucuuuugauguacccugaguuguuacacagcccacucacugcugcuuacuacuuuauacuucugagucagcuccuuucaugcucuaucccagaauauuuaccaacagaggagaacugcucccuuuucuguuucucacaguuugguuauggcuuuauaaacuuuuauuuggugaaagccccagauacccaaaugucauuggcaaaacuuauuuuuuuuucuggacagaucagauuucuagagagagcagauuucuagagagauuagcauucauaguaagugaaaauugucuaauuuuuuuaauccaugcuauuacugggcaguaggucuaauuuuuuuugacaaaaaauagaucuauuuuccuuauauauugauuuagaaucuuaaguuagaauuuuauagaagaaaugucugagcaguucuauguauggaggagcaauucagcuuuucagcagcaacuuuaucuuuugccacuagagggagaucugugguugcuuucuccuuuggagaauagcugcuuugcuuuuauuuuuaauuucuaagguuggaauagaacuuauucucaaaauuccuuuaguguuauuaaauauuuucauuuauuagucaaagguaaguuaauuaagcuuguuuaaugaugccaaucuuaugcuuuucuguaaucuucaauuuuuaauaaaugugaguuagauacuaagugaa

SEQ ID NO: 192858 - RNA, 5529 nt, Homo sapiens
gagaugcagguggauucuugggcauuugcuguaaguacuuuuuuucucuuuggaaacuuugaacaucucuaucagcaagucagagucccaaauaaccaaguuggcaagucagagucccaaaccaaauuccuggcucuaggggugaaggucuaaguguggucaucuaauaauugacuuucuaccagccucagugacuuuuaaagaaagaggacucugaugaugauauggagauuggauagaguggugaacaaaggggguugguauggaggauauaggagauggugugaucuguuaggagcugauauaguagcucaggccaugaacugagaggcagaggcagcaggaaugaagagaagggagaaguuuugagaguuauuuaagaguuaguauucauaagacaucaugcuucauuagauauggggaaugagaauaaaaggaggcuaugauuauucccagguaucuggcuuaggugucucuauagacagugaugugauaaacugagauguggaaugaagaugagggagcaagcuuaagguguagggagaugauauguuuacaucuggcaacuuugagauuuucuuauugagacugaggucuguguggaccauccuggugguuauauccaaaagaaagcuggauaaauggcuaggagcucaggagagcaaucugagagagauacaguuucuagcaauugagugcggaggguaagaucacucaggaagaagauggaggguggaggaaggauccuuuuucugaguucauagaccucuuccuucuaagcacacauguccacuuucauuggauuuccacaccugacuucuuuacuccauuucuuugcacucuuucaggaucagagaaccuuacaccuuaucuuucuggcuuucuuuauaauaauuaaaaguaacaugcauagguguaagaauaauaguguuaagaugucuuacaacuuagaaaugacuguuuagauguuacuaagauuaauggugaaagaaauguaaaauuuagaaaauuauucuuucauuuucugguuguucgaaaauaccucuauggcuuccaugcauugcaaaaugcaugaauuucagcucaugaccuuguacguggcuccauaaaccaccacccauccauuccaacuaaucauauauuguacaaauuacuuucauuuugucuuuuagccaaauaagaugcgaguguucucucaucucauagauuuuaucuuaagaaaaugccagaugaaaaaaaaaaucuaaaauucuaaucuacaaugaauaauguauacagagggaguacuaguuuaaccuaagaauauccccucucuccaaaaggcugccucuaguucagaaaaaaagugauucaauuuccauaaauuuaauuuacucacagcguuuucauaauguugcuauaacaucugaaugacaguccauggcauuauuuccgugguugcagcaagccacuucuccuacucccuguccauauuagaugcaucuccuguuuuucaagggagagaaaccccugcucagccccugaugagcacaucaucaaauauuuacuauuguuuuauuaaucaaugugggugguuauuaugugucucuggcucagggaguguuucauccaacuaagcucccucagugguugucucacuucaucucuuauagauuaacuuccuuccaaaaugucaccauuccuguaucugguucucuugguacuugggcuucaugcuacaauccacugugcaucaccugaaggcaaaguaacagccugccauucaucccaaccaaaugccacucucuacaagaugucauccauuaaugcugacuuugcauucaaucuguaccggagguucacuguggagaccccagauaagaacaucuucuuuuccccugugagcauuucugcagcuuugguuaugcuuuccuuuggggccugcugcagcacccaaacugagauuguggagaccuugggguucaaccucacagacacuccaaugguagagauccagcauggcuuccagcaucugaucuguucacugaauuuuccaaagaaggaacuggaauugcagauaggaaaugcccucuucauuggcaagcaucugaaaccacuggcaaaguucuugaaugaugucaagacccucuaugagacugaagucuuuucuaccgacuucuccaacauuucugcagccaagcaggagauuaacagucauguggagaugcaaaccaaagggaaaguugugggucuaauucaagaccucaagccaaacaccaucauggucuuagugaacuauauucacuuuaaagguaagacuuucagaugucaauuuucagucuagggcucagauacuuggguggagugcugaggggagcucauggucucuuauuacuggcaucaguaggugucccucauaccacagugaucugcuccacuggacauagcugugaauaguauuggaucuuccaagauggacacacagcucugugaaugaguccaggaaauuucuagggagagcgcccuuucagagaggugggugacaaugguaugaacaucuugcucauaauuggcuaaagauucaugguuuccaaaagauuuggugaggugggacaagcuugcacuugucaaguagacauauuuguauguaaagccuacugugauucucacuugcuguacauacuuaggcauguuacauacauaauuuuaccauguauuaugcacucacuguguacuaaacaccaucugacaugugugguauacacacacugucucaaucaauacucauaaguguccaaguuuacacaguuaauaaguuuuagaacugauauuaccaacaaggucugugugagucuaaagcuggugcuuguagaaacaagaaucaugugacuauuuccuaaagguacugugcucaaaugauuucuccugguucuauaguauaugucagccacauuucuuggaggaguaaucaauugucggccacaaaccacacauagauagauuggcuaaaauugcagaacagaucuguuuucucacuucucccuaguguguuggaugucguuauaccuuuuuauggaagaggaaacuauggcucugaugggcuuagugugguauaguaguuuugaauacagacuguggagcccaacagcccuggguaugauuccuggcucugccaccuguuaacugggagaccaugacaaaugacuuucucugccugauccucagucacuuguaaaacugguugacuguagguaccuaacucuguggugaucuuaauuucuaaaugaaaucacuaauggaaaaggucuuguugguacugauaccgguuuaaaauaaacaccucucuuuucuuuguauuuuaagcccagugggcaaauccuuuugauccauccaagacagaagacaguuccagcuucuuaauagacaagaccaccacuguucaagugcccaugaugcaccagauggaacaauacuaucaccuaguggauauggaauugaacugcacaguucugcaaauggacuacagcaagaaugcucuggcacucuuuguucuucccaaggagggacagauggagucaguggaagcugccaugucaucuaaaacacugaagaaguggaaccgcuuacuacagaagggguaaaugccuuagaggauguguggguggaaggugggcauaaaagugcaggugagacagaguucagcagaaacccagaggcagaagaaucacccugaacuacccaacagcuauguaugaucacuagaauaugccaagaaaauacugucuaccaggcccuuggcugggcauucuacauacuucauaucauccaagcacaucaacaaaccuacaaaggaggcaguauaauuggcauuuuucaaauuaggaagucuggucuugaaagauaagaugagcuccccaaagucagccuauuaguaaauugauggcuuccuguagaccaacuagagcucaaagaacagguuggauuuugauguugaaaggugauugggcagccacucuguacuggaagugcaaggcagaaaacugugaagcuccugggugcuacccauuaaccuucaugccacuagcuccccaaccuuggucgucaccucagggauauuuucucuugauuauaaaggaguuacaucucccuacucccagugcuucaguccaacauuggcuguaccugagugcauuccuuucagaauaacuucugugaguuuggugccauguauugacuuacauaguaaugguuaucaauacucagggaagaagcagaguccaauauaauaccaucaugagagagagaaggagagaaucauaagcuugauauggugauugccauguguucccuuccucuuuucccacagauggguugacuuguuuguuccaaaguuuuccauuucugccacauaugaccuuggagccacacuuuugaagaugggcauucagcaugccuauucugaaaaugcugauuuuucuggacucacagaggacaauggucugaaacuuuccaauguaaguugauaaacuagaguucuuaaauguaugaacuggaagagcaauuaggagucaauugauucaacuuucuuauuuuaccaauuagcaaucugaugccuagagaggcggugugacuccuccuaagcuagaaucacuccagagucauucccauuacuccaaauaaguaauuguaucaguuucuuccauccuugaccuuuaugucccagaauuacucugauagaacagcuuaaugaucagaagugacucuggugagaugcaguucugaaggaggugugaggagggaaugcuuaagaggugacuccuggcggcagcaggccauagugaaugagguguuucccaauggcuagccguagaaucgccagagaaugauugacuacauuuagcagaggaaacuucauauucuagcaccaucaacauaguauagcaaaggggcggccccaccuuuccuuucccuuucuuacuucuagaccuucccaaagacuguuccuguuucuucagagacccgcaggauuuguucuccccacacaggcugcccauaaggcugugcugcacauuggugaaaagggaacugaagcugcagcugucccugaaguugaacuuucggaucagccugaaaacacuuuccuacacccuauuauccaaauugauagaucuuucauguuguugauuuuggagagaagcacaaggaguauucucuuucuagggaaaguugugaacccaacggaagcguaguugggaaaaaggccauuggcuaauugcacguguguauugcaaugggaaauaaauaaauaauauagccuggugugauugaugugagcuuggacuugcauucccuuaugaugggaugaagauugaacccuggcugaacuuuguuggcuguggaagaggccaauccuauggcagagcauucagaaugucaaugaguaauucauuauuauccaaagcauaggaaggcucuauguuuguauauuucucuuugucagaauaccccucaacucauuugcucuaauaaauuugacuggguugaaaaauu

SEQ ID NO: 192859 - RNA, 3269 nt, Homo sapiens
gguucugggaaguaggagaccccacuggcuuugguccccuaagaauggacucugcugccugugcugcugcugccaccccuguuccagcccuggcuuuggcccuagcuccagaccuagcacaagccccacuggcacucccuggccuguuaagcccaucuugccuucucuccucuggacaagaaguaaaugggagugaaagguaaguugagcuuagccuuuggcaaccugaacuuaggcuugagagcuuccugagagaggaaggaaaaugagauguccagggcacccuguucucugugaaggggaaaagcaauggccucauagcccucccuccucaacucuagcuggaauaucucaucugacuuuucaccucacuaaucccgcuggguggcaagaggggacuuggggacagcuguugccaaagcugaaggugaagcagccagguccucauaggccagguggcugaguccccugagggggauggggaacugccaugaaaccugggcuuaacacaaucuagacuguggggguggggaguuuggggaaagaggaccaaagucuaaagaggcccuugacugggacauugucuuuuuccugaccacgccauaagauuuccauuugcuuuuuuccuaccucugcaaguccaguggggaagcaguggacccaggaacauuucuggcccucuucuucagcccaggaagaugguagagcucugaguucuacaucuuggagcaggaaguaggaggcaagauauuuuccaucuagcccccacucauuacuccaaacauuuagucuucaacaaacauuuacugaaacagcuacuguguaccagacauuguacuagguguugaggauucagauacgauugagcauaucuuugagcuuaagaagcccaaagacaaguaaauagacaauuacaaaacagcaugauaaaagcaauaauaacauugcugaagccgagaggagggacaucuguccuggaaugggcucaggagccuuaggaaaggcuuccuggagcagauggcaccugagccaagcuuuugggaggucucuuguuaucucagggagcccaccuuucagucucuuccucuacggauugaucucuccucuuugucccagaggaacuugucucuggaggcccuggcugucuuccacaaaugacuccccaaggcagaugaggaagcugguggauuuggugaguucgagcccuugugacguguguucacaugcagccacaugcauuaacagugaccaggucacuucccagagagccccugaccucaguccaaaggugcagaucugagauagcauccucacaguuuugccaacauuugauuccaacagagagcagauccaagcuuucuguggcaauuggaaagaugaggagaccaaagcucagagugggcaagggaucugggcaggccccacagccaguguguggcagugcuggugcuugaggccucgucuccuggcaccuuacuccagugcucucccacccacccgaucucccugaaucuuugcugcuccaguagaacacuguccccuggagagccuccaaacaggugcuggaacagaggcagggaagcaaacaacccgcaggacucugucugcuuguuuuucaaccagaaccaagagagaccccuuguugagggguggguauuggggguugcugggucccagagaugucuaaggucucuucaagaucauuuuaccugcagcuuucugaccucuaguacagaggaggaaguuaucuagccauguacuuugagccacaugcuagcuuuugcuuuggacaggcugcugguggggcaacggcugcugaggucaccaaggcugaauccaaguuccaucacccugucagguaagcuucuggcaugaagcuccaaacuugacauagauccauuagcucuuugaaucuucacaaaggucuugugaagcaggagaggggaggaauugcuaucuaugaucgcuguuucauaggagagaaaacuggagcccagagagguuaagggacuuugccaaggcugucuuuucuagaggcauuguuaacgaugcccaagaaugaucccccauggaugggucagugaaauaauccucaguggaaggagauggggccauagggcuggagaauucuuggcuagaagcuuucugggguagguagcagguggagucagagccauaagugacagaugcuggggcuggcccccgacccaaccacuauagguccauaaggguuuaccuuccugcguggggccacuuuguaacaaugcagaagguucuguuacaaaacuuucuuucuuccuuucccucugaccucauuguugcagccaagagaagggguuuaggggccagcuucuuucuuggcccuacuggccccucugcacauaugacaccuguuaggggccauguuucuucucuguccacaggcucuucuggccuaaaucccgcuccuucgacuaucuguacagugcuggggagauuuuacugcagaacuuuccuguccaggcaaccaucaaccuauacgaggacucagacagcgaagaagaagaggaagaugaagagcaggaggaugaagaagagaaguaggaggccaaugaaaaggggccagaagggugugugaggguaccaggguccauacccuacagcgccacagcucaucccccuuccucaccccuaaccuauccaaauggaggcagccagagucugauugggguucaguuugucuggcaaguuuucacagacaucaguuagccggaaguauuaguccagcagauagagcuuucuggacugaaaauugggucaucuagcugcccagcucacccuggcuuaccugaauggccugugagcucaggccucuugcaucucauugucugggcugcuguuguguugaccaugggaggguucuaggagcucuagaaggaaggcuugcugaagcccccaggaagcagagcagggcagggaaugcccuuguggagggaaguagucauuccucaggcccuuugacucccuagccuucccagguggccauguagucccgucucucuguggaaagccugacuucuggcuucaccccaaggaauaccaacagcagauccaugcaagguuggggugccuuuuugaugagucuuacaggaagggaaggcaguguguagagaaucggcuugcucuggggaugccuccccauuuugccugcuguccauugaagucuguguguuggcaugagaugaaucaggagaaaaauaaacuggaugguguuuuccuuuuucuuggaa

SEQ ID NO: 192860 - RNA, 56940 nt, Homo sapiens
gacuugagguccgcggccuauuuacccaaguuggagguaggggccuguggaaacaugaagagguaaggacuugucugaagagcaggcggcaaggggagcuuuguucuaccuuuucuuuugaaaauggcuuccauugcuuucugguuuggguauugcacguucucaggaugcgguuucgugggagcgggaacacgacaaaggagacgggaggaggggagacgggcugaacaggccugcagagcgaaguucaggaagggcugccaccggggccggcugcugugggaaugcccucccggcacgggccccgggagcuggccgggugcugcggcuucgucguuucacccggacccagcugggcaaaaggguuugaggcugacaaauucccggcgccggagauguagguaccucgggccagccccucgccguucuccccuaccuccaccuccaccugagaaaggcucggggcgggcgcauuuauuugcaacgucuguguguuaaagacuacuugcuugggccccgaaaccauguagcgcuuucgaaucuuaaaguaagggagcgguacuuuguuucuaaauguggaaggacagcaccaaagcgguucgauuuaugggguggggggaggggagguggaaggcauugcugggcucaguuccccuuacuuguccugagguaaauggccgcuugagccuaaauggccugagccuccuaacuauugacgggcuuaaauuaauuuuagauucacucugcaaguagaaucaucacucuggaauagugcagugcauuuaaaauucuuacugauaugcuuuccugcacugucaguuccuugcaucuuuuaaaaaaccguuuaugacuuugccugccugaaacuaaccuuuaauauuuuuuuaugauaucuccuccaugcgaaauaauguauaauguauauauacagcuuaaagaauaauaaagguucgcauccacuacaagcuuaagaaauaggacauugccagucccuuagaagucuacugugucucuucccucccuucguuccccccugaggugaccacuauccggaauuuuguguuauuaauucccuugcuuuuaaaaaagcaaauaguuucuaguacauaugaauuuaucccuaaacaaaauguuccuagucauguauuugaaguauuccugauacuucaugcuggcguuucuauuguaaaagcuacuagacucaauguggcuaaaacaauacugacuuucccuuucccaaaucauuuauuccaucuggagcuuugucuuuccuucauugguaccauuguucucucaguuacacagacugaaauuuugggauuaucuuugacuuccuugccucugccuccaaaaggccucucucaucuaacccuuucuuuccauuuucacuauuaccauuucagucuagaccuucaucaccuuuuacuucaguaguuucauaacuaguucuucuuguuucuucccuuugaaucucuauggcauauuauaaccacauucaucugucuaaaccaucacuugcacugugucacuuaacuguuugauaaauuacuacuucuuauuauccuucaguauauauuacuaucccuuuguacucucuuucccuguucuccuuuucugcaucacacaccuuugaaugucagcuuaaaaguaccuuucugaagucuuccuuuaccaccuuuaucucccaauuuucucuucugugaauuucuacuaauuuggcauaugcuucuauguguuauuauucucuccuccccccgcugccaaggcacaugcacacaacacauaaacacacacuucuucucccuaaauagauugugggcuucuugaggauagggacuaugucuuaaacaccuuugacuucccucaguaccuagcauagugccuucuguguaaacagguauuuaguaaguguucauggacuaaaugguaaagggcaaugaauuguuggagaagugucuuugaauaaauggggucaguaaugguagauaauauagauaaggaauauauuuugagacucacagucucuuccguuuucuguauauauucuuaugucuacuccaggguaaacagcugugugaagagugaugagcauguccuggaggagcuggaaacagaaggggagaggcagcugaaaagccuccuucagcaucaacuugauacuucugucuccauugaggaguagguauugauuuugcaaacggagaguaucauagacucuuaccuccaggugacagaucucucuuaaagccuagauggaauguuccucucccaccucccuuucuuuguuagacuucaauguauuagguaggguuuuaauucugugucucuuccucugggaagccucccauaucucacuaagucugagccaaguaccuauuuuauguccuccuacagcaucccauauuucccuuaacauagcacuuguaacccaauauuaucauugccuguuuacuugccucuguuccacuguuuuuccacaaaagcaggagccauuuuuaucuuuuuuauaaagcuauuaaauccuuaguaccuagcagaguaucugaugcauaguaaguacucaauaaauauuuguugauuuaguuuauuauuccuggaugacggcacucucgauggaguuccauuuuguugcaguggugcuucagcuuagaaauaagauguaagagaaaauuugcuggugaguuucauuguaccucuuacagugcugaaccuccauuuuugugaaugauaguaaccucaagauguucuuacucuccuccugcauguuuugcagauguaugucuaagaaagagagcuuugcuccugguacuauguacaagcccuuugggaaggaagcagcugggacuaugacuuugucccaauuccagacacugcaugagaaggaccaggaaacugcuucucucagggaauuagggcuuaaugaaacagaaaucuugaucuggaagagccauguuucuggugaaaaggugagugggguaauguuuuuuuuuguugguuuuucuccucaaagaaacagagcaaaauaucuucauuuuagcacugagagccuuuucauuucuaguucucacaaaacugagcuuggugucugaaucuucuuugauuuuuagaaugcagacauugguaaaagagaagcuguucuuuaacuucuuagcuaacacuuucuguaaacauucauuucugggccuaggucaucuuuuuacuugagauaccagaucaucauguucagguugugcccucuaugauacaugccaucucauuccucugguuucagaagacaaaacugagggcaacuccugaagcaauacagaaccgucuucaagauauugaagaaaggaucucggagcgucagcgcauucuuugccugccacagagauuugcaaagagcaaacagcugacccggcgagaaauggaaauagaaaagucuuuauuucagggagcugaucgucacuccuuccuuaaggcucuuuauuaccaagguaugugauccccacugacuuugauauauucuuucacugagagaaagauuaaacagcagggcauuaaauaugaagaguuagugaagggaauaggggaaagacaaauugucacuacuuuugagaaauguauaauaccauaagagagacaaauaugugcacaguuaguugcaugacaacauggaaacugcuauuauagagauuugaauaaaaugcugagguagugcagaacacagagcaucuaagucuaguugggggagucagaaguugacauuuauacuaacuccugauggaucaaugggcauuugucagguaaauaaaggggaauggagauuaaagguaguaaauagcaacaggauuaugaaagaaccuggugugucuaaggaacaaugagaaguuuaacguggcaggaguagaagaaguggcagggaaugacaggaggugacacuggaaggaaggggaggcgaagcuagauugugaagggucuuuaggcugaacuacaaauuagcacaaaauauauagauaaauaguaugugucuuaaccagaaggauuuaguuugacagauaaguuuuacuagacgcuguggaaggugcauggaaguuuaagaaaugguuccucaccuugugccaaguauagucugguuggagagauaaacauguaacauuuagugacaauacuagauacauuuguuaaguguuguuggaguucagaggaggcaaaggccacuguguauuggugugauugaagaagcccucucagaggagguaagauuuaaauguucuuuuaauacuaccuauucuuuagaaaagagagguaaugacauuucaguugcaacagauggugugagcacuagggagugugcuaacuauggaggagaugugagacaagguuagaaagguagcuaaaaauuuugaacuguauuugguaacuaguauagacuuauacagaguuaguuaucaguuaguuucaauaugguugaagguuuuugaaccagaagugacaugauaaaagccauauuugaaaauuauuaaucugguggucaauaaauaggauuagagagaggaagaacuggaagcaggcagaauggauaggagauauuacagucauuuaggcaugaagacuuggucuagagugauagcagugaaauuggagagagguagguuuauaauggaagaacuaauaaaacucguugacugaaaaugaaggagggaggucaaugcagagguaugugucaaagauaauccagagguuucaaggcugugugacuuaccaauuggcaaaauuaagaaagccuuuauggggaaauuucgaggaaggaugaugaguuugauuuuaaacauguggaauuugugagaauggcaggaucaucaaaugcagauguugaggagacaguuggaaaugcagccgugaagcucaggagagaggucagaacuagauauauagaacugggaaucaucuauccuuagauaacauguuaaggccgugagaauggaugaaugauuuguuagagauagaaggaucauagacauggcagagcaguggugaaggaaggaaugaaugaacaaaugaauaaccuuuuguggagagacauuuagcauaaugauuaagaacaugggcucuggaggcagacugccugggaaaauccuggcucccccacuuaacuagcuaugagaugcuaggcaaguuaccucucuaugcuucaguaucuucaucuguaaaaugagaauauuaauaguagcuauguuacaggguuacuaagaggauuaagugagagaauacauguaaaucacuuaaagcaguaccugguauuugggguggagggugggugguuuaugaaucuguucuguuuccuaucuuugaaacuccuugcuuuaaaccuucacagcauaccacaaaaagacaagugcagacaaguacaugaccucaaugaagaggaagauaaaauuaggcacaaaaggcaagucgagaguuuucuuauaguguuagacuuaggaauguaaccuagggucccaguugagcacuuauuuaauuccauauucaguauaugacaauguuuauaggaaaugauccagagggagcauauuauccugauacagaauauuaaagagaggaguuaguagaaguuguaaagcuuuuacauuuacugcuguuguuuuuucucuauacauuuaaauuauuguaccagacauaaauugaccuuaaugauuuuuagaucccauuucacaaauaauucugaauauuuuuauuagucaguaaaguauaauuauugaugaugaugaugauaugauagcuaauauuuucuuacuuuugaaaugaacuuccaauaaaauugcauggggcuucuucuuuuuugguguacaauucuaugaauuguaaaucauguagauucauguaaccaccaccacaaucaagaaagagaauagcuucaucaccuuaaaaaacucccucaugcugucccuuuauagucauucccaacccaccauaauuccugacaaucacugacuguuuuccaucacuguaguuuuaucuuuuagaaaaugucauguaaauggaaucacacaacauguaaccuugugagacuggcuucuuucacucagcauaaugccuuugagacucauuugaguuguugcguguaucaauaguucauuuauuuuguugaguaguguuucaucauauggacauuccaaaguuuguuuauccauucacccauugaagugcauucggguuguuuccagguuaugauggcuaugcauaauauugauaugaacguucuuguacagguuuuuuugugaacauaaguuuuuauuucucuaagguaaauaucuagaagugggauuacugggucauaugguaaguguacauuuaacuuuauaugaaacugccaaaccauuuuccagaguggcuguaccauuuugcauuuucaccagcaauguaugaaaguucgaguugcucuacaucuuugucagcacuugguauugucaguauuuauuuugguuauuucaauagcugugaagugguaccucauuguaguuuuaauuugcauuucuuuaauggcuaaugauguugaacaucuuucauuugcuuauuugccauccuuauauccuguuugcuaaagugucuguucaaaucuuuugcuguuuuauaauuggguuguuuauuuucuuccugaugacuuuugagaguucuuuguauauucuaaacacaaucuucuguuggauaugugauuuucacacauuuuuucccagucuguagcuugucuuuucauucucuuaacagugucuuuugcagggcaaacuuuuuuuauugugguaaaauauacauaaaauuuaccauuuaaaccacuuuuaaguguguaguucuauggcauuaaguacuuucacauuguucugcaacuaucacagccauccaucuccagaaauuuuucaucuucccaaacugaaacucuguacuuauuagauacuaacuccccguuuucuccauccccaccagccucuggcaaccaccauccuacuuucuguuucuaugaauuugacuacucucaguauauaaguggaaucauacaauauuuguccuuuugugacuggcuuuaguuagcauaauaucuucaagauucaucuaaguuguagcaugugucagaauuuucuuuuuaagguggaauaauaucccauuguauguauauagcacauuuuguuuaucaauugauggaugcuuaaguuguuuccauguuuuagcuuuugugaauaaugcugcuacgaacauggguauacaaauaucuguuugaauaccugcuuucaauuauuguagguauauacucagaaauggaauugcuggaucacaucuuaauucuacauguaauuuuuugagaaacugccauaucaguuuccauagagacuguaccauuuuacauucccaccagcaaugcacaagauaagaguuccaguuucuccauacccuuggcaacacuuacuauuuucuuaaaaaauaauagccguccuaauggguaugaaauguuaucuuauugugguuuugauuucaauuucccugaugauuagugcuguugagcaucuuuucacaugcuuuuuggccauuuguauaucuucuuuggagauguaucuguucagaucucuuguccauuuuuaaaauaaguuucuuguuuguuguugaguuguagaaguucuauauauauucuguauauuaauuccuuauaagauauaugacuugcaaauauuuucuccuauuccaagaauugccuuuucacucuguccuuugaugcacaaaguguuuaauuucgaugaaguccaauuuguugauuuuuuucuuuuguugucuaugcuuuuggugucauauccaagaaaucauugccaaauccauuguuaugaaaugaaggcuuuuccuuauguuaucuucugagaguguuauagcuuuagcucucauguuuaggucuuugaaccuuuugaguuaauuuucguauaugguauuaagguaaaaauucagcuuuauuauuuucauguugauauucaguuuucccagugccaguuguugaaaaaagacuguucuuuccacacugaaugauccuggcacccuauucaaaaaucauuugacuauauauaccugucuuuaugccaguaccacacuguuuuaauuacuguaaccuuguaguaaguuuugaaaucaggaagugugagaacuccaacuuuguucuuuuucaaaauuguuuuggauauuuggggauugguugagauuccauaugaauuuuagaauggauuuuucuauuccuguaaaaaaauguuauugacguuuugguaggacuuacauugaaucuguauaucacuuugguuaguauugaugucuuaacaguauugucuucuaagucaugaacaugggaugucuauuuauuugugucuuguuuaauuccuuucagcaacauuuuguaguuuucaguguauaagucuuuuaccucacagaaaauguuuucaaguauuguuucaaaucuuguuuaucaguugauccuuucauggguugccuuuuauguaugugcauuuauauguaucuaacaacucuaccuguucaugaaaaagauauuuuccuauguuuucuucugauaguuauauaguuauacauuuuacauuuagaucuaugauccauuuugacuacuugauguuuauauaagguaugaaguuuagguuaaaguucacuuauuuuuuuuuuuuggcuucaaauguccuguuguuuuagaaccaacuguuaaaagaguauccuuucuccauuuacuugccuuugcauuuuugucagaaaucaauuggccgaauuuguguguuaauacuuaaccucauaauuaauggugaaaaguugaaauucuuccccaaagaucaaaaauaagauaaggauguccacucuugccacuucuguucacaguggaaugaaauucgaaauaaauaacagaaggacauuuaggaaaauuacaaauauguggaaauuaacacucuaccaaacagucaaugaauuaaaaggaaaucaaaaggaauauuagaacauauuuugagguaaauuaaaacacagcaugccaaaaacuuauggaguaaaauaaaaucaguguuuagggggauauuuagcuguaaugcccauaguuguauaugcccauauuaauaaagaaaaaagauuucaaauuaauaacugaaaucuccaccuuaagaacuuauuaaaagaagagcaaacuaaauccaaaucaagcugaugaaaagaaauaauaaaaaauggagcaaaaauaaaugacauagaggaaauaauagaggaagucaacaaaaccaaaaguuaguucuuugaaaagaucaacuuaauuuauaaucccuuagcuagacugaucaaguuaaacagaaagaagacucaaauuucuaaaacucagcuccacuuugguucuuauuuguaugggacaucuuuuuccaucuuuuugcuuuuaaucuauuuguguuuuugaaccuaaagugugucucaugacagcaaauaguuuggauuauauuuucucuuuuuaaucaauuauuucaaucucugccuuuugaguggagaguuuaguucauuuauuuuaauguauuuaauuagagucuguuaaggauuuacaucugcuauuuugcuuuuuguuuucuguuucucuucuaucuuuuuuguuccucuguuccuccauuuauuccuucuuuuauguuaaauagauuuuuccaaugugccauuuuaauuaacuucuugccucuuuuacuguuuuuguguauguguguguguguuagugguugcucuggggauuacaauuaaccucuuggcuuaaauaaauuaauuuguauuaaaaccaacuuaauuucaauuauauuaaaaaacuuuguuuagcuguucucuaccucccauacuuucuacuguaauugucauaccaauuacaucucagaauguggcuuuucauugaagugccaggcaggucaaauaguuccauccagguaaaauagugaaaauucuccaaggauggggcuuuuauggugcuccagaacuggucugccacuccaguuucagauaggcugcugguuuuugcagcuucuguuguugcaagguuguugguuuucaaggcuacugcaaagcuagagaaggggagaugggaugauggaaagucgaaaugcuacaaaccucacuguuuaaguuacauucaucucuuagcauauggauagccaauuguccuggugccuuuaguugaaaagacuauucuuuuucauugaauugucuuaauaucuuugugaaaaaucaauuuaccauaaauguaagaggcuuuuuaaaauguuuuuuuccucuucauuuucagcaauuugauuaugccaugucucuucugcacaugaguucuuuguuaguucaaauucuugguuucuuaccccuuccuccugcugccauucacucuucauagcauuuaaauguaccauacauucuuuccagguuuuauaacuuuauucaaugggagucacggagugaagugugcuaacuucaucuuacccacaaacaaguccuaauagcuacuaauuuugaggacuuauuugugccaguccuugcuaaguauuuuuguaaauuaucacauuuaaaccuuacagcacccuaugagauaguacaguauuauacccaauuuacagaaaaugaaauugagcuucagggggcauaagugauuuucuuaagaucacaauuauuaaguggccaugcugggacuuaaauccauguuuguccuuacacaaaagucuguacuuuuguccacagcacuuguauaugugauuggaaaagauuuauugguuuauuaagugugauuuuacuauaucucgagacaaacuuuucuggaguuauacauaucccauuuucuaaccuugaaucagugagaaagaaacauauauuaucucuagaaauauauuuccucugaaaucuucaacuauaguaugguacucucugacuacaaccuuucucuuauccuucuggcucgcauaacucucuuaaauucacauaccaucucuucaacccuguuuauaucuccaguuccuugaccuuuuaauuuucucccaaucugucagccccuuucuauuucuucuugcuuucaaaucucacuuagacucuaucauccauuauuuaaccacccaucuugacaaugaaucauucucuuugcuuccuugucuauguaucacauccacccagcaaaaccucaaacucaaaucaaccagacuaauugccuucucuauuucuacaucauggcuucugggcacugcuagaaagaaaacauaacuuuguugauuauugccucuacaacuuucucgucucuguuauugguuagagccucucccuuguucaacaaucuaucuccuagucccuagucagcucacuauuucauuccuuauaaauaguauuuuaaauccucauuacucuuuccuuuccuacuauuuugucauuuuuaacagucuuccauccuauuucaaaggaaacugccaucagcaagaacuuucauccauuuccugcuucaugcucugcuaacuucuguauccucacccuuguuuucuucucucuugacucagugcuagggaaguccuuucugcuuaaggcuaauguguauaauuuugugcuggauccuaucccuuuuaucuuccaaauaacuucagucauccccaguauuccuucuuucuuuuuaggguuuuaacaugacuuguauacuugucagacuccauggucuacauacgcuuaccaugaacuaucuaaagaaaaugauaaaaaugaaaaaugucuuucaauugauuagcuacuugaacaaauaauacauuuagauuuuccucuuuuuuuauuauacuuuaaguuuuaggguacauguguacaacgugcagguuuguuacauauguauacaugugccauguugguguacugcacccauuaacucgucauuuaacauuagguauaucuccuaaugcuaucccuccccacuccccccaccccacaacaggccccgguguaugauguuccccuuccuguguccauguauucucauuguucaauucccaccuaugagugagaacaugcaguguuugguuuuuuguccuugcaauaguuugcugagaaugaugguuuccagcuucauccaugucccuacaaaggacaugaacucaucauuuuuuauggcuacauaguauuucaugguguauaugggccacauuuucuuaauccagucuaucauuguuggacauuugcauuaguuccaagucuuugcuauugugaauagugccgcaauaaacauacaugugcaugugucuuuauagcagcauguuuuauaauccuuuggguauauacccaguaaugggauugcugggucaaaugguauuucuaguucuggaucccugaggaaucgccacacugaauuccacaaugguugaacuaguuuacagucccaccaacaguguaaaaguguuccuauuucuccacauccucuccagcaccuguuguuuccugacuuuuuaaugauugccauucuaacuggugugagaugguaucucauugugguuuugauuugcauuucucugauggccaguaaugaugagcauuuuuucauguguuuuuuggcugcauaaaugucuucuuuugagaagugucuguucauauccuucgcccacuuuuugaugcgguuguuuguuuuuuucuuguaaauuuguuugaguuguuuguagauucuggauauuagcccuuugucagaugaguagauugcaaaaauuuucucccauucuguagauugccuguucacucugaugguaguuucuuucgcuguacagaagcucuuuaguuuaauuagaucccauuugucaauuuugucuuuuguugccauugcuuuugguguuuuagucaugaaguccuugcccgugccuauauccugaaugguauugccuagguuuucuucuaggguuuuuaugguuuuaggucuaacauguaagucuuuaauccaucuugaauuaauuuuuguauaagguguaaggaagggauccaguuucagcuuucuacauauggcuagccaguuuucccagcacuguuuauuaaauagggaaucguuuccccauuccuuguuuuugucagguuugucaaagaucagauaguuguagauaugcggcauuauuucugagggcucuguuguguuccauuggucuauaucucuguuuugguaccaguaccaugcuguuuugguuacuguagccuuguaguauaguuugaagucagguagugugaugccuccagcuuuuucuuuuggcuuaggauugacuuggcaaugcggacucuuuuuugguuccauaugaacuuuaaaguaguuuuuuccaauucugugaagaaagucauugguagcuugauggggauggcauugaaucuguaaauuaccuugggcaguauggccauuuucacgauauugauucuuccuacccaugagcauggaauguucuuccauuuguuuguauccucuuuuauuuccuugagcagugguuuguaguucuccuugaagagguccuucacaucccuuguaaguuggauuccuagguauuuuauucucuuugaagcaauugugaaugggaguucacucaugauuugacucucuguuugucuguuauugguauauaagaaugcuugugauuuuugcacauugauuuuguauccugagacuuugcugaaauugccuaucagcuuaaggagauuuugggcugagacggugggguuuucuagauauacaauugugucaucugcaaacagggacaauuugacuuccucuuuuccuaauugaauacccuuuauuucuuucuccugccugauugcccuggccagaacuuccaacacuauguugaauaggaguggugagagagggcaucccugucuugugccaguuuucaaagggaaugcuuccaguuuuugcccauucaguaugauauuggcugugggucugucauagauagcucuuauuauuuugagguacgucccaucaauaccuaauuuauugagaguuuucauucaaugcaaaaauccucaauaaaauacuggcaaaccgaauccagcagcacaucaaaaagcuuaucuaccaugaucaagugggcuucaucccugggaugcaaggcugguucaacauaugcaaaucaauaaacguaauccagcauauaaacagaaccagugacaaaaaccauaugauuaucucaauagaugcagaaaaggccuuugacaagaucuucuucuuuuacuguauaccauaauaaguagcaguucguuuaaaaagugaaauguaaaaauuuaagcccuaaaaaagauaauauuaaauagauaauauaauauguuaauauuuuugauauccuaaugggaaaagauuuuuucuauucuuuguuuucagugaaaauuuucaaacacacagaaaagaugaaagaauuuuaucacaaagaaccauuauauuaccaucuggaaucuaccauuaauauuuugccuuaucacaaaucuaucuauacccauacccaucuaucaauccaucuuuauuaauguauguuagaaaaccgcugauguaaauuccuucccccgaaauacuucagcauguauacuguuaauuagaguuaaauauuuauuaaugauuuuucuuuuguugcaaaauuugcaagcaguuaaauguaaagaucuuucaaguguucauuugcugacuuuugaccgguguauaaaucuguagugauauacugguaaauguuuaacaaccaggucucuggcggggggguaggggaggggagcggggaaaacaggcccugauuuguaucauuugccaguuuccaagguguacauauuaccaccauagccaguuucaagcuaccaauauguuaucacugaacauggaauugggaauaaagacaaucaucggaccaucuccaggacacacugcaucuguguaaccuaaccccuaucaacacagaagauuacuaucaccacagaaagucucagcauacuucuuuccaguaauucccauccuacccucucagaggcaacuaguguugugauuuuuuuccaccauagauuaguuuugcuuguucuagaacuucauauaacuggaauuguacaguauauguucuuuguguaagguuucuuuaauucaacauaauguuuuugggauucauucauauugucguauguaucaauaguuugcccuuucuacagcacaauucuuagaagaguuuucuauaauuacuguauuaguuuccuagggcugcuguaacaaauuauuauaaaucugguggcuuagaacaacagaaauuuauccucuccacaguucuggaggcuagaagucuaaaaucaaaggugucagcagggccaugcucucucugcaggcucuaggagaauauccuucguuacuucuucuagcucugguaaguugccagcaauucuugguguucccugguucauagaugcauaauuccuaucucugccucugucaucacauagcauucucauguaucuguguuuucacagugcucucuuaaaaggauaucagucauuggauuuaggccccacccuaaucuaguauuacuucaucuuaauuuaacuacaucugcaaagacccuauuuccaaauauuucacagucuguggcuugagguggacaugaauuuuagagguauacuguucaaccuaguacagucugcccucuggugccaaaaauucacaucuauccacgugcaaaauacauaacauccccaaaagucuuaacccauuccagcaccaagucugagucccaaauaucaucuaaauaccaacucaaaaaguccuaagucucauuaucuaaaucaucuauaucagguauaggugagguucuggauaugguccauccuggggcaaaauuucucuccauccagagacugguggagcuagaaaacaaguuaucugcuuccaaaauaaaauagugggacaggcauaagguagacauuaccauucugaaagggcaaaaaugagggaauaaagggguuacuggucuaaagcaaguuuguagccuagcauggcaaauuccauuaguuuucaaggccuaugaguaauauucugggcucagugcuuuguccacugggcccauauacucagucuaucagggcagcuauagccccauccucucuggccucuaugucuguggcuuugcucuuguaaucauccuuccuuuguccugucucugucucuuucacaccaggcuggcacuggugguuuuugcugguauaagauucucaaaaacauugucagucucauauaugucaagagauuuacaccauuagacaugagguuucucuacagauucuuccuagauaaccccaucuguauuccuggcuucugcugaggugguugauuggauccuaacacccuaacacuuaaucucuucaaugaaaguuuguccaucuauacuguuggcccuguuuccagagcacgcuaucuguauaggcugagaauuuucccaaucaucaaguguuguccccuuuuuucuuaacaguuccuucuucaauuuuccucuguccucuuuuauuuuauuauaagcaucagggagaaacuagccugcaucuuccacacuuugcccauucaucuccuuagugaaauaucaguuugucacuuuuaaguuaaacuuuuugcccaacaguagaacucaauucagccaaguuucugccacuuuauaacaaagauugccuuuccuccagugucuaauaacauguucaucauuuccuucuaaggccuugccagaaguaccuuuaacauuuauaccucuagcaacauuuuguucaugauuacguguauguaaucaugaacacauauauucucuaagguaauagcagcuuucucuacugucucuuuacuucuuucugagcccuuaccagaauugccuuuaacauccguauuucuaccaacaaucuccucaauguaauauaggcuuuuaccaucaagcagcucaaaauucuuccagccucuacucauuacccaauucuaaauccaauucuacauuuuuagguauuuguuaaagcagcaucuuacuucccaguaccagugguacuuuguuauggcagaccuaggaaucuaauacagacuuugguacugggaaguaggaugcugcuuaaagugaauggcuuaaaacaacagaaaguuauucccucacaguuguggaggcuacaaaaucaaaauguuggcaagguuggguccuucuaguggcucugagggagaauuuguuccaugccucuuucuuagcuucugguguuugcuggcaguucuuagauuaucucucuaaucucugccucugccaucacauggcauucugguuguugacuguaucugucucuguaucuucacauguccuucuuauaaggacaucagucauuggacucagagccuacccugugacuucaccuuaacuaauuauaucugcaaagacccuauuuccaaauaaggucauauucuuagguucuggguagacaugaauuuugggaggauucuauuuaacccaguacauuuacuuguugccgcuuguucaccucucauucacuuuuuuugcaaacgaucucuuuauagugagauagaucaugacaaacagcacuuaaaacauuuuuaaucagaucaagaaacagaacaugccgauacuccaaaaauccccauaugucccucacaaaucacaacccucuucccacuagauauaacuacugcccuaacuugugauaauuuccuuauuuuucuuuauaucuuuaccacccauacaugcagcacuagacagucugguuugguuuugccugugcuuaagcauugugucagugaauuauacuguauguauucuauugggucuuccuuuucuacucaauauugugguguuuucuggcaauuauauuugagauauucguacauauugcuauguguagccauaguucauuuucauugaaguauaguauaguauuccuuuauaugaacauaccauaguuuauccauucuacuguaguugcacauuuggguuguuuccauuuggggggcuguauauaucacuucugccacugugaucuuucuuguacauguuuucugggacacgugugcaggaguuucucaggguauauaucuaggaguggaauuggguggugaaguguucacauugucuucaacuuuaauagcuguuaacuaauuucugaagggauucccccaaguuaaaauuccaccagccauguggaaauguuuagguugcucuacauccuuguccacaacagauaucgucagacucuaaucugaugaguauuuacuuguauuuuguugugcuuuuuucccuuuauuauuaguuaacauuuauuuauguuacuuuuuuuuucuuuuuuuuuuuuugagacagaguccacugugucgcccaggcuaaagugcaggggcaugauuucagcucacugcaaccuccacuucccagguucgagcaauucccgugccucagccuuccgaguagcugggauuacagacguuugccaucaccccuggcuaauuuuuauauuuuuaguacagacuagaaauacaaaauauucaccagggacaguggcacacgccauguuggccaagcuagucuggaacuccugaccuccagugauccacucaccucagccucccaaaguguugggauuguaggcaugagccaccacaccuggccaauuuauguuacuuuuuuuaaagccuuuagucaaguguuauuuuccucaaccuuuuauuuuggaaaauaucaaauguggagaaaaguugaaagaauacacccacacccuucaccugcguucaccaacuguugacaacuugccacauuugcuuuaccucucuuccuccauaugaguguauguguauguaguuuguuuacugauaaacuauuuggaguaaguuucagaaauaagaaggauuuacuccuaaauacuuaauuguguaucuccuaagaacaaagacauucuccugugcaaucacaguauaaugaucacucuuaagaaauuuaacauugcuucucuaauguugcaaucagguuucucaauuauaaauccggaauacaauuggagaucacacauuacacuuaguuugcuuuagaacaguuccccgaacaguuccccugccuucguguucguguguguguguguguguguguguguguguguguguguaccuuucaggaugucauuuuaagagucugagccuauauuguuuguuuguuucauugugguuuuaauuucauucuugauaacuagugauguuggauaccuucuuacacauugacuggccauuuggacagccugcuuugugaaauggcuauucaguucuuuugcccauuuagcaaaugugaaaaugccuauuuacuaucugaaugucuuuccgucuguuuguaucuuuguccagaugcagucuugguucagaggucacuuuaggcaucuaucaaaacaauagcuugugaaucuugaagucagcagauaaauaacuuuaaagacaaaauaaccaaugggugaacaccaaagcacuaagauauagcacaucucaguuauugccaccucucuacaggaaggaaggagguaggaaaguguugagguuauacauccugaauacucuguauccaauuuuucucuaaucauaggugcauuuucuuauaaauuuguaccagucuuuuuauuauuauggauacuuguucuguguugguaauauauguugaaaauguauauuccaauucuguaguuuaucauuucacugccuuuaugguaucuuuugguaaacaacaguuguugaucucuauguaauaaaauuuauuaauuuuuucuuuauacuuagugguuuugugcuuugauuaauaaauccuuuuuuuuuucugagacaaagagucuuccccugucacccaggccgcagugcaguggccugguucacugcaaccuccgccuccuggguucaagcaguucucaugccucagccucccaaguagcugagauuacagauaugcgccaccacggccagcuaauuuuuguauuuuuaguagaggugggguuuuaccacguuggccaggcuggucucgaacuccugacuucuggugaucugcccuccuuggccucccaaagugcugggauuacaggcaugagccaccgcgccugggccugauacuguucuuuauucuaaaagcuuuauguuuuuugccuuucacauuuaagucuuuaauccaccuggaauugauuuauguaugugguauaaaguaggguuccaguuccuuuuuucccucauguagauagccuucuaacaccaaauauugaaaaugucuagacuguuauuguguugcaauaucagguguucauauauggauggauauucugucauauaucagguguucauauaugaaugaauuuuuuuuugauucucucuuuuguuccuuugucuuuuuggcuauuuuagaaucaauaucauacagucuagcuuuaugauguuuuaguaucuggagaauaauucuuuccaacuuguuuuucuucaaaaguguuuugucuacuuuugacacuuugccuuuccauguaaauuugaaaaucuaugaaguuacacaugcacacauaccuuuauaugauuuugauugggauuccaucgagcauuuaagucaauugaggucaauugacauaucuaugagucuucaaaucuucaaaugugaacaugguaccuuuccauuaauuuaauuauccuuuaaugacuuucaguacauuuucuguuuucuauuucuucucaccuuuugugauucugaauaauuuguuuauuuuuaaacugcuuuauugagguauauaauuuauacaugauaaaauccaccuauuguaaguguucaauucagugauuuuuaguaaauuuauagaauugugcuaucaaauccagaguccaauuuuaggacauuuccaucacccggggcaaaauucccuagggcucauuggcaguaaaugacucccacauacaccccaagccuuuguuuccauaaauuugucuuuucuagauacuucauaaugaauggaaucuuacaauacguggucuuuugaaucuggcuucuuucaggaaccauaauguuuuggagguucuccauguuguggcauguaucagcaauuuguuccuuuauauagcuaguuuuuuuauuuuacagcuuuauuagucuguucucagacugccauaaagaaauacuggagacuggauaauuuuuaaaggaaagagguuuaauugacucacaguucugcguggcugaggaggccucaggaaacuuaaaaucauagcggaaggggaagcagacaccuucuucacaagguggcaggagagagcgugugugugaaggaggaacugucaaacauguauaaaaccaucagaucuugugagaaugaacucacuaucacaagaacagcauaggggaaaccgcccccaugauccagucacgucccacuaagucccucccuugacacguggggauuauggggauuacaauuccagaugagauuuggguggggacacagagccaaaccaugucaauagauauaccgcauuguuuaaucuuuucaccacuugaugacauuuauguuguuuccacuuuuagcuauuaucaauaauguugccgugaacauuuguaugaacauguuuucauuucucuugaaugaguagaauuucuguguccuacaguaauuccguguauaaccaauuugaggaauugacuauuuccuaaugugguuguaucauuuuacugucucaucagcaauguaugaguucuuauuucucugcauccuugccaauacuuguuauuaccugucuuuuauuacagccauuucaguguguguacugauagcucauugcaguuuuauuuugaauuucuguaauaacaaaugaucuugaauacuuuuucaucugcucauuagccaucaauaugucuuuuuuggugaaaugucuauucaagucuuuugcccauuuuuugauuggguuguuucugaguauaagaauucuuuauucugaauacaaguccuuuauaagguauauauaugauuugcaaauguuuucuuccagucuguagcuugucuuuauuuucuuaauggugucuuuugaagcacagaaguuuuuaauuuuaaugaaguucaauucauuauuuuauggcuugugcuuuuggugucauaucuaagaaaucauugcugaacucaaggucagaaagauauucuauuuuuuuuucuggaguacuuauagucuuagauuuuacaucuagauauauuauacauuugaguugauuuuuaugugugaaguaaaggguccaaguucauauuuuuguauauggauguccaguuguuccagcacuauuuaaaggcuguuauuuuucccauugucuuggcaccuuuguggaaaaaucaauugaccauaaauguaaggcuuuauuucuggacacucaacuugguuccauugaucuauaugccuauccuuauacucuaaaucuuuuuacuguaccuuuauaguaaguuuugaaauuggguaguaugacuccuccaacuuuguuucucuuuuuuaaaaucacucuuuucuauucuaggugcuuuguauuuccauguaaauuuuagaaacagcuugccaauauuuuaagaaaaauaagccugcuggaauuuaauaaggauugaguugaaucuauaauucaauuuggagaaaacugaucuuuaaucauuaaucuuuuaauacaagaaaauagaaugucucuuccuuuguuuagaucuucuacaauuuauuucagcauuguuuuguaguuuuuaaguuacauuuauuuuaucaaacuuaaucuuaugcuuucuuuauugaauuuauuuauuauuuuuuagagacagggucuuguucuguauuccaggcugaagugcagugacacaaucauagcucgcugcagccuccaacuccugagcucaagggauccucuugccucagccucccgaauagcuaggacuacaggugcaugccaccaugcuuggcuaauuguuuuuaaaauuuuguuuagagauggggucucacuguguugcccaggcuggucucaaacuccuggccucaagugacccucccacaucauccucucaaagcacugggauuacagguaugagccaccacacccagccuuuugaauuuauuucuaagcauuuuaaugauuuucauguucuugugaauagaauuguuuucacauuucauuuuccaauuguugcaugcaauuauauagaaauugaguugauauuucuuuuuucuuuuuuuuuuuuuagauggagucuugcuuggucacccaggcuggagugcaguggcacugucucggcucacugcaaucuccgccaccuagguucaagcgauucuccugccucaaccuccugaguagcugggauugcaggcaugugccaccacgccuggccaauuuuuguauuuuuaguagagacagaguuucaccauauuggccaggcuguucucaaacuccugaccucaggugauccucccucuucagccucccauaguggugggauuacaggcaugagccacuaugccuggccuaaaguugauuuuucuauauuaauuuguauccugugacuaaacucuuuuauucuaaaaguuuuauuauggauaccuuaaaguuuucuacauagacaauccuauuuccugugaauaaagacacuucuuucuuuccaguuuggaggauuuuuuuuuuuuuuuuuuugccuccuuauacugucuggaaccuucaguacaauguugaauggaaguggugagagcuaacauccuuaccuuguucccagucuuaggggaaaaguauucaguuuuuaaccauuaaguaugaucuuagcucuggguuuucugcacaugcucuuuggcaguguauuacuuuccuaugaaaagaaaaguaauuaguauguaacuaauuaccguauauuuaguggcuuaaacaauauaaauuucugcccuuauaguucuagaggucagaaaucuuaagaugucaacaggacugcauuucuuuuagaggcucugguugagccuuguccagauccuagagguuaccugcaugccuuggcucuugaccccuuccucacauuauccucugcauacaucaucacaucucccauucugucucugaccuucuugcuuccuucugauaaggacccuuaugauugcauuggucccaccugcauaauccagaaucaucuuccuaucucaaccuuaacaugaucacauuugcaaauuccccucugcaguauaauuuaacauuuucacagauuccagggauuaggauguggacaucuuuggggggccauuauucagccuaccauaagcagguugaagaugcucccuucuagugucaguuaauugagcuuuuaaaaaauuauaaauggguauuggauuuuguuuaaugcuuuuucugcaccuacugugaugaucaugugauuuaagauuuaaucuauugauuuuuagauguuacaccaaucuuucauuucugggauaaaucccacuuaugugugugugauuauuuuguauguugcuggaugaggcuugcuaauauuuuauuagguauuuuugcaucuauauucaugaggaauauuggucugugguuuucuuguaauaucuuuguuuaguuuuguuaucaguguaauacugauaucauagaaugaauuggaaaguauuuccuucucuucccuuuucugaaguguuucugcaggauuaguauuauuucuuuaaguauuugauagaauuuaccaaugaagccauuuggaccuggguuuuucuuuguggguuguuuauugaguacuaaugcacccucuuguuauucguuuuuucuuugagacugcuuugguaauuuguaucuuucuaugaauuuguccauuuaucuagguuuccuaauuuguuggccuaaaguuauuuauaauauuccuaaauaauuguuuuucauucccuaaaguuaguagugaugcuuccucuuuaauuauugauuuuagucauuuuugucuucucucuuacuuucuuguucagucuagguaaagguuugucauuuguuaaacuuuucaaagaaccagcuuuugguuuuguugauuuuucucuauuuuuccauuuucuauugcguugauuuauuucuuaaucuuuauuguuuucuuccuucuacuugcuuucuguuuaguugacucuuuuucuaguuuccuaacuuggaagcucagguuuuaaauuugaaaccauucuucuuuuccaauacaggcauuuaaagcuuuaacugucuaucauauggaugcagcauuguuuuagcugcauccauaaauuuugauauguuguguuuucauuuucauugaggucaaaauauuuuuaaauuuccuuuaugaguucuuugacccauggguuauuuagaaguuuguuguucaauuuccagauauuuguguuuucccguuucuuacaguaguggaucacuaauguauguccauugugguuacagaacauacuuuauaugauuucagucuuuuuuaguuuuuuugagacauacuccuaccuugagaccuuacucuaauaucaguaugauagaugcccuugcuuuuuucaggucuucacucaaauagcaccuucucaaugggaccuauccagaccaacauuaaaaauuacaaccaccccauagcucuuccaaucuuaucuuguauuuuuuuucuuuuuuauagcacuccuaccuucuaacaugccauguaauucacuuagcucuacaaagggaggaauccuuauuuauugaugcauccuuaauuauuuuuuaguguauuuauuaaucuauucauccacuuggacauauguagcugaaauuuguucacuuucuuuggaugauaguauuucaucauauaaacguaccagaauuuuauaauuaauucuucuuagaugaacauuuguauuuuugcuaacucugggcaauuauaaauagcaaugaucugaaaauucuuauuauuguguccuggugcauauaugccuacauuuuucuaagguauauaugugggaguugaauugauggauuguauguugagcauaucuucaacauuaguagaugaugucauguugauuugcacuguguauacacauucccacuagcaauaugugaggguaccaguugcucuacaacuucacugacauguaauguuggcauucuuuuuaauuuuugccaauauguugguuuucuauuaguaucuuauacccuuccuaauuugcauuucccugaauucuaauguggcugagcacuuuuguauauauuuauuuuauuauuuuuuuuaauuuagagacagaguaucaccauguugcccaggcuggucuugaacuccugggcucaaggaacuuuccuccugccucagccucccaagugcugggauuacaggcaugagccaccacgccuggcccacauauauuuauuagcuauguguauuuccucuuuuguaagguaucucuucaguauuuugcccauuuuccuaaugguuguucaucuuuuucuuauugauuuguaggaguuauucauguauuuuaguuuuaaguucucugauaauucuuuguguagcaaauaucuuuuccuauccugugggguuuuuuuuuuuugguccaucucuuuaugacaucucgaugaacagaaguucuuaauuuuaauguaguugaauuuaucaaucuuuuccuuaaugguuagugcuuuuugugucuuaggaaauacuuacauaacuacuccuaugccuugcugguggaaauauagaauaguauaacuccuacagcgugaaauuuaacaauacauagaaaaauuacauacacauuugcccuuugucucagcaguuucacuucagggaaucuauuuuaaacauauacuugaaaaauaccaaauccuguaugcacaaagcuguuuaucaggacauuauucauaacaguaugagacuagauauaagaccaacguguaucaggaggggaauaguuaaauaaacuaugguacauccacacaauggaguacugugcagcuuuacgaaggaaugagaagagcucuacacauuaacauggaacuaucuccaggacauauuguuaagugcaaaaaaguaaauuguagaacagugcuuauaguaaguuacuuuuuauguaggagagagguauaacuaaugaauuauguauauguguauauaugccuauuugcuuauauuuucaaaaaagaaacaauggaaccauaagccaaaaccuaauaaaaauuauuauuuauggggaaugaagggaaugggauaaaggggacagagauggaagugagacuucugugaagguacuguauaacaguuucacuuuagauccauguaaauauuuugcaucaucuaaaaguuuaaucaaaaagguaaaauucaaucccuaaaauucaaaaacaaccugaagcaaaugagccuaaugauaaauaaaguuaguagcauaaacacacaauuggaaaacaaagcaguuacuuauagugacuuuaaaacauuuguauauuuccaaugggacccauauucuaagggcaaaaguaacugcaaaagaaauauaaaacuauauucagcaguuuuauuggugauaguauuguuauugacauuguaaaauucuguaaguauauuguaggaagaagcuaaugaauaauuuugcuaauauuaagcauaugagaggagauacacucuaaaauaaaggaguuuaaguaaaaaucuuguuaucuuaaauuugaguuggaaauaccaauauaaacucaugguuuacuuuucucuuuaaaaaugucccucuugcucaacaaacuaacacaagaacagaaaaccaaacaccgcauguucucacucauaagugggaguugaacaaugagaacacauggacacagggaggggaacaucacacacuggggccuuucgggggguggagggaaaggggagggagagcauuaggacaaauaccuaaugcacgcggggcuuaaaacuuagauaauggguugauaggugcagcaaaccaccauggcacauguauaccuauguaacaaaacugcauauucagcacauguaucccagaacuuaaaguaaaauuuaaaaaaaaauaaauaaaauaaaauaaaaccauucuaguggaucauuuuaaaaaaaauguccuagcuuuuguccacugaaaaggccuggaaacaacaacuuggaaguugcuucugcacacaccagcaacacacuuugguuucuaaauaccacuuccuacuaaaaggaaccaagggucccuacaaaaauauuccagguuugaguuaggagguaugcaagaugagcuuaggauauuuggcugugccagaaagccgagaagcaauacaggagccgauuugaaggggcucccacuggucuuaagugggauaauuuggccacuaaaaagaauaaugaguauguuuaauugacacagauaaaguauaugaaaauacacgauuucauuauuauacuaaaaauaaccauuggucaccauuggacauuuuuuuuguuuugagauggagucucacucugucgcccaggcugcagugcaguggcgcgaucucggcucacugcaaccuccgcuucccagguucaagcaauucuccugccucagccucccgaguaacugggacuacaggcacccgccaccaugcccggcuaauuuuuguauuuuuaguagagaugggguuucaccauauuggccaggcuggucucaaaguccugaccuugugacccgccugccucggccucccaaagugcugggauugcaggcaugagccaccacgcccggccuccauuagacauuucuaagaugucaacucuuacucucauaauugguaaauaauggcaaagaaucaagcauuuauccugccauucccauaugaucuacauuuuuagggaaaccacauaguugaugaugguaaguucauuuuagaauuacggauaauaagcguaaaagaaagaauuaggaaagccaugauuugcaacucuuaauaaauuaauagacuaggcaguggucaucaguggauguaaaaaacccauuagguggaaggugaaugggaaaauuuaauaauggagggaugagacuaaugccaucuaccaccucaauccacugaucaauuucaguaucacuaaaaauaggaccaccaaacguuaugugucuuaugacaugauacaauaggaaguacauaucugucuauaaaggauuauuuccuaaaaauauugaaccugaaccuaaucaaaccucuggaucagcacuguccaaugcaacuuucuaaaaugauguaauaguuuuuaucuguucuguccaauaugguauccacuagccacaugugacugucgaacacuuuaaauuuguuaaguucggcugaggagcugauauuuaaaaauuuauuuaaauagacacaugugaccaguggcuacuauauuagguagcauaguuauggauuaucugccaagaaauagaagggauuaaggaacaaguuaaacaacaccaucagaaaaugauuaaucaaauucauuuguucauagaacaaauguaguuuauuuaaucaauggaugagugagaaaaugaaauaaagggaugggagagacgaggcacuguuuuagaauaaaaguaucuuaagagauauaacagccaaaggcuaguuuagauuuugaauugaauaaacaaguauaaaaaaaucuuagauggaaucaggacaauuugaacauaacauugguauuagaugauacuaaggaauuauuaauuuugugaaguauaaugcuauauugcuuauauguuuuuaaauguccuuaucaauuagaggugcauauauuugcaugacucuaggugccucacuugccucaccauaguucuggccuauaguucugcuugaaauauacuauaauaagauaacuauuuaccauugucauuugucacagguuguaaagaccugccccagcaguguuucuuuaucugagguccaggauuuaauuuuuauuaauuugccaaagguuguauugguaggcuuuguagaacuucccuaucucuuugucuugauccagaugaaccccaaaagaagaacaaaggugaucccaugaacaaccuggaaaguuuuuaccaagagaugauaaugaaaaaacgucuugaagaguuucaacuuaugagaggugaacccuuugcuucccacucacuggucucagcuacaucagugggugauaguggcacagcugagagcccaucauuacuccaggacaagggaaaacaggcagcacaggguaaaggccccagucuccauguggcaaauguuauugauuuuucaccugagcaguguuggacugggccuaagaagcugacgcagccaauagaauuugucccagaagaugaaauccagagaaaucguuugucagaggaagagauccgaaaaauuccuauguuuucuucauauaauccaggggaaccaaacaagguauaggccaaaccaaguaaaacaaccuggguugauuucgcuuuuauuuaccucuaccuaaaguaauacuuuuaaauuagcuuugauuauaccaaagaaucaugauauaggcacagugauuguguuuguccuugaccuugacuauucauucucugcauacuauauaaguagcauauuuccuauaagguucuugguacuuugcuaagguccugaacuauccuuagcguuuuaaagaaaucuugauaagacucuaguccauacccauuagaagccccgaauugaaggaauaguaacauccaauuuccuacaguguaauaaucaaauaguguucauaggaccaccauagcugguagccuuggugccucuggaauuagccaauaauugacugccuggucgugaguuggguauaugcuaccacaugagucuucucuucagaaugcucuaccuggcugucauaugacauaugacuuaaauugcuguuggcaaagcagcaaagugaaaagguccuauaagcuuuaagaaauuguccaacaaggccaggugugguggcucaugccuguaauccaagcacuuugggaggcugaggcaggcggaucacgaggucaggaguucgagaccagccugaccaacaugguaaaaccccaucucuacuaaaaauacaaaaauuagcugggcgcgguggugugugccuguaaucccagcuuguggaggcugaggcaggagaaucacuugaacccgggaggcggagguugcagugagccgagaucaugccacugcaaaauccagccugggcaacaaaccgagacuucgucucaaaaaaaauuguccaauacguaacuaaauaacguuguagauaauucuuauuuuauugaucaaaucauuauuucacauucauguuauauguuacaucuggaauggaaaacucuucauuacuauauuacucaaagagacaacacaaaccccuggagcauauacuuuguugugucuaauuuaaaaaacaaaaccaaaauuauuauguuaguuuuugacugucucugaauuaaaaaaaaaucauucuagaugagggauauuaaaacaguuuguuugacugauugaauuucuaauaguucggggguauuuauacuauuaguucaaggguagcuuuguuuuuauuuacuuuuuguuaugaaauauuaauauaccaaaaguuauauagaauaauauagcaaauaccuguguagccagccaaccuuuauuaaucauuaucaauuccuaauauuuuccauauuugcuuaauuaaaaaaauaauaaagcauuauagauauuccugaagacuuccacauauuccucaccaaucccauucuccuuuauccuuuccagauguaaccacuauccugaauuugcuauuuauaauuccugugcacguuuuuauauuuuuacuacauagccauauauucacaaauaacauauaguuuuauauguuuuaaaacuauauagaugacauacucuaucauucuacaaccuuuuugacucaauaugcauaaugcuuuugaaauuuauuucuaaagauacaaggaacuauauaguauuccauuguagaaauagaccaucauuuguuauauuuauccacuuuccugaagauuuguucuuucuguuauuuugcuauuacaguuaauucugcaacaaguauuaucauacaccucuuguugcacauaugccagacuuuuucuaggacaguguuuuucaaacuuagauuacaauuaguagguuacaaccaaugggauuuuuuuaaugaaauggaauagaauagaaaauaucaaaaaguguucccuacaguauguuaggguaauuacuguuucuuaaagcuuuuuuuuuauauguguuuguguauaugugacauaauguguguggggccacauugaagaaugcaguucuucguguagaucucaaucaaaaguguugggaaggugucauucuauuacagugucucaaauguuagugugcaucugaauugccuggggggcuuguuaaaacacagauugcuagacuccacccccagaaauuuugacucaguagaucuggaguggggccugagaauuugcauuuccaacaaguucccaagagauucugauccugcuggucgagaguaacaauuuaagaaucaucauucuagguuauauaccugggaguggaauuacugugauauauaggguauguauaucucaauuucuaauguaacaggguuucagagauccucuucacauucuugccaaaacuuuggaguauuauuuugccagccuaaucagcuugaaaaguuaucucauuguuuuaauuugcauguuucugauuuccagugagguuaugcauguauucuuaacauuuauuggccuuucaggaacuuucugugaguuaccuguuacauuccuuugcugaauauuuaaucguuuguuuuuucauauuuauuuauagggauuauuuuaaaauucugcauaugaauccuuucuguuguuuagcaaauaucuuugcccaguggaugacuuaccuuuuaacuuuguuccugaugucuuuuguugagcaaaagucuuucauuuuaauguuaucagauuaucgguauuuuauucaaugguuugugcuuuuugaaucauuuuaaggagauccuucccuacaaaucaauaagaaaaauacaaacaacacaauaaaaauaaaaguguuuauaaaaacagacauaacaggcaguucacagaggcaaaaacaccaguggccuauagacuuaagaaaucucauuaguaaucaauaaaaugcaaaauaaaucuauacuaugauauauacauuuaguacuuagaaugcuggcauauauuuaaaggccugacaaugccaaguauuggugaacauacgaaacaauaagaacucuauguaaccucagcacuuugggaggccgaggccagcagaucaccugaggucaggaguucgagaccagccuggccaauguggcaaaaccccgucucuacuaaaaauacuaaaaauuagccgaguuugauggcacacacuuguaaucgcagcugcucaggaggcugaggcaugagaaucucuugaacccaggagguggagguugcagugacccaagaucaugccacugcacuccaacacuccagccugggugacagagcgagacucugucucaaaaaaaaaaaaaaaagaaaaagaaaaaaaagaaaaacaauaagaauucuaauauaccuccaggggaauauaaaugaauacaaccacuuccaagaacauuauggcaaugucuaguaaaauugaagaucuucauacacuguaagucagcagucucacucuucauuaucuauccuagagaaacccuuagacauccacauuaggagauguuauaaugaugcuuguuguggcauuguucaucagcaggaguauagauaaaacaugguauguuuauaaaauagaauacuacacaguagagaaaaugaauaaaauagaauuauagguaucaauuuggaugaaacucacaaacauaauuuugaacaaaaauagcuaguugcagauuucuaguuucagcuucaacaugugaaguccuuagaagucaucacuccugucuuacaauaagaaaaacaguugagcaaacuaaaaaucaaugacuuuucuuagacacaacagaaaauuuaagucacagggcaaacuguaaucuugaaaucugaagaaacgggcaguuacagaaaaucacaucccagauuugcuuaucaggagcaaaacgcacuggagccauaaacugguagaaacacuuaggugguaacuuugacaaauugcuggcgucagaguguagacuaguguaggaaugacaaaacugggggcccacagucuuagagguuuugauugcuuccaggaaccccacaaguuucaagguaaagaccgaagaaaaaaaaaucucuuguuucuggcauggagagaggaaacaucauuuuuaaguguaucuagaacuuucuacuuaguaaagggcuacccagcaaggaaaacaacuuuaccaaagccuuauccaacuccaggcucuucuagccuuccugucucaucuaagagagaaaaaaagcugugaagugcuugugaagguuacaggcuggagacacaggcacacuaaaagauugagacuucaucauaggauuagagaaugccuccccuuccacaccuugcuacuacaucaacagagcuucaguauaauaaucguggauuauagcugaaagaccugcaaggaucagacucuauuuaaggagguuuuuuuguugcuguuuuguuuugauuuguuuuuuuuuuuuuuuguaaauccaaaggaaacaagggagacaaaaagacaguagaagaaacagaaacuucugacaccuacagcuacaucaaacauuaagcacagcccaacuccuggccagauuaacauaaaaccucauacuaauggucucuuuggauuaguuccuauuacuugauagaucauguccaguuuucaacaaaagaaauuauaacguaugcuaaaaaaaaaaaaaacacacauucugaagaggcaaaacaagcgugagaaccaaauucagguuuuggaauuaucagauauggaauuuaaaauaaccacgauuaauauacuaaguaggcuaugaauaaaaguagauaacaugcaagaccagauggcuaaucuaaacagagagaaacucuaagaaagaaucaaaaggaguugcuagaaaucaaaaacacuguaacaaaugaagaaugccuuugauaggcucaucaguaaguuggaaacagccaaggaaggaaucaguaagguugaagacauggcaauaaaaacuucccaugcugaaauacaaaggaaaaaaagacugaaaaaaaggaacagaauauccaagaacuaugggacgauuucagaguauaacauacauguuauuggaauaccaaaaggagaagagaaaaagaaggagaagaaauauuugaaguaguaauggaugagaauuuuccaaaauuaauagcagauaacaaacuacagaucugggaagcuccaagaacaccaagcaggauaaauaccagaacuacaccuaagcguaucauguucaaacuacagaaagacaaagaaaagauuuuaaaaacagccagagaaaauaaacacuuuaccuauauagaaacaaagguaagaauuacauuucucaucagcaacugugcaagagaguagugugaaauauuugugucaaaaguaaaaagaaaacacccacuuagaauaauuuauccagcaaaaaaaaaaaaauccuucaaaagugaaggaaaaauaauaaagacuuucucagacaaacaaaacugagggaauuuuuucaccaguaaaucccaccuuguagggaaaaaaaaaaaugcuuucaaaaaaaguucuccagagauaagcaaaauuauauaggucagaaacucagaucugcauaaagaaagaaagagcguaggagaaugcauuaagguaaaaugaaaucuuuuauuuucucauuuuaaaacaaucuagaauaaaacuuuucaaauuaauaauaggaauguguuggauaaugauaguauauggauaagugaaaugaguaacagugauauuauaaggaauagguugcaggaauuaguguauauauauaaauacaaauuugucuuuguuauaagguauuugcacuauccauaaagugguauaguuuuaucugagaguggacuuagaucaguuguaaauguauauugcaaacucuaaggcaauuacuaaaaaaaaauuauauaaagaaguacaacugauauggcuaagagaagggugaaaauggaagcauauaaaauaauacucauuuuuuacagucuuuuuucagaaaacggaagcagagggaacacuucuuaacucaugagaccagccuuagcuuaguaccaaaaccagauaaagacauuacaaugacaaaaaacuacagacaguaucccucguguauagaagcaaaaauccucuauguuaggaaaaucaaaacauuugauugaaauauugauugagaaaucaaaauguuagguaaucaaauucaauaauguauaaaaauaauuauauacuaugaucaaguaugauuuauuccagauauccaccauagguucaacauuugaaauucaauuaauauaaucugccacaucaauagacuaaagaaguaaaaucauauggucacuucaauugauguagaaaaacauuugaaauaucuuaacaucgauucaugauaaaaacucucagcaaacuaggaauagacuauaacauccuuaacuugauaaagaauaucugcaacacccuacagcuaacauuauacuuaacagaaacuggaugcuuuccccuuugaugagaaauaaggcaaaaauguccccuuuccccacuucuuuuugacacuguacuagaaguaccagcuacagcaauaaaacaagugaaggaaauuaaaaguauacagauugggaaggaaaaaauaaaacucucuuuguucacaaguaacacguaugucuguguagaaaaucccaaagaaucagccaaaaaacaaacuaacaaacaacucuugggacuaguagauuaguauagcuuggagguuacaagguuuauccacaaaagucaauugcuuuccucuauaccagaaaugaacaauuggaauuugaaauuaaaaacaacaccauuuacaauagcaccaaaaaagaaugaaauacuuagguauaaauuuaacaaaguauguacagguucuauaugcacaaaaguguaaaacugaugaaaaauuaaauaagaucuaaauaaacacagagacauuuuguguucuuggauugaaagacuuaauauuguuaagauaucaguucuucucaaauugauuuguagauuccacacaaucccaaugaaaucccagaauguuauuuuguggauauuuaggaacuuaaucuaaguuuauaugaaaagacaaaagacccagaacauguaacacacuccugaagaagaacaaauuugaaggacugacacuacccaacuucaagaguuacuauaaucaaguagcauggugugguguugcugagggaaaagaagacauacagaucaauggaguagaauagagacccaaggauuagacccacauaaauacaguaaauugauacuugacaagggaucaaggacaguuuaguagagaaagaauagucuuuucaacaaauggugcuagaacaacugaauagccacauguaaaaaaaaaaugaaucuagauacaaaccuuacauccuucauaaaaauuaacucguaauggucauagaccuaaauauaaagcacaauacgauaaaacuucuagaagaaaaagauuaaaaucuaagugaccuuguguuugaugauguauuuaucagauauaucaccaaaaguacaauauauguaaggaacaauugguaagucagacuuuauuaacauuauaaacuucugcuauaugaaaaacacuuuuaagagaaucaaaagacaagccacagacuagaaaaauauuugcaaaacucacgucuaauaaaaaacuuguauccaaaauacacaaagaauucccaaaauucaacaguauuaaaaaacucaauuuaaaaaauggguaaaaaauaagaacaaacacgucaccacagaagauauauacauggcaaauaagcauacgaaaagaagcucaucuuuauuugucaucagagaauugaaaaaugagaagugccacuacacaccuacucgaaucgcuaaaguccacaauaaaacugacaauaccaaauucuguucaggaagcagagcaacagguacuuuuuuaaaaauuauagauguagaagauacaagugcaguuuuguuuuguuuuguuuuguuuuguuuuguuucguguuuugaggcagagucucgcucucugucacccagacuggagugcaguggugcagucucagcucacugcaaccucugccucccugguucaagcaauucuccuacuucaacuucccaaguagcugggacuacaggugcgagccaccacgcccagcuaguuuuguauuuuuaguagagaugggguuucgccauauuggccaggcuggucucaaacuccugaccucaagugauuugcuugccucggccucccauagugcugggauuacaggcaugagcuaccaugcccggcugcaguuuuuuuuuuuuuuauggauauauuucacagucaugaagucugggacuuuuauucauugcuggugguaauacaaccucuuuggaagacagguuggccaccucuuacaaagcugaacauuauuuuaccacacaguccaacuacugcauuccuacuuauuuacccaguugauuugaaaagccuguguucaacaaaaagugccaugugaauguucauaguagcuuuauucauaauugccaaaaaccggaagcagucaagauguccuccaauagguuaauggauacauucaccuguggcagaucuauacaauggaauauaauucagcaauaaaaagaaaugcauguccagccacaaaaagacauagaggaacuuuagauauauauuaauagcugaaagaagcuaguauggaaagacugcauauuguaugauuucauuauaugacauucuggaagagggaaaacuauagacagaugauaaaugacugccaaggguuugagggaaauggagaagggagaaauacaugaaacacagggaaucuuuagggcgguaaaauuauucuguauaauacuguaguuguagaggcaagacaugcauuugucaaaaaccauuaaacuacauagcacaaagagugacacuuaauguaugcaaauguuaaaaacucauuuaggagguugagagacccuaggaaagaaugcagacagugagaagagagucuaacuguaaaacaaccucaucgaagggaugggggaaaagaugcugaacuaagcaucuuuggaaauauguggagucugaaagacuaaaagcaaauggaacuucacauaagcacgguacccuuauugauaagguuauuucccauggcagguacugguuacuuagggaguaacaauucugauacucuuauacaugcauaauggaauggaacaauuaaguaaauguauggcagauggcgggggccagguuucucacuguugcaaucuacagauaaguaaagggaggaagcugaaaugauccaugugauaaugguuuacaguuggagacaucaggaugaacucauguuuaacuuaauauagauauaaguguuuacauauagaaauauuuauauguguuuauauauacauggauuaguauaaauacauauuuuuuauucugugagaugaaaggacccaaaugaaaggacacaccaguagcaaugagcuugcacagcauccuuaucuugguuucuaauaccauuuucuaauaaaaugaaccagggcuccuuagagaaauggcugcuucuaauacuggggcaggaaauauacaagaugagccuugugcaucuuguagugccagaaaguaaggaagugcuaaaaagaacaauauaaaaucauuauuuuauuguucuuugacaugaugauuuuauguuuuuuuuuuugacauucgggguauuucaaaggaauacaggagccaaaugaaagagcuuccuaugacuaaagccagaacaauuugugcaacaaacuaaauaaaauaaaauaaaucauuaucuuaaaucauuuuauuguucuucgacaugaugauuuuauguuuuuugacauuggggauauuucaaaggaauacaggagccaaaugaaagagcuuucaaugacuaaagccagaacaacuugugcaacaaacuaagauaaaauaaaucauuaucuuaaaaucauuauuuuauuguucuuugacaugauuuuauguuguuuuuugacauugguauugcaaaggaauacaggagccaaaugaaagagcuuccaaugacuauagcuggaacaauuugugcaacaaacuaaaauaauguuggauaauccaauguauagaauaaacauccaugaguccaggugauauaaauaagugauugaguaaacaaauauauagaggaaaagaaauauacaccucccaugaaaaagaauuucauacaacuuauguagauacucugccucagggagggagagcauaacuccccauuccuuaguuuugagcugcucauaaugacuucuuuccaaaagaguacaggaagagaaagcaggaaaaaagaguaacuuuucaagaagaaaccugacaaacuaccuaagccaggugauuaaggccaacaccaauaguuguuaaucauauugaugaaucauauugauuguguguaugcuuaacauuaugugaucaaaacuguacuucuccugugugguuuucuucccaauaauccauaaucccagucuaaauguaauguaaccuagauccuagaacagaaaaaggacauuagguaaaaacuaaggaaaucuaaacuguggacuuuaguuaauaauaauguaucaauacugcuucauuaauuguaacaacauauuaaugugagguuacauuacauuacauuaauguaagauauuaauaacagggaaaaccaugggguagaugggaguucucuguauucucaauuuuucuauaaauccaaaacuguucuaaaauuaaaauccauuuuuaaagaguuuuuaaaaauguagcuguagaagaaugcauauuguuuauauaaagggcuauauuacaugaaguugaaaacauguaaaauaauaccguguauugcauagggauaccaggaagagcuuuaugcuguauuaugacuuggaggcacuguuuuucuuuuucacagcuuuguuuaucuuguuuuugaaccuagcuuuaucuguguguguguguguguguguguguguguguguguguuauguauguuguggauacauucauacauacauacaagucugcacuuacguguguauauaugcagaggggauguaucccagcauccccugacagagccaccucaaccagaaguccucuuuauuuuuaaaaauuauucauauuggccaggugcgguggcucacgucuguaaucccagcacuuugggaggccgaggcggguggaucaccugaggucaggaauucgagaccagccuggcuaacauggugaaaccccauuucuacuaaaaauauaaaaaauuagcugggcgugguggcaugcaccugcaaucccagcuacuggggaggcuguggcaggagaaucgcuugaaccugggagguggugguugcagugagccgagaucacaccauugcacuccagcuugggcaacaagagcgaaacucugucucaaaaaaauucauaucaaagggaacagucuuaguaugggucuucccuaauggaugagaaacucgaaguuuguuuucacauaccccuuucuaugguuauuuaauuugauauuuucaugauuaguauuugagagcauaggcaagucaauuauuccaugcccuugccuuuaagauaugaacauacauaaaugcuaaauauguuaauauccagguuuuaaagauuuugaaacuuaaagauucuacuacuuguuaacaauauuuauuuauuuauaccuuuuagcacuuaagucauuuaagagguauauuugcuuguucuuugcuuuugcugcuccugccugaauucuuccauaguuccuuuaagcuauaaaggauauaacuaaugcuagguaauguaugagauuuuuuuccuccuccauuuuuuuaaauuguguuuuaaaaacacaagaucuauccucuuaacaaauuuuuaaguguacaauacaauauugugaauaauaagcacaauguuguacagcaaaccuauagaacuuuucuaucuugcaugacugaaacuuuauaccugucgaacagcaacuccccauuuccuccuucccccagcccuggugacuaccauucuacuuucuguuuuacuacuuuagauacuucaguaaguggaaucaugcaauauuuguccugcaacuggcuuauuucacuuagccuauaguccucgaguuucauucauguuacagcauaaugacauauaagauuuccugcuuuuuuaaggcuaaauaauauuccauuguauuuuauuuauuuauuuauuuauuuauuuauuuauuuauuuauuuauuuauuugagacggagucuggcacugucgucugagcuggaauacaguggugcgaucucgguucacuacaaccucuaccucccagguucaaguaauucuccugucacagccucccauguagcugggauuacaggcacccaccaacgcacccagcuaauuuuuugcauuuuuaguagagaugggguuucacuauguuggccaggcuggucucaaacuccugaccucaugaucugccugcuucagccucccaaaaugcugagauuacaggcgugagccaccacacccagcccccauuguauuuauaugccacauauucuuuaucuauucaucagucaguggacacuuagguuuuuccaccuguugacuauugugaguauugccgggaugaacauaggaaugcauauaucucuuugagaugcugauuucagcucuuuuggauaaauacccagaaaugggauuguuggauuguaugguaguucuaauuuuaauuuucggaggaacuuccacacuguacuucauagcagcuguaccacuuuacauucccaucaacagugcacaaggguuccaacuucuucauauccuugccaacauuuguaauuuucuguuuuuuuugauaauggccauuguaacagguaugugguaucucauuguguuuuucauuugcguuucucuguugauaguaauauugagcaucuuuucauauaccuguuggcuauuuauaucucuuuggagaaaugucuguuuaagucuuuugcccauauuuuaaugagguuguuuucuugccaucaaguuguagaguuccuuauauauuuuagauauuaaauaugguuugcaaauauuuucuguuacuccauagguugccuuuucacucuauuguuuccuuugcugugcagggcuuuuuaguuugaugcagucccacuuaucuauuucugcuuuuguugcaugugguuuuggugucauagcaaagaaaucauugccaagacuaaugugaagaagguuuuccucuauguuuucuucuaggaguuuuacagucucaggucguauauuuaaaucuuuaauccauuuugaauugacuuguguguauggcguaagauaaggguccaauuucauuauuuagcauguggcugucuugucuucucaacauuuuguuaaagagacuaucuuuuucucauguuauauucuugggacacuuguagaagaucaguugacuguagcuucauggguuuauuucuagacucucaaauugguuccauuggccuauguguccaguuuuaugccaguaccauacuguuuugauuacuguagcuuuguaauauguugugaaauaagaaaguguauggccucuagcuuuguucuuucccaagauuguuguggguacuugguaucaucugugguucuauaugaauuuggggauuguuuuuucuauuucuguaaaaaaugccauugggacuuugauagagauugcauugaaucuguagaccgcuuuggauaguucggauauauuaauauuaagucuucuaauccaugaacacaggauaccuuuucauuuauuugugucuucuuuaauuucuuucagcaacauuuguaguuuucaguguacaagucuuucaccuccuugguuaaguucuuucuucaguauuuuauucuuuucaauaccguuguaaaugggauaccuuucuuaauuuccucuucauauuguucauugguaguguauagaaaccacaacugaauuuuucuauguugauuuuuuauucugcaacuucacugaauuuguuaauuaguucuaacuuuuuugguuuaauuuuuuucuauuauuuccauuaauauagucauaauuucaugccaauaauaaaaugguauaauuaaaacagaaaagugauguucucaagaggucuuccaugaaagcuauuugaacugugggccaaauaaacaugguaccaccauucaccagguagcagcuugucucagcugcaaaguacccaagggagaaaaaucgaugucuugauugcugcacuugugaaccuugauuuauuauuuuauuuauuuucuuuuuaaaguuuuuuaauugacauauaauaaauuauacauauuuaugggguacauacugauguuucgauacauauaauauauagugaacagaucaagguaauuagcuuaucuacuaucuuaaguauuuaucauuucuucauguugggauaauucaauauccuucuucuagcuauuugauacuauauaauauauuauuguuaacuauaaccauucuacaaugguauagaacacuagcaccuauuccucuuaucaaacuguaauuuuacaucuuuaacaagucucucccuauccuuuccuuccuccuacccuucacagccucuaguauccucuguucuacuuuuuacuucuaugaaaucaauucuuuuuagcucccacauauaaguaaaaaccugcaguguuuaacuuucugugccugguuuauuucacuaaacauaauauucucuaguuccauccacauugcucugaauaacaggauuucaauauuuuuauggcugaauaguauuccacuguguauauauaccacaucguugggcaccuagguuaacuucauaucuuggcuguugugaauagugcugcaauaaauaugagaaugccauugucuuuucaauauacugauuuccuuuccuuuggauaaauucucaguagugggauugcuggaucguaugguaguucuauuuguaguuuguugaggaaccuccguacuguuucccauaguggcuguaaaaguuuacagucccaccaacagucuguaauaauuugcuuuucuccacauccucaccagcauuuguuaacuuuugucuuuccaguaguagccauccuaacuggaaugagaugaugccucauugugguuuugauuugcauuuuccugaugauuagugauguugaguauuuuuucauauauuuguuggcaauuuguaugucuucuuuagagaaauagcuguuuagaucauuugcccauuuuuaaaucagguuguuuguuuugaugcuguuaagauguugaauuccuuguauagucuggauauuaauccccuguugggugaguaguuugcaaauauuuucucccauucuguaguucgucuuuucacucuguuguuuccuuugaugugcagaagauuuuaguuuaauauaaucccguuuguuuauuuuugcuuucguugccugugcuuuugaggucuuauucaugaaaucuuuucccagaccaguguccugaaauguuuccccuauguuuuuuccuaguaguuuuuuaguuuccggucuuacguuuaggucuuugaucuguuuugaguugauuuuuguauaggaugagagaugggggucugguuucauucuucaugcauauagguauccaguuuucucagcaccacuuauugacgagacugucuuuucccaacugauguucuuggugucuuuauuaaaauauuaguuggcuguagauacaugggucaguuucugaguucccuauucuguuccacaguuacaugugucucuuuuuaugucaguaccaugcuguuuugguuacuacaguuuuguaguacauuuugaagucugguagugcaguuccuccagcuuuguuauuuuuguucaggauugcuguggcuucagagucuuuugugguuucauaaaaauuuuaagauuuuuuuucuuuuucuaugaagagugucauugguauuuugauagggauugcauuaauucuguagguugcuuuggauaguauggucauuuuaacaauguucuuucaguccaugagcauggaauaucuuucuguuuguauccucuaaacuuuucuuucaucaguguuuuguaguuuuucuuguagaggccuuuuaccuccuugguuaauuuauuucuagguauuuuauuuugcuuuuuguagcuauuguaaaugagauugcuuucuugauuucuuuuucagcuaguuugcuguucguguguagaaacgcuacugauuuuuguguguugauuuuguauccugcaacuguauggaauuuguguaucuguucuaagggcuuuuugguagacucuuucagguuuuuuuuuagguuuuucucuauauaagaucauguugucugcaaacagggacaauuugacuuccuccuuuuugcuuuggaugccuuuuaugucuuuccuuugucuaauugcucuggcuaagacuuucacuacuguguugaauaagaguggugagagugagcauuguugucuuuugccaguucuuagaggaaaagcuuucagcuuuuccccauucuacugaugucuaauuuuuuguuguuguugagucuuuagcguuuucuacauggaugaucauuucaacugugaacagagauaauuuuacuucuuucuuucugauuuggaugcauuuuauuucuguuucuugccuauuugcuauggcuagaacuuccaguacuauguugaauagaagugagaguagguauccaugccuuguuccugaucuuagaggaaaagcuuucaguuuuuuaauacugaauauuauagcuguggacuuuacauauauggccuuuauuauguugagguaaauuccuucuauuaguaguugagugucuucaucaugaaacaguguugaauuuugucaaaugcuuugucugcaacuguugagauaaucauguaauuuuuauauuuuguucuguuaauguguuguauuacauugaucaauuuuuguauguugaaucauccuugcaucccagggauaaaucucccuuagucaagguguaugagcuuuuuaaugugcuguugaauuugguuugguaauauuuuguugaggauuuuuacaucuguuuauuaaggauauuggucuguauuuuucuuauaauguuuuugucuagguuggucucaggguaauccuggccucauagaauagcuagcauauaguuggauuuuguuuauccauucagguacucugucucuuggggaguuuauuaauauuuaauguaauuauugcuagcaaaggacuuacuauugccauuuguuaauuguuuucugucucuguuguagcucuuuugucucucccucucugccgucuuccuuugugguucauuggguuuuuuuuuuuuuuuguagugauauacuuugauaucuuucccauuuuucucuguuuaucuuuuauagguauagggcaugguaaaacaaucuguuuuaagcugauaacaucuuacguucaaucacauauaagagcucauuuuuguucuguugaauuuuuuuuuuuuuuugagacagggucucacucuguugcccaggcuggaguguggugguguagugugaucauaguucacuacagccucaaacuccugagcuccaguaauccuccugccucagccucccaaauagcugggacuuguaaaauuggccaguugugguggugcaugcuguuugcucacaaguagcacaugccacccugucucuuuugcagagacagggucucacuguguugcccagacugaucucaaacuccuggacucaagcgauccucucaucucagccucccaaagcacugggauuacaggagugagccaccgcaccuacccucccgugccgccuaauagguagaauaauuucucuuauuuuccugaggauauuaguuaugguuuguugaaguuuuuuccuauuuccuuucuuuucuuuauguuuguuguguucucucuuucacauuagaggaguuccuaagaugccugauaauccaugcccaacuuuauaaguaggaacuaaaaagcagauuggaaucucugagcacacaaauggcacuuguugacuuugagcuucacuuuaaaguggucuggcugggucauuuguuagagaaauuccucaucccaagucaguauuuuuauaucuuuccuccuaggacuuaccaguuuucccagagaagacuuccaaaaucuuucuuacgaggguacuaccagcguucuaggagccaaauggcagaaaaggacugggaggaccucaacauuuaguauucucuuaguuuccuugcuuucagaaacaguguucacaucuucagccauguauggcauuccccaucuucugacaaugagccucaaguuuucuaccaggauuggcaaguuaucuuuuaccccauagcauauugugagggaggguauuuaaaaaucauauuggcuuuuagacagccuucaacugauuugccuuauuuuaaccccaucccuucacauuuauuucugaagguaagugaaauuaucaguuccugaacuauuuaaggauucuuaaguggugacagguguguucuuggcucucuccacuaccaguuuaaaauucagcuuucuucagugugcugaguugguuccugcucauccaauuauuuuucaucuuccagauuauuauugcuguugucuccuuuucuuguuccuccugaccuuguugauuuguguuuuuuuuuuuuuuuuuuuaagugccuauaguuuuagagaguuuucuggauggaaugaaauuaaaugaauguguucaauccaccauuuuuaugugaaacuaauucuaaucauaaugaaagaguuuucuuacggcugagcauggugucucacgccuguaaucccagcauuuugggaggccaaggcggguggaucaccugaguuugggaguucaagaccagccuggacaacauggugaaaccccacgucuacuaaaaauacaaaaauuagccaggugugguggcacaugacuguaaucccagcuacucgggaggcugaggcaugagaaucacuugagccugggaggccaagguugcagugagcagagauugcgccacugcacuccagccugggugacagagugagacuuugucucaaaaagaaaaaaacaaagagugccuuaccuccuuuauaugauauuuugguugauccucaauuuguuuuagguauuauaccugaagaaccuuagcccucgggugacugaaagagaucuugugucauuguucgcucgguuccaggagaaaaaaggaccuccaauucaauuccgaaugaugacuggacgaaugaggggccaggcuuuuaucaccuuucccaguaaguaguuucauccagaugauuacucaguugccccucaguucgcuagagauuaccuauaaccucucuaauuuagauauaguccuuugauuucuccacagcaugugagaacaagacaaugaacgaaaaauauguuuucaguguuucuuucuguuuccucuccuccauugacagugcauggccacacuaccccaguguccucaguuuuucccagucuugguacuuccuucuuacccuaccaaaaucuguacucccuucacugacaauaguauuucuaguccaaguuauaauuagauuacucauuaauuaauguauuaguauucugaucagaacacauguacuuggcuuaugcgcuguuccuuuaggacuaagugagagcaagcuaauauacuaauuuauuacuaauucauaauuaguagaugaugauacagucuucuaaauauuauuugcauauuaauuaaugcauagcuucuaauccaacuggaagaauaauaugcaaauuucaguuucuaugacagaccagauaauauguuguuuugggggaaggcuuuguaggaucuguaccuuucauugucccuaaaguaucgucauuucuaaauagccuauuaaucuauaugugggcaagugguuuuacacaugaauacugccaaacuccccuccauuguuuucauacagucuuguaucaucuuuccuaucauacugaagguuuuuaaauccgcuauaccagugguuuucagucuuuucaaguguaagaaccccuuuuaaauuuaaaaaaccguuuaugggugccccacauaauacgauguauuaguugaaaaaauacauaauaaaaaggcuuuuuaaagcaaguacuuuaaaauguguagcuguuuuacuaaucuugaaagcuauacacuuaaaaaaauuuguaguacuuauauauaugaaacaaaauugguuuagucuacuugucuacuuaggauuccacaaacuccuggccacaaaucaucccuuccuuauuucuuacauccaggcucuuagacccauaaguugaauacuccuggcauguaguauauauucucacauuucaaccuucaauaugccuacaaguguucuuauacuuauuuaucccaauaagguggcccagaaccacucucccacugaaaaaaaaguggcaaagugcccuugauaacaugauaacuucuuuuguguuacucauuuugaaaaugauugauucuaauaauaccuauaaucuguuaccuaagauagagacuuguguauaauuacuaauagcuuagacuucuuuagcacgcugccuaugucuuuguuucucuacuuguuucuuugaauuaggagacacccucaaacaccgauuuugaguuuuuauuguuauuauuuuugccauuaauuuaauuuugcuuaauaaugcaaaugggagauuauagaaaaaaugaucaaaucaaaugacuauauggccuuauagcuuacauuuaacuccaaggcaaaauaaucuaaacuaaaccuggaauagaauugaauuauuaaguccuauguaaauugaaauuuuuucuuucucuuuuagauaaggagauagcauggcaagcauugcaucuaguaaauggauacaaacuacaugggaaaauauuggugauagaguuuggaaagaacaaaaagcaacggucaaaucuccaagcgacuucucucauaucaugugcuacagguagcacuacagaaauuagugguagcuagaauauauauaaauuguggguccuggauggucuuucuugaauuggaaucuuggaucuaggauuuauguauagacaccaguuuguuuggaguugaagaggaaaaacuaacugagggaggggaaaaaaguaauuucagcuuuuggagagaacugguagaaaacauuuucuauuauauaauugaagacuauauaggacagaugauaugcugaguaugaaggguaaagugcaaagaguauuauuuucucaggaugaauuacaacggauuauuccuaaggauuuuuaaaaaucuuuauaauuuuucugggguccucaauauuugucucuagagauaacauucuuucuuagacugcuucguauacacagaaauaaaaaacuaauuaaauguugaaauauuucuuuacuagagcccauuugccauauuucauccaccuaguaaauaaaagaguaggacccccaggccuaagcaucaacaaaugcuauuaagucagaacuaucagcaguaauaguagguaguuucauaagucaguugacuuauuuaaugaaugcuuccuccacaaguuaucagucuucaaaaagcuauauauuuuucuagugaaauauuuuagaucaaaauguugguguucucacagccauuuaagcuagcaaccauugaguaucauugaauucauagcaauaaacauugauuaagugucuaauauauguuaaauauuaggcauaugaauuuuagaagaggaacauacaagcaaagaaugccaaacggaaauggaaauaaagcguucucuagaaaagaggaugccagucacaaaucccccaguuguuuguuuaugguugcuggaaaauaaaaaaacaauauacagagaggaaguaguacaaacuggagucagaccuguacagccacacuuaacauucuaugaccuuggcaagucacuuaaucugagccucacauuuuucaucuauaaagugaggauaauaaugcuacuuaccucacuggguugugaagaugaacugagauauuauccaggcugaagaacagaaaggaaaacaaugaauaaaauugaacaagaguauagaaccugugugacaccauuaagcauuccuacauauuucuaaugggaguacaggaaaaaaggaaaagaaaugaaggagcagaaaaauauucuaagaaauaauggcuauaaauacccccgauuugaugagagacauuaaccuauacaucccagaagaaaaagaaauuacagacagauacaucauaagaaaaaugcuaaaacccaaaaacgaaaagaaaaucuuaacagcaauacgagaaaaaugagccaucacuuaccaaggaacccaaauaaaauuaguaguugacuuccccucagaaacaauggcaguggcaguggaauaacacauucaaaguguucaaagaaaauaacugucaaccaauaauccuauauacaauaaaacuauuuuucaaaaaugaacgugaaauaaaacaucucacauaaucaaaaaccaagagaauuuguugcuggcagaccugacuugcuggaaauacaaaaggaaguucuucagccugaaagcaagugaccacagacaguaaucugaaucuacacacaugcagaaaaagagcacaggcaaaaauaauuauguaauuaucagaaacaaucuaugcauuuuucuuuuuucucuuaacuaauguaaaacacaguuguauaaaacaauauguauauaguugcaucguuuggccuauaacguauaaaauauaauauauuugccgauaacagguugaagaagcugaguggaagcaaaacugucuuguacuaaagaacugacuccagaugguaagacaaauccacaggaacaaauggagagaacgugaaauaggaaauaaguuuaauauaaaaaaacuauaaacauauacuuacucuucucucagcuucuuuuaaagauguaaaauuauauuaaguaauuauaauaauguguguuggguuuguaauguauaggaauaacauauauaacaauaauaccacaaagcgggggauggguuuauauaggaauaggguuguuacauuggaauuaaguuaguguuuaucugaagccuauucuguuuaguuaagauguguaugguaagcccuagagcaaccacugaggaaauaacuuuuaaaaaaucaaaaauauuauuaaauguaaauaucacauuaugaaauaaugcaaaagaaggaauggagaagcaaaaagcuugaggcauaucaaaaacaauaaaauggcagucauaagucuuccuauaucaaaauaacaaugugcauggauuaagcaauacuauaaaaggcagagaugucagaaacaagucugauuccacuucaugccaucuauuugagacacacuuuagaagauagaaagagauuaaagguaaaaggauggaaaacaaauauaucacacagacaacagccauaagaaagcuggaguggcuauucuaauaccagacaaaauagacuuaaaaaaauguuacuggagauaaagaguaaaauguuacaaugauaaaagggucaauacaucaggaagauguaacaacuauaaauauauaugcaucuaacaguagagcccaaaauacaugaagcaaaaacugaaaggaaaggagaaacagauaaguccauaaaaagaguuggaauauucaauaccccuuuuucaauaauagagcaccuagacagaagauaaaccaggaaauagaagacuugaacaacauuauaaggcaaauugaccuaaaagacaucuauagaacuuuccacccaacaucagaauacauauucuucucgagugcauaugaaacaucuccaaaauaggucauaaguuaaagcauaaaacaagccuuaauaaauauaaguagacugaaaucaugcaaagcaugcccucugaccacaugggaugaaguuagaaaacaaugaaaaguugggaaacucacaaauauguggaaaucagacacacuuguaagugacuggcugggugcaguagcucacgccugaaaucucagcacuuugguaggccgaagugggaggauuccuuggaucccuugagaccaggaauucaagaccagccugggcaacacagcaagacccugucauuaccaaaaaaaaaaaaaaaugugucaaagaaaaaaaucauaagggaaauuacaaaacccuuugagaugagugauaaugaagacacaacaaaccaaaacuuacaagaugcagcuaaagcaguguuuacagggaaaucuauagguacaaaugccuguacuuaagaagaaaaaagaccaggcacaguggcuuacgccuguaaucccagcacuuugggaggccggggcggguggagaucauggggucaggagaucgagaccauucuggguaacauggugaaacccugucucuacuaaaaauacaaaaaauuagccaggcguggucgugggcaccuguagucccagcuacucgggaggcugaggcaggagaauggcgugaaccugggaggcagagcuugcagugagccaagauugcaccacugcacuccagccugggcagcagagcgagacuccaucucaaaaaaaaaaaaaaaaagaaaagaaagaccauagcacuaaccucacuuuacaccuuaagacccuggaaaaagaagagcaaacuaaaccuagagccaggagaaagaaggaaauauaaaagauuagaugagaauaaaugaaauagagugaagaaaaguagagaaaaaucaaugcaaccaaaaguugauucuauaaaaagaucaguaaaacugacacaccuucugcuagacugaccaggaaaaaaggagaaucaaauuacuaaaaucagaaaugaaggagggaacauuucaacugaacuuguagaaauaaaaaagauuaugaaggcauauuaugaauaauuuuaugucaauaaauuaucaaugaaguggacaaauuccuaggaagacacaaacuaccaaaaccaacucagaaguagaaaacuugaauaaaccuauaucaaguaaauagguuaaaugaguuuuugaaaagauacccacaaagaagagcccaggcugaaauagcuucuuaaaugaauucuacaaaacuuuuaaugaaaaauuaauacaaauucuucacaaacuuuuucaaaaaguagaagaguggugaacacuucugacacauacuacaacauggaagaacucagaauaugcucagugcaagaagccagucacaaaagacuacauauuauaugauacuauuuauaugaaguguccagaauuggcaaauauauagagauagaaaguggauuagugguugcuuagggcuagcacagaguuggggggaaugggaagggcuggggguaacaguugaaguguaugaaguuucuuuagagguugaugaaaguguucuaaaauuggucgugguggugauuucacaacucugaauauacuaaaaaccaggaauuguacacguuaaaugggugaauugugugguguaugaauuauaucucaauaaaacucacaaaaguagggguguccaucaauaggaaaauggguaaauaacuuaugguacaucuauuuaguacaauacuaugcagccauuaaaauagugaaguguaucuaugaauauauuaugaccuauacucauguccaagguuguguauuaaguuaauaaacaagaugcagaaauauguauaguaugaauacauuuuuaugcaaaagcauucauuuauguauaguauguauguauauagauauuucugaauaaauuuaagaaaaagcugggaaauagacauagaaaguuauaaaccuuuggaagugggauugaauaggcugaaggaggacuuucacuuuguaaaauuuuuaaaguggugugauuuuggggugauuuuuacuuuuuucauuuuuuuuuuuaacuaaaaaauuuuuuaaaaaauauucugccaauggcauggcuuccagaauauuugucaggccuacucuggggauaucaucugacuauacucaggacaaacuccuauuccuuugauauacugcucacuuaggauuaacacucuaauuucagacauaguuaagugacaaggaauaaauuauccugauauagccucugauacauguuaccaggggcauacuucuaagcuggacuuuuuagaaggaagugcuuccuguuagguagaaaauuucaccucugcuuuuuacuagaccuacagaccacugcaauugaggaacauaaaaaugaaggauauccuucaacuggugcauagauaaaccguaguauauccaugcaauggaauccuacucagcaauaaacuaaugaaauacacaugcaaccacuuggaugaaucuuaaaugcauuuuacuaaguaaaagaagccaaacucaaaaggcugcuuacuguuugauuccauucauauuauuuucucaaaaagcaaaacaauagggauggagaaaaaacuucaguggaugucagggguuaagguuggaaugcuccuugacuacaaagugguagcaugaggaauuugucuuaauaauugaaauuuuccgugucuuuauuguaguuacauaaguauaugcauuugucaaaacccauaggcuuguacacuaaaaaggaugaauuuuacuguguguaauuuuuuuaaauaaauguuauuuuuauggaggaaagaa

SEQ ID NO: 192861 - RNA, 154611 nt, Homo sapiens
uuauuuuuucuaacuaaauuuuuauuaaauuauuuuuucuuugaaggcuggaaccaucgaaguccuuagaucagcuuuaagcacuggauggaguaaaaaccacaagggacuacaaggugaucugugaacagacuggcagacagaugacgagagagggagugacgacaacaaaaauagacaaacaaaaauaauggucuucuggcgaccuaguuaaauuacucgcuuauuaaaauuuauuagaaauaaacaaacauuaaugaaauaaaaaucuaaaacugagccccagacucaagacuacuagaaaggcucaccaaguaaaacccucgguugggucaagugagcucucugaauguuuuguacaaccugcugcaguuuguuccccuugagcaaggugaugcuuuguccugggcugcaaucucuaacaccaucaccauccccaagugcagcucccauucuaaaaaaaaaaaacagaugcccccacccccaauuccuggugaacugcucaucucuccugacugcagaaacugacucugaaggaggaaguugcaccagugguggaggcaggugggcaagcggguagggcagggaugguuuccuggagaauccaucuuuucuccagaugccuagcaugugcuuaagaguuuuuuguuuuuuuuuuuaaguuugaaaaaaacuccauugugaaaagugaguuaugaagagugcucuuuauuugaaaccuccacaacacagacgccaaucuugucucgcauugaaucauuagcugugcacaucaacacauuccaagcacaaauuaagaaaugcaaacagaacaaaaaaauauauauauauauaauuuuuuccccuauccaaagguuucaagucucaaugcagcaaauccuucugaacacagaaucugaggagcacacuguucaaacaguugggacagacaggucccugcaaaggcuacugccuuuuuaaaacacaugggguggggaucauggacggcauggaaaggggagagaaggugaggaaacaggcggcggggagagaaugagaagaggaacagguaugcgcuggggaagauggggcagcugggacacacacggugaguugguggauuucauuuauugguuuuugacaauuucuuucugguucuuuuuuuaacuccccccuccccagguccaacaaugguaaaaaaaaccccacggaguugggcagggccuuauuaggccagcccaaagccuucagagcacuccuggauagccaacaguagcauguggcggagcuucucaaagcucucauaggcaggcagauccagcugauuaaaacuaaggaaagaagaaagaucaguuuguggugagggaugacagauaaccaaaucuguguguucccauggugcccaccagccccuccccucccugaagaaaccaacucccugcuucuugaugacucccaaucuugucucagcccaguaugucccccuuuaucuggcucccaaacuggccaucaggcaccaaaaccaaaaaucugacccugucacuccuccuuaaacacccuggccucacucgcccauaggcuaaagugcaaacuugaaggugguuuucagagucacugguaaucggaccucugcugagcucuuuagacuuuugcucccugcaacuccuccuugcuccagucacgcuggcccuggaauacaccaugcucucuuguggugcuguuuaccugacagugucuccccagcccccacugugucuagcacaucucaucucaaacaucaccuccauagaaacaccaaauugugaguuacccaagguccaggacucagccacauuuguguucccaaucuuggguaggguccugaaaacaucaaguaugcaagcucaaccuaagcacugaaaaggagaaacaaacccuuccuuuuaccaugugugagcugaaggcaggcgaucuguggaccugucaucucgauggaucugaaacuucugaaugccauucaugccuucgagggcagcaaagccuugcagggguaccuuggaaguacccgugacaaacuggaggaacuuggcacggucagcuugaucgaaagaacgcaaugcucuccagaaccacuggaucuguaggaagggacccaugaagccaguguuagguagaaagcuccuagaagcagggugggggggauggaaucuaggaaacaggacuggacuugguaucugaggcaagucccuucugugggaugagcuuuagcuccuuucauucauaagacggccaagagaagucugcuaugcuucaggagaacaaagaguuagauauagguagacugucuucuacaugcaacuuccucuaagaguacuacugguuuauuugguaucacacaaacuagcguugccuaggguaagaggaccauaugaggagggaugccagcagcagcucaccugaauagaguuggacugguacuugugguauucaguguuggauuucagaucaucgaugucaauggugggcaguccugauauaagcagcucuaacuccugcucagugaagauggaaaugaggcgcuuuggaaugaucucauagaagccuucuaagaaagccgccaacugcuugcggauggcuccuggugagauaaccaaaaagccaaaugacuucuaaacucacacaaccguagaggucagagaucccccaucuggcucccaucuaccacuguuagcugggacuacaggcaugcaccaccacaacugguuaauucugcccaggcuagucucaacccccugggcucaagcuauccuccugccucagccucccaaagugcuaggauuacaaaugugagccacuguguccagugaaguuaagcuggguuuguuuuuuuuuuuugagauggagucucacucuguugcccaggcuggagaagaguggugcgaucucagcucacugcaaacuccaccucccggguucaagcaauucuucugucucagucucccgaguagcugggacuacaggcgcacgcugccacacuuggcuaauuuuuuauuuuaguagagacgggguuucaccauguuggccaggcuggucucaaacuccucaccucaacugauccgcccaccuuggccucccaaagugcugggauuauaggugugagccaccgugcccaaaguuaaguauuuuugaucaaguguuuugucuuuugugcaaggcauuuguggcucugucauagcagaggaaaacaaaacaugccuaucaaaugaaucaaguccgaccucuucucauauugagcaacuagaggucuaggaacauuuccccuaccugucauucucaucuggcauaccagguguacauacuccuucuuauucuccucuguuaccaagauguuggccccauuggguuugaggucacgaacuucacaaacuccaaacucuuggaccuagaacaaccaaaacaccaaucauacauaucagacuucaucuaggaugggauuagauaccuaggaacacacccuaaaccccuugccauguccuaggcagagagaugaggcaaguccauacaaaacagugacuuuuucuacuacucauagcucgcaacuccccuuauagggaaaggcuuuggguaggaaagaggaaaauacucuuuggcucuaagaccuacaaaaaaggcagaagagaguaaggcaacuaucagugguaaaagggaaaagggaauggcuaacauauguaacggaauguaaucucuuaggaaaagaauuuaggagaagaguaaccuuaacugccuucauuuuccccccacuuacauuuguacgauuuuucuacaaagaccuacccuugggaaugaggaauuauguacuggaguuuuuuuuuuuuuuuuuuuuuaauaaaggugaaacuaggaaauggccugcaaauucugguuuuccuguuugugaugucacucacaaacaccugcuacagcuuuaagaagucaagaugcuuccuuagaacuaugagaaggucacgcagugcuaguucuaaggugaaccuggaauggaucuuccagauuggcugggaugugcugugauuaggauuuccugaccuaccucagugcugaaggugaggucauagccuaguguggagacaucauuuuccagcagauaaaccagaccuugguagaagugguaaucuucacucuccauaucuguauaucuagaaaaacacaauuauacagggucaugguuugcgagugggggggaagaaggagcacaaggaugggacacaaaaagaccagacccccaggacugaagacagucccaggacuaugccucauccucaccugacugacuugcccaagauguguuuguaaaaggaucgaguaaaguagcacuccagaagacgguugucauauacagcuuuggccacaaugcguccgacaaacuugaaguagcugaggugguugggguugcagugggaagauggauugaugguguaggugacucgaucaccaggugagguacggaacaaggcauacauaggguuaaacaucucucgagagaugaucauauaccacucccgcaggagcccaccagcauccugcccuucuucuccuucaaauacuauauaccugcauaagaaagcagaagcagaaaagagcugugcagaaaacccaggauacauccagucauuugugugagugagagacugugaagcagugucuggggagugcagugucagaugaagagguaaacagagagugccaggacagcccagaaaugggguggagaucugggagcaaacaaaagcaccacugacagaggagaugucccaaaauagucaagguuaacagauauuccagaaaacaccaauaggaaagguaucagagaaauaaaugaggccuugcuuaggugaaguggggaggggagaaaagugguauuagagagggauaagcccagaguccaaauucucuaaagguauuuggugguggaagaacauggcauacagucugucuagggagacucccugacuucuugugauuacacaguuggagagcccacaccacaagagauggggaggaaucauuaaacaacuccaauaggucuuucaucucaucagcuccuacgcucaguauuacaaacugcugaucuccucuagguggcuucagaaucaccagugagcaguuaccaguuugguggaggccacucauacauggucauuccuaguauagcaauauuaaagcucucauugcaaagccagcagguauauccuuauaaacaccaaagacuuuccugucugucugggaauuguuggguagcuuagcuaaagggccagccagcagggcaggcccagaagauaggagacaacucaguaagauuaucuaaaaccagauuccuauggggaauuccuauuagggagggcagcaccucccuaaauuugaggcuagagcaagccaucgcuacugugcaggaggccccaccucccacccgccaucuuuucuccguuccugggcccuuacaaucgauucuucauuucuucgggggauuugcgaugcagcucacgauaggagucuucaaacacauggucacgacggacaugcacagccaugucuucuuuccggagccccucaucuaaacgcuccagcucuuggcggaaauaucuugggagguagaaaaggaaggaagauaggauuaaggguggcagaacaaauuuguuugugugauuaggaagaagacccacaaugaugcuccuucuauccuccaaacacuuugaucucugcuccacaccuguuugggaaaugcccaguaguugggagagguagaucacucauuaccaacucuaaauuuuucuuaccuccacugaguaagggcccacaaagauugugacaugugauuucugccacaagcagguaagcauguauacaugcacgaggagaaggagaggcauagggaugacuccaggaguguuguggaagccccuggaacccugcuguguguguucuauggccaccugugccuccuguacuacccccaacggauggaacagaacuuuagaaacugugugguucaaaaaucaugugacucuguuuugcugaugaaaaaugcagaugggguggagaagcccaggaguauuuagguaugauggccaucaaugcuacagcugucucuucccuccucaccaccaccauuccaagugcugucaccaaaggaaauuuguggccucaagaguaacuucagaggcgaguuaccauuuggggaguucucaccaccccucuaccccccaauauccaggacacauacuugcgcuugacaucaaagucgaggacacgaauguagucuaccaggacagcaaaaggcccaucagcaaggugggucguggacugccguaggaucugguuuaacacagugcggugagucucugaggggagaagugacagcaggaauuaagcacaucaucugccccagaagcuguaagacagccaaccagcuagcaacucucucuuccuuccucuuccuuauuucagggcucuaaaaggacuagucaaaaccaagggccagcccuugaggugugaacgugaaucugagcauuucuauucuaaaccugaguauccugaggccaagggaaaccaugcaggguuuacgugcacggguguguguauguacacacacacacacacacacacacacacucucucucucucucucucucucucucucaucaacuaaggauuaacuguaugaaacaauccuguuuaaaaugaagccuucuacaccuggcagccuaaaaguucccuguaccugcaaagcgaaggaacuucugugugucagggggcaggcuugaggagaugugcauagaugagggcucccgggagaagaaugggucaagggaggaaggcguggcugggguuaagggggcaggggagaguggaggaggcucguccuugaugugugccagcuggcucucacgggugucucggacaggaggcuugcucucccgcucuguggcauggaccagaaagaaggccucgacagcaggcuguagcacuaggguuaggaaugauggagaaguaacauuuuacucugcaaacuucaacaugcaaaccucuuugccaucauaaacaaauuauaaaaauaaauaaggaagaagaaauagugaaaacuaggcuaggugugguggcucacaccuaugaucccagcacuuugggaggccgaggugggaaaauugcuugagcccagcaguuugagaucagucugggcaacauagugagaccucauuucugauuuaaaaaaaaaaaaaaaaaaaaaaaagaaacaaugagaacuugcagggaaauaugguagaaucaagucacagaggaacuuccuugaagccaaagaaaaaugggauagcuaaccaguuauaaagauuccccuugucuauaaagugaaagacaccaacuauuaaaagagaaggucaaucuuuuuuauacugaagucagagaaaaaacacuucucuuuugaauucucauuacagagacacugagggagaggaguaaccuggaaggaagaaaaacaagcuggcaggaagggccccagagcagaccacuggguugggaccugggccuuuaggacacaacucaccuagcaccgcaugcuggucaugggauuccucuaguuccuuuagacacuccccaagcaugucccacagcucguccaaacucagcugcucgcugagcagggguaacucagguggucuuucuuccuuuuccuucucccccugugggguuccaucggaggcuggagggcacacagaagagagucagaaagucuucaaaauuucccuucugcuuagaucuuucuagaccacacgcaccaacuaauauacagaacaaguagaggggaccacuggccacugagugguacucaccgagcaacaucugaaacaaggucuaggaccugcauuggauggcauuuacauuaaacagaauaaauaaaauaaugaaucugguuccucaguugcgcuagccacauuuaaggugcucaaaagccacaggugcuacugcagauccagauagugcuagucuagucacugccucacuaguuucaagagaaucuguggauuauuucaggguaauguaacaacaguggagcuuuggaugguugccuuccaguuuacacaggauguuuuaggacacuuuugucauugaauucugacagcuggccuuggaaaguaggcugucuuuuccucauuuugguuucugaggaagacagcaccaggacaucaaacuaaaucuuucuaaccuuaagucuaaugccuuuuuuuuuuuuucccugagacagucucguucugucgcccaggcugcagugcaguggugcgaccuuggcucacugcaaccuccgccuccuggguucaagcgauucuccagccucagccuccugaguagcuggaauuacaggcacaagccaccaugcccggcugauuuuuguauuuuuaguagagacuugguuucaccauguuggucaggcuggucuugaacuccugaccucgugauccaccugccuuggccucccaaagugcugggauuagaggcgugagccaccacgcccggccuucuaaugccuucuaaauuagucaucuuguccuggggcaguuuaaaacccugagaagccaugguaugacagauggaaucccauggcugguacuuuuccugauacucacugggggcuuauucuaaccucugcucaguagcuaagcagcaagacacaaccccaucuucuggguggggaguaagugacuguuuucucaucaaccccugauccccauacaccuggcccugcuuagguuucuuccugaccuuugcuguucauccuuuacccaaauccugacuauucuucaagguucugacagccuuagguuugaauccuggcuccgguacuugcaaaucauaugaccuuagguaaaagaaggugaauacagaacacgaaaauaauaucuaucuccccaaauccugaugaaagguaggauaacaaugguuguccuacaagaauacuauuccaugggaauguguuaugagggugccaaaauguauucuauguaugacugacuuugagaaaugcugcuaacaauagcauucaucgugugcuucucuaaccacuauacauguuuuaacucauuuaauccuaacaacugaacauuccuauuuuaaacaaggaaaccuaacaaagagguuugccucaggucccagaagcaguaaaugggggagccaagauuuaaaacacgggagacuaaggcuggucggccguggcucaugccuguaaucccagcacuuugggaggccgaggcagguggaucacuugaggucaggaguuugaaaucagccuggccaauguggcgaaacccugucucuacuaaaaauacaaaaaaaaaaauuagccaggcaugguggcaggcgccuguaaucccagcuacuugggaggcugaggcaggagaaucacuugaauccaggaggcggagguugcagugagccgagauugcaccacugcacuccacccugggagacagagcuagacucugugucaaaaaacaaaaaagaaagaaagaagacaugggagacugaagugagaggauggcuugaggccaggaguucaagaccagccugggcaacauagugagacuccauuucuacaaagauaaaaaaaauuagcugggcaugguggccugucccuuacaguuccagcuacucagauagccaaggcaggaggaucgauugagcucagaaguuugagguugcagugagcuaugacuauguuacuguaucuuagcuuaggugauggagaaagacccugccucaauaauaaaacaaaagauuuaaaacacaugcugggcugggcgcaguggcucaugccuguaauucuaacacucugggaggccaagacagguggaucaccugaggucaggaguuugagaccagccuggccaacauggcgaaacucgucucuacuaaaaaaaauacaaaaacuagccaggugugguggugggcgccuguaaucccagcuacuugggaggcugagacaggagaauugcuugaacccaggaggcagagguugcagugagcagacaucgugccacugcauuccagccuggcgacagagggagacugucucaaaaacaaccaccacaacaagagaaaaccccauaaaaacaugcugucugaaugcaugauaucccaccauuuucuuuccuuuacuacaggaaagaaaagugugccuugguugucaaacaccugucaucauuuacagaaaccaggguuuacuggaacaaaugggaaaacacugggcuuauauaugcugggagcaggggauucagcagacauuccagaagacuggcuaucccuuuugcucggcuggaaacaggaaguaguacugaccaauggauugaguaucuugagcacugggagauggcugguccacauccaugggugauuccucccuccggacagacgccucugacuggcuagacuccgacuggauaaaagggagacaaaaaucacauaagggugcaacucugcuuuccuuagagacaggcuagagguuggcccuuccacuucucauacauugagcuugcaaagaagcuucccauauuuggguggggaaaacuguagcuauccaggacaaaaggaugccuuucccaacucuucugcuuuucuccacuguguuuuguaagcuuuucccaacagcuccuuggaugcuuacauuuccuacagucuacaauccagaccugugaccagucagaacuagccuccuguauauagacuucaagucuucuucuguuguguguguguguguguguguguguguguguguguguguguguguguauaaaaaauucagauggguggaagguaggucugcucuuuguuucuguuugcucacaaaaggggaaauaauaggagaauuagagcaaccucucaugagcgggauuauuuaaaaagccgacaucuuuucguguaaugggaaagagacucggcagaaaaaauacuccagaauaacagcuuuauuuucccuuucuaccuuccuggagucacugccccuaaguucaaggcuuuucccugccuacucaauaaaaccauacuguauaauaguaauuauacgcaaagaaauaucgggucuuaggauaccuuucuuggaucuuggaaagguaacuuacauguugcaaggacaggaaaacaaugagggagugccacagcauacacaugugaugccaggcuuuuacugcagccacucaaugccgggaccccaacacugagcuggcuacuuaaguaccugaagguuuccuccuaaaagugccugagugccuaggugccaagggauuauggagaauaaaggcagagggcaggguggagggagcagccacagacagaaguggcugugugggauauguaccaagcuugggggacuuucaaugguaggauuccugagauguuucugauguaccugcauuguuccaugggacugaaaaaaaacuucaccccauaaccccucagaacccagacaacacuuagcaucaggcaguuugcaaaagcgccacuguugacuggauagcugggagugggguaugauggccaagcuuuaaaucaaaucaaaccaacaaaccaaucaacaaauaggaaaacaccaacagaaaguaacccuuuuguccagaagcauucauauagcaaacuuaaugcaaaagcauacaagguaaaggcaaugaaaccccacugaugacaugguggggggaugaguggagagacaaaugaaugaggggccacaggcaucaugcuaaccguugcugcuuguugcugucuccgcgcccuuugacccucacguaccauuuguauaauggcaucagccucagccuccagcugccgaacagcugccuggaugcugcuagcugagccuaaaccggaggaaccugggagaaagagaaagaggaaggcaagauauaaaauauaggaagagggaaagcccaauauucucucuccuaucuccugggcugccacagggcaucuugcugaggucuuuugagcuuuagcucaggaagcuucagagugcucaucaucaggcgcuaagauuuaccauuacagauaagggcagggggcaugaugcuagacagacggaugguuuugugcgagaggguucugugggacaggaggaaagagguagggaaaaugauuugucaagccacggcuuaguuagaaaugaccaaggaagcagaaaggagaugcaccuagugaguuaagucuuguucagcaaaaggcuggcccccaacuucccugccagauuuccacucccccuuaauucccacucccccuaaugaauuuccuacgcagauagcuugaaugagauguagaaugcagccaucaacauucugaaaaaaggauaaucauuuuccuuuuggaaaggucaaacaggaaggagacaggccguuaaguccugcaccuccaaggaaucuggcuuuaccgccaccaacccuuccccucaacuggacacucuaguuccauaccuagccugccugucugcuuggcuuucuuguuagcccggcgcgugucgucccggagcuggaugaugaccuguaguacccucaagaagaacuucuggguagaugucuuggaugucaacauggacauagaaggcagcuggagcucccggccacccaaaggucgcuucugagaugccacaauuaccacauucucagccaugucaaaccuggauaguguagagguggcuugcguauauugacagcaucaaaguauaaacacccaaagcaagcaaggcuuccuggugucaaccagagggguaaggaaacucagaaggaaaucuuccaaguaggaaguagaaaaaaaugggucaaguguguauaggaaagauacgaaaaucacccagagaaauaaaaaagaccaggaaaccagcaagagccaucuuccagaauaucccagauucaagcccccagccaaaggguggcuaccacccaccugcucugcauuuugcccuucagcuugguggucuguggcugcuccucaggcaggccaucaggagagaggguuucacauugggcucgccgcugcugcucgagguuguauucccgcagcucggccagcaggguaccugagcaggcagaggagucagcaaguguucagagacuccccugguaaaguggcuaaaagccaaaucucucuaagacaccugcuuaggccacucuucauugcucagcugcagagaaccuagagugagcuggaaucgugcucuguucagcuuauuaugcguguccacgaaccgucaccugggacuaccaauuuaccuauggccacagggaucugcugaaucugcaugaaaugaguuucauguagaagagaaacaguaucuccucuggagcuaaacagaccaugguugaaaucccauauaucucucaaaauuacugagguucuguggugguuucaggcaaauuucuugaccccuuacccaauuugcuaaccaauauuaauacugggaugggaauauuacugccuaaccucauaacguugcugugacaauuaagagauaauuauaugguagagugccuagacagugccuggcccauagguguggaauagaugguggcagccaagagagaaaggucagaggccaaauucuuucuggaagaacguuguaauuuucaugcagcaaagaacacccugaguuauacaggccaaccaacucuccuaucaccccagacuuagggacaugggggugaaggagagagagaacuaaguauguagccaagaucuagggagacucaugauugggaugagggugggacaggguagacagacucuauguugaaagaaaaccuggcuguacuccuugguccaaucacuuuaucacccuggguuuuggcuuucuucucaguaaaacagggaggaagaugauagaaacgagguaauuuguaacuguucuuagaauuuuuauacccucaaaauuacacaaaagcagagaguacuauucugacucuguaauuccugaggcugaaugcaguguagggacauacuuugaaggggugaagcugccucagcugucuuauggggcucuuacgagugcccagcauggagaagaaaggaggcgcugcuguucccauguguucucuuuucucuucauuaagcaccacugugugccgggcagcggggaugaggagacaaacccagccuugcuuucaaacaacugagcagaggaaaacagaugauaacccaggguaaucuguguuacgacagagggagcauggaggcuguguuauagggauauggagguaucugauucagcuuggggauucaggaaaggauuccagaaagaggaagcaccuaaguggaaaccuucagaaagagaaaaugcuuuacuucugcuauuaccuauuuguuuacaaaggguauaacccagauggcgggcuccauucaguagcagcuugagaacagugucccgggucccagaguccccccgggagagcugcaguaguacguuggcugcauccucuaagccuuccucagaacaagagugggaugucaacaccugagaaaaagaagacagaaggaguaagccccagccugagaacaaaaucauuaucuacccuguuuauccuuucuccccaagucuuagcagaucagaagagcuuggacucaccucuacagagagcuguagcugguuuucagugaggccagaggacaccaucuuaaagucuguacugcugcugcccccaucacucaccuucgcuggagauuugcugcccuuaguagugggagaaacuuugaggaaacagacagaacacuguaagccucucugaaacucacaagccagggacuaagugacaaaaucaaggaaucgcugaauugcccagggcuucaaaaugggaaaguacugaaaaagaaaacccacccaccaaaggcaaaucuaaaugacuugggaugauaaaggcuuuuuauuuuuuauuacagacacggucucgcucuguugcccaagcuagaaugcaguggcacaaucacgucucaccauaaacucaaagaggacucuuaugacuguaacuucuaagcugaaaaagaaaccccaggcauuucuuccaacuauucccccaccaucauggcccacucuauucuuuaaaaccuacuucuucagauaauucuuucuuacuaaucuguggcagggcucauuaccuuuauuuccugggaugaucugguuacucugaaucacacuguauccugcccgcccuugaacuauuucccaugagaacuggcucccucaacacaacuggaaaggcugggaauucccugaggauggaacuuaacuuucuuuccuccuucuggugccuagccuagggaagcuacauucagugaaugccugcugaccuucaaaagagugugugugugagaggcaggggagagagagaaagagagagacacagagagacggggauggaggaagggagacagagugagagaacugggacagaugagggugagaaugaacacauucuguucucacaaacacaaaccaagcugauugcuaucacugagggagaacuaucuggauggaaaagggggugaagugggugccacaguauauaccccacagcucccagucuacauccacacuuacuugaaacaguagugguagcagucguggggguagucacuguggucgaagcagcuacgacaaugguggaaauagccguggcagcaaccagggcuggagcagaagugacaggggugggugcaguagggggugugggcgugguggaggcggcaguggugguggugguagaugugguugagguggcaguggugguggaggaagcaccgcugccagaauuagccugugcuucugacaccuuguuuucugggagagcaauugagaugagagaaaggagucugaggaguuucucaguuaagagagagcuccggcggaugacugggugugacaacauguucaugagcugccccaguggagaggccucgaggcuguauggagagguuucccccucaccgccagcgcucacuggcacugacuucacggaguucuugccuuuccggcugacauucauguuguccaguuuuaccaauaagucccagaagucugugcaaaugccacugcuggaggacugugaggagcaugggcuacaggccuuauugccccuuucccgaucacucucacaguuuguuucuuugguccgcugcugugugaaguggcugggaaauaccugccgggaaaaggaggacaaggcuuggucuaggacgucuucacagaggaugagccuuccugauagggaaaagacaacugguucccagacuccuucagacaauuuugguaaauauugggggauaugucauauaagaguuuuauccaacagacaguaaagcagccuagagaaaugaaugagggcuuuguagcaauacagacucacgagcaaacuuuuccugagcuuuagucucgcacuuauaaaauggagauaacuacacuuccuugcaaaguuguuggagauuaaacgacaugauguauuuugcacagugccuggcacaaggcaggccuuugauagauggcagcaaugcuuauuauugaaagaacacuaaauucuagguccagcuccaucacuuucuaaucauaagacaaaaugaauaaaauguucugaaucucagguucuucaucuguaaaacaggaaucauacagcccaguuguuuugaugacuaaauaagacauacauaaaaauggaaaagaaugaagaaaaaaccccagaaauauauaggacaauccccuagaaacaauacagggcucaacacuuaaaauaagagcaaaaagacacgcuagccugcuuaguguucaacuuucacccaggcucuugcugccacccuucuuccauccccaggaguuggguuugaaacccucaccuuggccaauugaaugaguguauccaaaacgugucugcagacaacaggagcagcuuggggauggauguggacgguggagccaccgcuugcaugcuucucgguauguuuacgccccccugaacgcuggaucugaaauauauuaguccugcagccuagggcugcauccauggauacugagagccaggaaagcugguuggagcucuuugacuccaucuuguguagcagguccaggggacgguucucauggcuacuugacccacagcucuugcucgacuuuuugcccuuuuccucacuuguagugaguuuggguguuucaaugcauagcucacucucacugcugcgcugcaagauggagagcagacugcggaugacccaguggcgggucugggcaugguagcagagauuucucaguacucgguguagacggcuaguauugagcuuuggcucauccacaaaaaguaggaccaagagacaagaaagggcuucgugguccagaaggagccguccucggaggcggaggagaguaucuacauuacugccagaaggccuggaaacagaacaugguuuuuggguaacacuucaguggcuagagcucugggauuaggcauaagaaugggggaggggaaugagcuagguaucuccaaggaggcuugagaaagguggguguccaguccaagggcucuucauaguaacagcugcccucuuaggugucuacuauguaccaggcacuuuacaaugacuguacaucauccuuucagggcugcuguacagcuuagagaaugaagccccccacccccaccagcuuuuuguugagauggagucucgcucugucacccaggcuggagugcaguggcgugauaccggcucacugcaaccuccacccccuaggauucaagugauucucgugccucagccucccgaguagcugggauuacuagugcgcgccaccacacccgacuacuuuuuguauuuuuaguagagauuggguuugccauguugccuaggcuggucuugaacuccuggacucaagugauccaccugccucagccucccaaagugcugggauuauaggugugagccacgacaacuggccgagaaccacccauuuuugagaugauaaacaagaggcucaaacagguuaagugacuugcccuacaucacacggcgacugagaagacagcagagauuccagcccagguaucauccaucgacugguaaaaucugaccauaccuaagucuaggagacaaugcuaguuucugccuucucuagacuaccaggaguuuguggccuuguaggaaccaaucacuccuuucacauuuuggcaugucaggcccacucuguuuuagccuggcuaacucacuccucuauacuuccuuagccuagguguuacaaacucaaggcaggugguuaguuguuuuacuacuugcaugggagacaagugguguuccuucuuguuaaaaccauaguuagcaccugcugccggccugcuuuugcgauuguggucuuugguagcaagacuaaccaaaagguguaguuuucugaauggggaguccaaagaucuggcucucucacuuauucaaggaaauggcuuagagagaccauccauccugccugucaggauuucagcuucuccaccuauaaaacuaagggagcugggcuaauagacuugaguggugauaugguaagguaaaaauagacaaagguaccuguuauggcugcugcuaccccccaucuggaaggugccaccucucugcacagcaaggcgaguauacuggaccccacgguugccacuuaagcgacuggugaaagcuggaaggaaagaaaaagaaaacugagauuguggagaggguguaaacuggauauagguaauacaaagguaagaaaacauagccucaucuggcuaaagcuuuccagagcccucccacuugccucccucuguacccgggcuucggagaauagcagagagugcggaggugcuacugugcccaaacagacgcucaugcaugagcugucgcugccgggcuucuugcucucgucucagggcuugagccucagcugcaaugucagguggcaucacagcuaacacacuguccuccauauccucuaggacacuacggcgcaggucugagggcagagucuggaugaaggucacaggguccauaggggugucugagcuggcauucugugcuaguucucgucgcugcugcucagcucucugcugugccaguaccuauggagcagaaaaagucaaugagggcauuucuccugccaggcagccuggccccaccaccuucccgcucacauacuuccuccugaauggcuggaggcagggcagccagaaacucagggcucacuucagucacaccaggauuccccaccacugcaggcgcugagcuauuuguggagggggcaguccggguugguggacgaaugccuagcugguucuguagaacuucccgacggaugucaucaggcagggcagccagaaaagagggguccacaccuucagggagacugauaccugaagggagauauaacauguaaagggauucacgccuuauuaauugcuugagacggggucuuggucuguugcccaggcuggaguguaguggugcaacccuugccucacugcaguguugagcuccugggcucgagucuuccugccucagcaucuugaguagcugggauuacaggcaugcaccaaaaugccuggcuaauuuacauauauauuuuuguagagauggggucucccuauguugcccaggcuggucuuaaacucuuggcuucaggugauccucugaccucugcuucccaaauuuucaggauuacaggcacgagccaccgcgcccagccucucacaccucuauuggugccuaauauguacuuggagaaaauaaacccaugucacuccuugagggaaaccaguguauaugucuucacugcuugcaagacaugggacacagagaaggcccaccccaccuucccugggcucagaacagcuuuuguuauuugcuagacugcaugcacuguuacuuacccuucauaaauaaccuaccacgcagauaucaucacccccucgguaucauucaugaucacagaaauuaaauaaugacccuagguuguaaaagguagaaguggcagagugggggaauuugagugagccaagaucaguuugacuccuaaggcuggacccguuucauuaugccauaccagcacccccgcuuauugucaguccucccacauacaugcccuccaucuaaauggaacuguuuggcuggugggcauuuccaugccaagggcuacuagaagccaaaacaaucccaggaugaccugggcauacacggaacucacccgcaaggggaucuucuucuucacugcuuguugaaggcaacggcucuucuaggauuccucgggaaucugcuccagaaauggccacggcagaaucucugguggaagagcucucagaggaugcagguggggagcugagggaaaucaugcucagguugcugucuguauuaugucuucucguuuauaaaacacugcuacaauaccccuuucucacagaaaccagcuuuaucuccccagcauaacaagcauguccauuaguugacgaguaugaaaugugcuuugaaagacccuccaauauauccuacccuucuuuugcccacacaugcuuaccuguccucagguggcugggcagauuccccugacccaucacuccugccuugcacuuccgccacagcugguggggcauccccaggaguggagcugccugcucugggcugcucagaacugccagcugcugaagugucacccacagccuccucuaagguacaggaagccaggcugcuuguauccauaggagagccuucuagcugacugcugacagccgucagugcaucagaauccucagcucucucuggggaaagugaggcuaggaagaaguugcagggagagguuagguuucuaucuggaaccggggcaaaaugacagauaaggucuuugauagggcugcuuccuuaggggcaucucagcucagacuucucacuucucccuugcugucccccucucaaucucacuuugagauuucuaagguucagcugaagcccuuucuaucaauucuugaacauuuacuguguuccaggcaugccugugaaacaucuucccuaggcaaaccagguaagggauuuuuuuuuggcagggggauggagucucacucuguugcccaggcuggaguacaguggcacaaucucggcucacugcaaucuccgccuccuggguucaagcaauucucugccucagccuccugaggagcugggauuacaggcaccugcuaccacgcccggccaguuuuuuguauuuuuaguagagaugggguuucaccaucuuggccaggcugaucuugaauuccugaccucaugauccaccugccucggccucccaaagugcuuggauuacaggugugagccaccgcgcccagcccggguaagggauuuuuucacuuugauucacugcaggcaccacuugcacgugcauaucccuguaguucucuaaauaaacaagguuucgguagggcgcaguggcucaugccuguaauccaagcacuuugggaggccgaggcggguggaucaccugaggucaggaguuccagauaagccuggccaacauggcaaaaccucaucuuuacuaaaaauacaaaaaucagcugggcaugguggcgugcaccuguagucccaguuacuugggaggcugaggcaggacaaucacuccaaccuggguggcggagguugcagugagccaagaccacaccacugcacugcagccugggugacagagcgagacuuuuucucaaaaaauaaauaaauaaaauaaaauaaaauaaaauaaacaagguuccuugaaagaaaaaacugacaccuuagggucucuccagagaacuucacaagcaagaugguauagagcagggauggcaagcagguaucaauuuauccuguugaaauacugcugagaagacuuuucaggccccauuucaaaccagugagaaauagugucaugagauaaacagugucugccaggagaaugggagagcucuaagugugggaugacaugcuugccauccugggaacuguggaaggagagaguaaucuuuaaagucagacagaucuggguuuuaauucuaguucaaccacuuacagagugacuugggcuaauuauuucauuucugaguuucaguuuacucauguaaauaacaccaucgauuuuggagaguuuuuuuuuccccccaauagagauggggucuauguugcccaggcuggucucaaacuccugagcucaaaugaucccccugccucagccucccaaagugcugggauuaugagucaucauacccagcuggagaguuguuuuuaaauaauaagccuggggugauagcccagaaacagaguaauugccucaaugaacuguugguaucaucaccaauaucauuagacauucaacuaucaccaguucaggaccucaacuucacuuaagaaagugaaugcgcaagacgagaucuuauuauuugagaaguugaacuccuacuauuucucucaagcaaaagagcaaagagaagcuacaaagacauccuuucuucccucuuguuucauccuccccaaauguugaaauucuacucacuuauagugggagcuggggauaacuccaucugaguuguuucugcuuccccacuuggccuugugggacccaauuccucuggcucuacaggcaucaauagcuguguagagcugcccccuucuccagcuggagacugcagcuccugaggaaccucucccaaagcuggugggguugggaguguugguugcuguugugaggauugcagagugccaagggucuccuuggacucagauguagcugcaucaguugaagaugggguuguuggguagcugucaggcauaggcgucccaucuuucucggaaagaacaauaauagugguuaaggggcaaccagccaaugaugaggggagccaccccaaucagcaaauguggccugauaaguaucccacccagccagugaucauccccacaacaaaaauacuccaaggaacaucucuggucugguauacuaaggaugaagguuaaggcacagugcuaucucugucccaagaaugcaagaacuggagcucugacucuguggauucuaagaauaaaauccuuucugugcccugcagguggaagggggaagauuucaggccauauagggugaggcuaaaugucucugaccuauagguacacagaaaaucuaacuaccaaaauccuauugauccucccacuucaucuauuuggagcaagaaauggucagaauuucguucaaaacucuauuuguuuuuuuuggagacagggucucacuguugcccaggcuggaguguaguggcacaaucauggcucacugcagccuucaccucccgggcucaggugaucuucccaccucagccucccaaguagcugagacuauaggcaugugccaccauaccugacuaauuuuuuguauauuuaguagagacagggucuugccauguugcccaggcuggucucaaacuccuaagcucuagcaauccacccaccucggccucccaaagugcugggauuacaggcgugagccacugcguccagcccuucaaaaucuuuuuuuuuuuuuuuuuuuuccugagacagagucuugcucuguugcccaggcuggagugcaguggcguguucucagcucacugaagccuccacuuccuggguucaagcaauucuccugccucagccuccugaguagcugggaccacaggcgagugucaccaagccuggcuaauuuuuguauuuugaguagaggcgggguuucgccguguuggccagguuggucucgaacuccugaccucaggugauccacccgccucggccucccaaaaaugcugggauuacaggcaugaaccacugcgccuggcccaaaauucuuaaaguaugcuuuccauucccuugcacacauuccuguucuauuacuaauaaaaugcaaucauuacacaguugaagaauagcaaaaugaguucaugcccaaagguaaaauaauuauaugcuccaauuaaugaaagacaagucacuuuauaaugacaucugccucacccuaaacaccaucuguccccuuccaugucucuuuucuuccaguccaaauuauccaaggaacaucuacaacuuugucugauggaggcaacacugcuaagacuaagugugaauaugccacacaccagggaaaguaguaaguuguauaguuaucuucuaauuggggccuaauaucccuaccccacaacaauacaacuuacuaccucacccuggcaugagcagaauccucuaauaagggcagcaggcaaaaggccauuuuacauggugacagacucuuuuaaagaucuuuugcuagauuaaggguaccaaggcaucuacccuacuucacugcuuuaaaaaauauugugcaggcuuugguacaaucauuuuccaacucaagugcgaaaggagacagguguagggaggcagaagaauguucugaggaaauaugggugggggagacauaugauaucacaugaaccaacugauagaaucacaaaauggcuacugaccauuguuaagaagaucagagggaauaggaaacauacggcagucauaccacuaagcccagagagcuaccuucaugaacagcacacuauccaagacaauguuccuagacuuuuagauuccauggaccaauaaaauuuaauuaaaaaaagaacaaaaaguagagacuaauguagggguugccaacuuuuaguuuagccauguaagaaaaaacauccaaucaacaucauuuaauaaaaauauuuugguaccacagaauuaggaauaugaucucuaaauacaaaaacagccuuuuaaauggaauaaauucagcuuuaugaaaaaggcauuaaagcuccuugauuuuguucguuuccacagaggacuggcauuugagaaccacugucaucaguuauucucaugaagugccacaccaugguggucaucaaaggaccagccacuucaaagauguacaugaacaugcuguuucagaggacagaguugcagucaggaaaugaacaagacacaugaccucauuacccaugccagaacaaaguagauaauaaccagaacaagaaccugaacagagccagucggagaagaaguguaccaccgugggaaagacaguagacuguauaguuaucuccaagaugggguaugacccuaaaacuauacaaucuacuaccucaucccacagagcaccaguguccaucuucagccuaugugggccagcuacucggaacuaucaggauaaagaagcaaccaauugauuaguaagaagggagaaagggaaggagaguuaccugagagauucuguucaguggagucauuugacuuagaugcaguacacugcaaaaagaagggauagaccaaugugggacuuugcaagcaccuaagauagaggucaacuguaauagucaccauccuccacccagaccaucuaggaguucagugaucuaauggagaaugcuuuggccaugugaccaaaggaaggugaucauuucacugugcaaauauaugaccaauuucucuauacauacucagguucaagaauuguuuggggcugagggggaaauaaauauggaaggaaaggauaauaaaaaccccuuagggaugggcacgaucaugaucauucuagcaagaauuucuugguuucaucuauguauuuuuucccuucauggggcuuauuuuuuauuuuguccacucuagucuuuucagucacaggcuagguucacuuauuuuucauccuauaucaaguuugaaacaauguguguauuagguaaaaaguucuauauaaagauauuuguuagaucaaccuuguuauuuuaacugaacacuucacuacccuuauuuuuaaucuaccugauuccuuaacugcugaguaggguauacuaaagucuuucacucucaagucuuauuucuuuguauuucuaucaguuuuucccccuuuuauaucaagugauacacuguaauguauaauucuaucaacauuuacucagacauuuaaaagaucucugucugaggucccagaaguuucagaaaaaaguagguaacuuccuucuaaaccaaaauuguauuagugauuuuauacaugugagcccuagaaaaaaugacauguggugaugggguucagaguacaaacauuuucucugaucugacaccuaggcugaucuuacucaaaugacggaauggggucaucucgguaagauuccccacacuggcaguucaccgacagaaauggaagugggcgacuaagagcauggacuuagauaagguuuuucuccuugucuugaugcuguccuuggcgguagagacuaugcagugugacuguugagugagaagccauucugcuucuggcuccaguuuuucccuugacacuugagaaaucuccccucuagguuugaauucuuuccccuaaaaaccaggucaauguauggugaauuugaaauaaaaaauuucccagguucaacgugaacguucuaggauucuucagugauuccuggugccauguguaugccaaaaccacauuacggcagacacagucaaagaugaauccucccagcccuugggaaucaccugugcacucugaucccuguucuccuuaucuucuuugccuuuaucaguuaucuuuguuucuuccucagccaguuguuuccugcgcuucucucgccuuucuuccagcuccucaucccucaggaauuccaggugauugacaauggacacuuuaaccacuguuucaaagaggcaaaaaucaaaggcugcucugguggggucagggaggaagccaagaggcagagcuuguagccacagagaaccagggaaacaacucuccacacguuugcccuagcucuggaaggcucacuauugcccugauaaccaagcugccacgcaccugaaacacagucaugcaugcucucagcaucgagaacuuugcauucuucuguccagcgggucagggcuguggggaugcuggacaggguuccuguagggacagcaaaggggaaugagauucuuggccuugucaagcauuaacugauccaccgauccaaaaauugcaguauuucccuaaaaggacccaaggucuaucacaauguuuagaacauaacaaguaccuagagacaauaaaguuuuuguugcccauggcuaagucacugagugguucuggcuccuauaaaauggggguuuucuauagggcagacacugucuugcuuuuccucagcagggaaaaaguagaaucugacaaauucuacccucccuuucaccacacaaacuugccugcuuggcugguagcugugcucugaucauggaaaaagucauccagcagcucaucaucagaacgggcgaugauguggacgucaucguugccuaccaggaggcgggcccgaccccggcuuuguaggggaaggcugcugcucagcugaaggaugucagcagcagcugagggaccaagcaaccuguaggguaaugguggguaccaugaucacuguuaaguccagaggugcccugcaaccuguuaccaugagauccucuucaugcauccucuauuaaaugcagaacaugauuauaaaccugaugaugugcacacaagucuaaguuauuuuucugaauaccacccugguuuuguacuuaaguuguauauuauuccauaguuccuggcaccaagugggugucaauaagcucccacgugccaggcacugcgucaggucacauugccuccacuacacccucucugucgucuguacaccaaccauuacaacacuuauaugccuuucuuuuacuucuuaagauuguuugucucacuaaacucuaagccugagggcagggaucuugucccgucuauaucuaaaguguuaagugcuuggcaugagacacuuaauaauugcuaaauacaugcgcagaacuauugacauaauuugguauuccccaaaaggcugcacuccccaaaaggcuacacauguaauccacaaagaaauggaacaaauaccuuauuuguguguaugacaagaacauuaagugauggacuauuucccccaagguuaagacaaugcuaaagcacagugaaaauucuuacaagagcuccgaugaauccaacagaucucuguaacucaccucugcaguauaagaggaggguugggcuggcgauucccaggguagugaacaugaaugguguggccaguauuggccgucagcugccuuaggguccucugacugcgcccgaugcccugggugagacgaguuguugaagagccacugcccagugucagagaacuguggucugcauggcgcaccaucaguggaugggugguagggauauuuccuggggauggggggaugucugcugcaaggacaauauguaaaagggucagugucaaaaagaaauuucuuccauguuuguucaagcagaaucaugucuccugggccuuacuuccucacacggaaaccugagcuuuguccuuucucccucauucccacaacucaucuacaaucacugacacuaccauagcuuaugccaucaucucucacuuagauacugcaacggccuccuaaauaguaccuucucccaauccauuuuccacacuacagucacagugaugcuucuaggccccucagauacaugcugcucccuucaccuugaagacuccucucccgcuucuuuaccugcucuucucuucuuggccuaagaugucacuuucucugugaagccugacuuccacagauuggguuagguaacucuuuaccucugugcucucuuacuauagugcaauguaaugccugcuuaguuaugauuccuaauaaaccacuccuaugaggaacgaggacuguuuucuucuuuacugcuguaucccuaguaccuaggauacaguaggcacuccucaaauauuguucaauuugcugaauggacagaggcucaacucuaagggaaacugaugaaaaucacaaaaaugcaaaauaaucauagauguuaucuucaaaguuaucuaauccaacccauuuuuuucucgaacuuuucauuuacaggugacaaacugaggcucaaagagguaagagauuaauuggccaagaaaacagaccagaacaguucaguguuuucugcuacaucaugcuugugauuuaaguugucaagaccugcccuaucaagacagcuugauucuaagaacucgauucuaacuugacgcuaaaagggaaguuucacggugaugggggaggaagagauucacucguucucccgaaaagacgcauccuggaugaauagagugaguauguucaaaucugcuccccaaagccaagcucaaaggugaccauucaaacccucaagaucuuguguuauggacauaaggauuauugauugcccugccacuguggugugcacaugggugccugaugcagucagccuuggucucuuucuuuuuuuuaaucaagcaaaucaucaaguuguccaggcucuaaaauggcugccuauuuacugaggugaagggaacaaaagcagccucucacuauuccuucuccuaaguauacacuaaugagacagauggauucagauaucccuugccccaggaagucagcauaggaaaagaagugcugucuguaucggaucgguuugguccacugcuuggcuuacccuagagaaggguauaagaaucaagagagaaaaacccagcugagccccuguaucuuacuagcacuggagaacauguugucaaacucaaugaugagaucauccucccggucaaagcgcucaaaucggaccaagggagaagcguucauaucaggauaauccucauccaauuccaucucagagccaucgucgucaucgucuucaucucccucuucaccuucaucauccuccuuaagggaaaauaggagauggagaauugcuggagguaaggguuuucugaagccuggugccauggccacaugugcacaugagggagggagacgcugaggcuagcaacccagacuguugguuuucugcagcucuauguucccauggaagaggucaucugaaccaacccaaacgcaguccccccucaccugaucaucuuccucaucuuccuccuccuccuccucuucauccugacuaucauccucauccucguuacugccacugcuguccucuuccugagugugcuccuccucauccucaggguccaggauauucauggaaucuaaaacaaagggagcacauuggaggacuaaacugaguagcuagaaaacaggcuacugugcaggccagcaggcugagugggaaggugaugggauaucugacucuaugagaggaagaaccagaucuggggugauguacagacuuagugagccagacccgauuuccugagagugccaaucaaugcaucaacacacugagcaggguggcugaauguggaggcuggcuagaggguggugcuugaggagccauggucuaggacuuggccaagucugcuggugcccccuugccuuuucagcccuacuuugcuauugacuauauccuguuggcaagagggaaccuggagcgaugauagcaggugggugagaagaaagcgaaccaaguaagaagugacaaacuuugggcaagcaguaguaacauguuauuugaaaaacuggcugaggauaaaguggaugguguaugucagcgcaugcagacagaugcuuccuuauucugcacaugugggcagcugccuccaggaaaacccuaguguagugucugucagacgugcagggcaagaagggaggccuuucuggccucggcacucucaccuucucgguuggccugcaagguggaagcuuggcugagguuggaaggagcuucauccaucagcacguccucuugugauucauccucuccacuucugcucacugaagguuacagagcagagccuucacugaacaacagaggacuucccuuuccagacugggugcgucuaaaguagcuauguacaccuagcagauauccacuuuuuuuuggaugagggagaagaccuggauugucugcugucagcuagcuaggugagcuuggccagucacuuuaccugucugagucucaguuuccucaucuguaaaacaggaugaucacaucugcccugccaaucccacuaauugugaaaccacagaggauacuggguauaaaaaagcuuuguaaaacuuaagaauacgugucuacuuccauuuauccuuugauuuccuugaucaacaaaguaaaaacaaguaacacauacacccucagagccaggugacaguaggguaccuuugccauuuucccucugagauuuauaaagggccacccucagggaaugaucauucuuuuuacacuacugagacucaggggcagaaagccccuggacuucauugaagaacugaaaggcagcgcuuucucacccuacagccuccucuaggccuccaugaauaaacacucuuuugaugugcuugauguaucaucuguaucaauggccacucccaccaccucccccacacaggcaacacuuuagacugccacaggccuguagacgucuugugaauuucucaucuguaagaccgucaacaucaagacaagcagcgaucuaggcuggcuaugagcccuuaggcagagcugagcaagcagaugaugagaaaaaggguccucccaagagagacugaggcaaaggaagaggcuauacucaguucuggggcucucaccuauaauuguacuguucccagauccgccaucccucucaagcaacucaucuaucagguccuccagcucauucucaaccuggagagaaauagaacauauauauggaugcacacaagucuaucauugugcuagcaccgaaacccuaaaaaaggccagcaaagcagcauacauuucuaggauaacaugugacagaggauguuacgugaaaccacacauucggugcuaauuagcacagaaacuaccacgugcuaccaauccacaaccagacuauccuucaaauggguccaucccaguuaucugauacuggguugucuuuauacuguccaggaagacauaauagaucucuuuaaagccagcagcuuaggaccacaggcccaauuucuuacccaaugcuaccagcuccagaaauuacaaugcuuuccuuuagggucuuuagaagacugcuguuuuaaugccccagcaagagcuggugcuauaggcauaaggugguguuaaggagcuuccaauaaugaccagagccaaaguaaaucaaagacccggggcccaacggucucaggucagcuuucuacuucaacauuucaccugugccuaaguuuucugguugggaucuauaucauuucauaguacauggcauccuggcccugcccccaccccucuuuuaauacaguacaaacacauuuacugagcaucuacuaagcauaucacccaugcuccucugcaaagcagccagcauugaggcaaggaucuaaaguacucacccacccacaccaccuggcaaggguuugguucagcgccgcaacagggaaaugcugggugaucugccucccuaccugcaucucuugugaacugagcaccucaggcugcccagcaaucaccacugagucgguuucagccuccccauccaugauauccccaucugccaccucugucugagugacaucaugauccuccuccugcacuucugcuuccccaggcucgccugaaacaaucaaccaaccagcaaaauaaucaaagagugccuaugugcugggcaccaugaggcaagcgcaaagacaauaaggucccuuccuugggcaaguuuguaaguucucagagaauaaacgaaugggugacaaaggaaaagacaaggcuacgugugaggauagccaaacaaggcugcauuuugaaggaauucuuuguggggcagauucccacgccacuaugacagaucucuggaaggccagcaaguucccagggaaacaccaccaagccagaacaguugugaucccaggcccauaaagcaacuacucccaccucuccaguccauuggcucugauucccuaccuggguccugcugguugcuacuggaaucuugagaggcuccuugggcauccugcucagacuuguucuugcuagaagcacucuugcugccaaaaaggcuacugggcugguucacaauccgggaaaguguuuccaaaggcuucagagcagcauugacuguguuggccauguugggacugagauaagggaagauaaagagauggacugagcacagaaauacuaggugucuaucuucuaaaugacacuaagcuucuuacaauggaaucuacuaagagaaaaggggcauaaggucguacaacuaacacucuacuuuuguuuagaaaaaaaaaauuuugacuuaaaugucuucaaggaacccacccuaaaagcaagaguuaaaucaaugccauauuucauggggccauggaaagcacaugaguaacaaauucuugacuggaaaucagaauguauucuggaugaccacaugcaagcaagccacuucucggauguacucaggauuuuuuuuuuuaaaccaccagcauuuaguccccaaacccuaaaagcucaaaggaaggaacaugauaaaaguuuuccuuuuuuuuuuuuggagacagggucucgcugugucacccaggcuggaguacauuggcacaaucucagcucacuguaaccuccaccucccaggcucaagugauccucccaccucagguuuccaagucgcugggacuacaggcgugagccaccaugcccagcuaauuuuucuauuuuuuguagagaugggguuucgccauguugcucaugcugaucucgaacucgugagcucaggcaaccugcccuccucgcccggcugauaacaguuugaaguccugugaauuucaaauuauacucuguagggcuuccuagaguucaauaaaaguacaauaggggcugcaguuggaggugugguaugauuucuaaguguaauaaggugugugagaccaaccaggugcccacuaacaccagagcagcucugcuuuuaucugcuuuauguguguauuuaugugugagucuauguauguauguauguauguauguauguguguguguguguguauauauauauauauauauauauauauauaugcucacuaguaguaccaagauggcagucucugauaucacaucacacuaaaaguaaccaagacucgucagaacaagugaucccaggaauagggcaaggaagggauaagguaagccugggauaucucauugugccaaaaagcuuucaaaaauuaaugggacagcugggcgugauggcucacaccuguaaucccagcacugugggaggcugagaugggaggauugcuugagccuagccugagcaacauagugagauccuguuucuauaaagaggaaaaauaacaacaaaaauggggaaaaaaaauuaaugggaucauuaccacaggcccagcugaguaucagaaagaauaaugauaguaauggaauuauucauuacaaaguggaaaucuaacagaaaccacccucccaccucagccucccaaaaagcugggacuacaggcguacauguccagcuaauuauuguauuuuuuugcagagacagggucccacuauguugcccagguuggccucgaacuccuaggcucaagugauccaccagccucggcugugaucaaauuuagcaucacaaguauugggaccaagugguauucaccugucuccugacgugaugugagaagggcaaauaucacccauguaguauuuuugccaaaaauguuuaaccugacccuaaccauuaagggagcaauuacaucaauguagacugugagauguucuauaagacaucaagccuggauucaucaaaacaggaaaaugucauaaaaaaaaaaaaugugacaaccaaaugcaacaugugauacucacugaaucccggaucaaaacacucucccucagaguauaaagacauaauugaaauaacugggaguauguguauauaaaauuguauaaauuuaguauuauuauauuauugguaaauuuuuuggauaugacaauggaacuguacccauauaaaggaauauuuguucuuaggagacagaugaucaaguacuuagagguaaaguuuuacaguguuuucaacuaauuucaaaugauucagcuccugaaaggacaggaagggaagaaauaaagcaaaauguucagcagugguuaaucuagguagacacaugguguucauuacaguacugugaguuugacauuuauaaauguuucaaaaaauugauagguuuguagcaaaaggacaauuuagucaucuugaaggggccacauaggucaaagguguaauaauuugagcaugaaaaagugacugcagugauccaaauaaauucaaucacuaguuucaaaacaaaacaaacaugaaaagucgaguccauaauacgacuuaaaaauagaaagccagaaaaaaaccuacauuugaaucucaaauguaaauagaaagaaauuaaguuuuuauacugccuuuauaauagaaauuauauuuuagcacaaccagacauucccugugaggcuaacacagaaaaaugccaguuaauaauguauucgaaaugagaaauuagaaagcuuuuauucauaagccucaaagaaauuaauugauccaggcaagaauuaucaacugauguuaaggcuauuauuuagguauaugauugauaguguagacauuuguaaagugccaaaauaacaacagagaugacuuucuaguaagaacaaaaagugacaauuaucaugggagaugugucucccacgauacaauaugagcuauacaucaccuaggcuacacauuucagcccaaaauguuuaaacugcuucaauaagccucuaaagccucuagaucuaacuagaaguuuacagaaaauaucaggaaguaaaggauuaaguuaaacuacacugcaaggaagcaacugcaccaaguuuagaaggcaaaaacacggucgcuucaacaagcuggaaucaugaacaacaaaaacaaaauaaagaucgaaauaaugaaaaaaaauuguuuuagaauaagagagauucagaaaacauagccagauguaauacaaguccuuaauuggauucugguuuggagaaaaaugcuuaauuauggauuugggcauuagguaggaugaaacuuauuuucauagcaaggaagugaccaguaacugaaaauaaaaacgaaaaugccccaaauuucccccaacacaauagcauguaucauaucauguuaguaaagaauacauuauuuaugcaugcaaagaaaaacacugaauaauaaaccaauaagguaaucaugguaucugggugguaggaauacagugucuacuucuuauuuuuacucaucuguauuucuuauaauauacauauaaucuucuaauaagugguaauuuuuaaaguggggggaagcuugaaaaaaaaaucacuauuauaguucaacucuugaguuuauagcaaguaagaaccaaggcuuuaagaaagacaagugcuaaaagccacaauaagaaagacuugggucucccacuuguacccaaaguuuucccacuacaccagcuaccuccacaucauucguguagugaggcugaagagaaggaaaagccuggggcuggggcaugauuuuaccuggacaggucuaagcugugagguacucuggccaggucauuaaccagucccuucuucaggaaaagccgaaugauguuguucaugccauugugcugggucuucgcuguggcacugcuguagaagcuggagguggaggggcaggacuccaugauaguacugaugauacacaucacugccugaagccugggagagaaguuuugacaucucuaucauaugaauauagccauuucucaggccaagucuucacaaaauagccucagauaacccuccuguaacuuuuguauuuccuucuggaaauaacaucuaaacaaacaggugagaacacacucccuaaggugauagcauucguuuucucuuuuuuagacagggucucacucuguagcaggguggaguacaguggcgcaaucuuggcucacugcaaccuuccugggcugaagugacacucccaccucagccucccgaguagcugggacuacgggagcgugccacuacgcccagcuaauuuucuguagagacaggguuucgccauguugccaaggcuggucuucaacuccuacuccugggcucaggcaauccaccggccuuggccucccaaagcgcugggauuacagacgugagccaccgugcccagccccuacuuuaaauaaaauuuaaaauauaagaucaaauaaccugcucaacuuccuugaagaccuuaaaaguacacuuaacauuucccuuuguuuucucuagguuuacccacuuacucuaaugguaaucagugcucuggcuauuuccaaccgccagaacuauuugagcggaccagagaguauaugaugccaguaugacaagaaguuuuguucaagugcaaaaccacccauggacuaagaagaagaauaaggggauguucuuggcuauuagcccugggacagguaugaaucuuaccuggcauguuucucuguacucucagccauagccagugcccguccaagggcugcuuuuacuucauucacuagggccaccugggcaucugugccacucccugcagcagccaggcuugcgaggaacaggcgggccaaggcagggguguccuugucuucugcauucuggguaugugggagcaggugguccagaacaaaagcuagcacacugcaguccugaaaagucaugaaucacgacauuuacuuacaagcacaauuaugccauaucauuugcacaggaccaaagauacacacacacauaguauuuccuuaagucacccaaugagugauuauuagguccacuuuauagaugaagaagccaaggcucaaagauacaagcaaguaaggagcaaacccagauuuuagaaaacuuccaaaugccacccauuucccacugcacagcuuauacacuguuauguagaugucauguauuuuuaaaaacauuuuuuaaaaacuuuauuuuuauuaaaauguuuuuaagaagaugaggucuugcuauauugcccaggccagaguacaguggcuauucacaggcaugaucaucgcacaccacagucucaaacuccuguguguguguucucacaccucagccuuccaaguagcugagacuacaggcaugugcuauugcaccuaucuuaaaauauuuucacaugugauauuuaauagaacuacuuacagcaaaucuauaaauagauaaguauuuucucauuugauaagcgguaaucugaagcccccuaaagaaguggcuugcacagaagaauuuaaucaagggcugaggauucaaaccuugauucuuaauuaagugcuauaaacccuucaguguucaauuaaauugaaauuauuuacugacaccuacaaugugcccaggacccugugcuacaauagaagcugguaagagcugagcaagagacagcagagucacagaaacuaauaugcaaaaauauuuaaugcaagguuauuuaaaguaacgaaaaaggcucaauagaggaaggaaauuaagucagacucuucuuuuuucucuaacuacaauuccugccuagacaauuccuuaucuuagaaacaaauucuauugucauucaagcaaauuuuggaugaaaauacacugaacauuuuuggaacuacauaggugacaguugcacaacacugcgaauguacuaaaugccacucaacaguacacuuuaaaaugguugacuuuauauaaauuuuaccucaauaaagaaaaugcauugaauaauuugagagucugagaaacugaauaaagugaccuugucaaaacaaaacaauuagaaauaacaauuaauuucccaguagugaauacauacaaaguuaaaacuauuuucucaauaaccacguagaaaggacuuagcuuuggaaucauagcccuagcuuccaauuuuagcucugcuacucuguaguauggucccaggcaaguuacuuaccucuuugagccuucucuccucuauuaaagagaucacuaucaacaaccuugcaguguggaggugaggauuaacaauaguauuuauaaagcacuuaccaguacccaguacugguaggacacuggacacauauuaggcagauacuuaauaaauuuguaauuaaauauguuaacccacagguaauacuauuauaaauuaugaauacaacuggcauaaaugaguuaaagcuuuggaauaaagccuggcuaggugugauggcucaugccuguaauccuagcauuuugggaggcugaggcgggaggaucacuugaggccagaaguuugagaccagccugggcaauauagcaagaccucaaaaaauaaaauuagcugggcgugguagcaugugccuauaggucccagcuacuugagaggcuaaggugggaggaucacuugagccugggaguucaaagcugcagugagcuaugauuguaccacugcauucuagccugggagacaaagugagacucuuaaaaaaaggaagccuauuuauguauuuauaggacuuauguccagaauauauuuuaaaaacucaauaggaaaauagaguaaaagagcugaauagacauuucccaaaagagaaugaacaaauggccaauaaagacaugaaaaaaauggucaacagggaaauguaaauuuuaacuauaaugcaauaccacuacaaacccauuaaaaucaguaaaaugaaaaaacaccaacuguugaucucccauaugcugcugguaauaauauaaacugaccuggccacucuggaaaacuuuuagcauuagcagaacaacuaucauacucuagagcucagcaauucuuacucuuaggcauauacuacccaacagaaauuggguaguucacgaacuuauauauauucauaagaaugcucauagcagcacuaucugugauagcuccaaaggcaaaauuacccaaauguuuauuagcaguagaauggguaaaagauguauuuguuuugguacaugguacauuccacaguggaauuuuauacagaugaaaauaaacuucaccugcacacaaaaugaaucaaguauguuaagcaaaagaagccaggcaaaaaagagaguacauucuaugagauuccauuuacaugaacuacaaaaccaaauuacggcacgagaacucaagauaaugguuaucuugagugaaggugaaaugggugggaggagaugcacuaaagaacaaggagggcagcuucuagggagcuuguaaugcuuuauuuaacuuggcuagugguuaccuaggaaaaacagacuauuuaagauuuguguauuuuucuauguauauuaaacuuggauuaaaguaagaauagcuuuaaaaauggcgguugcuuucaaagauggcaacacuagugccccuacucacucucagacccuuuugccacuuacuaaccauaaaauuacaaugugauccacaaaacaaggcacccuuacgggaaaaaauauuugggcacccauuuuacauaugcgggaacaugugauacaguuucucaaaaugccccacucacuuaaaaaaucuaaccugaggauaauucugcaucaggacacuucauucuuuuccacagcucuacuaaugaacauuuaaggcuuuuccuuuauuuuuauuaccaauacugcuaccacaucuggugucuuugcacaugugugaguacaucuggaagaugaacaccuauauucuuauuuauaugguuuauucaacuguccuuuagacacuuuuacuuagaugucccacagauacuucucaaaacuccucauuuucucuucaaaccuuccccaccccauucuauuuucuuguuagaugccaacccauaaaagcaauuaaaaaaacccccacaaaucaagaaacauccuugagucuuaauuuccuuuuucaucuuccaaacccaauucuuguccauuuguaccuuaaaaauauuucuucaacucacccauuuuccuccaacuucaccaagaucguacguuacuagauuacucuaucagauuccuaacuguucucucugacuccagucuucccucuucaaucuccacaaugcauaaaaagggacuuucaauagaacaaaucucauuaacucucucucucagugaaccuaaugaaaaaaggccuagcucuuucagguuuuuuuugagacagaguuuugcucuuaucacccaggcagguguacgauggugcgaucuuggcucacugcaaucuuugccuccuggguucaagugauucccgcaaucucugccuccuggguucaagugauucccgcaaucucugccuccuggguucaagugauucccuugccucagccucccgaauagcuggaauuacaggugcccgccaccacgccuggcuaauuucuuuuuguauuuugaguagagaugggguuuugccauguuggccaggcugaucucgaacuccuaaccucaggugauccgccugcuucagccucccaaagugcugggauuacaggcgugagccaccgcacccggccuugcaugucugaagaugccucuucucacucauuacuuggguuagcacuuagcaugcacagcuucccagcagugucugacacaggcgguacccaaaugauggaaguacaguguaacaucuuaaauagaaguuggaaauauuaccucuuugaucaguucagacuggcccacaguguagcuguaguuggcaaucaggguagcaauaccaacauaggaccucaccaacucugccagaagacgaaggauaguggagguaggcauuaaagguuugcugcccuugccuuucuguuugccuuccucagaggcccgguccccuucuuuaucuuucuucccaucucgagacuccucuggaguugaagcuguugagaaaagucaaacacugguucaauuccacacuggaacacuggcaaaaucaagucuuagguggaaaagaaugcuauuucuccuccacuuuaagccaccuguacaaacugaaugcucucgugacacugcagugcaagagcagagaaccaggauaacucaggucucagauuuaugugguuacaguacaacagggaugcuuuguccaacuauuugugcaucucccuccauuucccuccuuuuacauacuccagaaacacucuacuaacaguucuucaaacuugucuugcucccuuacuucuuucuuccgucugccuggcacacuuuuaucuaguucagcucaaaugcugaccuccuccauaaaugcuuuccugucucaucuagacauacugugagauacuuuacauguccauuauaucuuauccaaguaugccuucauucuggcaguuauccugcauuauaacucuugcaggucucagucacuggacaaaguacuuuaaguacagggaacaaaucugauccauuuugguguccaauauagucugccacauaguggguaaugcuucccuugaaucagcaccaucauccacgcuauacacuacauauggccaguaaacccaguaaaaugaguuaaccaauuauuucacuaauguuagccuuuuaaauuuaucuccaggaacuaguaugauuuuaaacaaaaugucuccuaaauuggaucacaaagaccuuuccuaucuaaggagaagcagcucuuuaaaggucucauuagacuuacucccagggacauuuuucuaguucauggugaguagucaaugggcucuguuaacauugcuggaagacaggcauccaccacguaaagcauguagcuagaacaauaucacuggcauaaaaucucuauaagccaguuuuuagaaaccccccaaauaauuauggugugauuuaaaaaguaaaacuaaaauauguuaccacagcaaccauuacuagguugguuaacuuacaguuccauuaacuuuagcauauagagacccuuuauuacagaacacugagcucaccugagaaaguucacuuagaccaguaaacguaauaauuaagucuguauucuccuacccccugcacaggacaccuacaguuuuuucaaguuguuuuccuaaggaauaagaacaugguagugagaaaagcaaaucauuacccucuccuugggaggucccagaugcggaagucucaguggaggcaccaucugcagcaaagaccugacucugaagaagaagaaaacuccugagcuauuaugaauuucaaaagcacccgucugcaaauggcagaacuccuucccagggcacuggcugggaaugccacagauucucuuuggccaaccuuuuaaccaccuuacaccuuuauacuauaaucugugggaggcuauuauaaauacagugacugggagacugugggggaggcggggaaggaaagggaaaagaaaaaaaauuaaagaacaguucuaauccuaggagagaaaaaaaagucuccagggacaccccaauuuugucuuuacaggcaacagauaauuuacagauacaucacaauuaauaucuuugaaauuccccggggauagcccuaaauacugagaccacacaggcauugaaaaaugagaagaaagauaaaacgcuguuggaauugacuuacauuaauggaaaaaccugacugcguaucaaagucacugcucugacgcguaagugaccgguacugcugguauacaucaucacccaugucuugcaggagcuggccaaccucuugggucauaaccccagguuuaggaucagauuuaucugcuaggaaaacaguaacaaccaucaaaaacaaaauaaaccucuucuacaauuggacaauguuaaggccuaucuagucagucuuggucaauuucacaucaaguggcuaugacuguuuacauggugcuauuacagauaauguuagagugccucacccuaaaauuacaaaaacuagucuugugaccacaggcaauuaacuuagucucacuuuccuaagcuguaacuacaaaccuuaagugaacauaccuggcacuauugcucaugcaguggugggucaauaaaugguugccacagcuauauagcuaaacuauuucggggaggugauaagagauaggguaaagauucuggggugauaggagaaccaaggaauucuauauggaucaggguucuguacagaugaaaagcaccaaggucaagacucagauuucuuuugcuuauuaaaggcagcauucaucaauuuuuggcaauucuguggaccuaucaaauaaguauguccugaauaaaauccagaaggaccuuacuauaauggaaaccuauguuccaagcaaaucaaucaugacuuuccuaaugcuuauaagaugcaccuuaacuaggaauaaagguggaugggugugguggucucaacaguuaggaaacucagacacaccuccuaauauugccuccagcucuucagacaauaaaaagguuuugcuugaguaugaaaacauuagagacuuccuggugucuuauuuucaaccucucacagaaugcuauuaucuccuucuaaaucuuuguucauucuucccccguaugguguguauucucauauaacagaacucuggcaaucucauccauucaagguucauuuuagaaaucauguacacaaagaaauuuucuuaccugugcacccucacuagguaaggugccucacccuaaggacuuaccaccauccugguaugucauacuauaugacuauuagcuucuucacagacaugcaauggguaucuuauucaucuugagccccagaguaugggcacauagugagugcucacuaagccaugaguuggcugaaaugacccaggcaaaguaacauauccucuagugcccagccuccugagguaggcuagccacauaccuuccucuggagcaugguaugcagccagagcauucagcauaucauagaucacuuccuugauaguaucagggaugacaggcagaggugagggcuucaaagggguggucuucaccagcuguacagcauuagggccuuuaauucuaagauucucaaauucaucaucugaagcuaagccaaaaugagagagaaaaaccagucaaucaugaagcaguaccuaaacuagguuacuaauaaagacucagaagggggcauguaugauauagaaggcuugagauaggagaccauuuucaauuaauguucaaguacucuacuauaaaaccugguuuauacuuuccuuaaauuccacaggauuuaauauagcaguaccaaauaguaaaggcuugaguuagagaaaacugguuuugaaauccaguuguuaauucaacaaaccucaauuuucucacucuccaaauuuauguugaggauuaaaugaggauauaacugagaaaugcccagcacaggggcaggcacauagcuggaacuuccaaaauaauuucauccccuucccaacguuuuauuaaaaaaaaaaaaaaaaaaacucccucucccuccucucccuccucucccucucccucucccucucccucccucuccccacggucuccuuccauggucucccucugaugccgagccaaagcuggacgguacugcugccaucucggcucacugcaaccucccugccugauucuccugccucagccugccgagugccugcgauugcaggcgcgcgccgccacgccugacugguuuucguuuuuuuuuuuugguggagacgggguuuugcuguguuggccgggcuggucuccagcuccuaaccgcgagugauccgccagccucggccucccgaggcgccgggauugcagacggagucucguucacucagugcucaauggugcccaggcuggagugcaguggcgugaucucggcucgcuacaaccuccaccucccagccgccugccuuggccucccaaagugccgagauugcagccucugcccggccgccaccccgucugggaagugaggagcgucucugccuggccgcccaucgucugggaugugaggagccccucugccuggcugcccagucuggaaagugaggagcgucucugcccggccgccaucccaucuaggaagggaggagcgccucuuccccgccgccaucccaucuaggaagugaggagcaucucugcccggccgcccaucgucugagauguggggagcaccucugccccgccgcccugucugggaugugaggagcgccucugcugggccgcaacccugucugggaggugaggagcgucucugcccggccgccgccccgucugagaagugaggagccccuccguccggcagccaccccgucugggaagugaggagcgucuccgcccggcagccaccccgucugggagggaggugggggggggucagccccccgcccggccagccgccccguccgggaggugaggggcuccucugcccggccgccccuacugggaagugaggagccccucugcccggccagucgccccguccaggagggaggugggggggucagcccccggcccggccagccgcccaguccgggagggagguggggggucagccccccgcccggccagccgccccguccgggaggggggagggggggucagcccccugcccggccagccgccccguccgggagggaggugggggagucagccccccgcccggccagccgccccauccgggagggagguggggggaucagccccccgccuggccagccgccccguccgggaggugaggggcgccucugcccggccgccccuacugggaagugaggaccccucugcccggccagccgccccgucugggagggaggugggggggggucagccccccgcccggccagccgcccaguccgggagggagguggggggucagccccccgcccggccagccgccccguccgggagggagguggggggaucagccccccgccuggccagccgccccguccgggaggugaggggcgccucugcccggccgccccuacugggaagugaggagccccucugcccggccagccgccccguccgggagggaggcgggggggggggucggccagccgccccguccgggagggaggugggggggucagcccuccgcccggccagccgccccgucugggaggugaggggcgccucugcccggccgccccuacugggaagugaggaccccucugcccggccagccgccccguccgggagggagguggggggggucagcccccgcccggccagccgcccuauccaggaggugaggggcgccucugcccggccgccccuacugggaagugaggagccccucugccuggccagccgccccguccgggaggguggugggggggucagccccccgcccggccagccgccccauccgggaggugaggggcacuucugcccggccgccccuacugggaaguggggagccccucugcccggccacgaccccgucugggaggugugcccaguggcucauuggggaugggccaugaugacaauggcgguuuuguggaauagaaaggcgggaaggguggggaagaaauugagaaaucggaugguugccgggucuguguggauggaaguagacaugggagacuuuucauuuuguucuguacuaagaaaaauucuucugccuugggauccuguugaucugugaccuuauccccaacccugugcucucugaaacaugugcuguguccacucaggguuaaauggauuaagggcggugcaagaugugcuuuguuaaacagaugcuugaaggcagcaugcucguuaagagucaucaccacucccuaaucucaaguacccagggacacaaacacugcggaaggccgcaggguccucugccuaggaaaaccagagaccuuuguucacuuguuuaucugcugaccuucccuccacuauuguccuaugacccugccaaaucccccucugcgagaaacacccaagaaugaucaauaaaaaaaaaaaauuaaaaaaaaaaaauaaaauaaaaaaacaaauccaacaaaccuacagaaaaguucgaauaguauaauaaacaucuauauacuuuucauccagaauuaccaagugacuacuccuaaauacaucuacuuguagcuccuaagaucaaggacauauauuuucuuuuuuauuaccaaaaaagucagcagaggggagaucaaggguauuuuuauacagaacugcaauaccauuauaauaccccccaaauuuaacagauacaauuacauuaccuaauacauagcacucaaauuucuccaaaucuuuuaucuggauccacagcccaaccaaggcugguggugauuaucucucuagucuacuuuucucuauaagaaaugauccuguauuuuuucuuucauaacauuaauauuuuugaagagucuaggccaguugucuuauauagaacaucucacaauuuguauuuaucuaauuguuuccucauaauuaaauacaggucaaacauuucuuggcaggaauacacagaugacgucuauuucgcacuguguuacacgagacauacauccauuuaacccuuaauuaucacuugauuuguaaaccauuaacuauauguaaagccuacugccccaccaaaaugagcucuuugaagugaaggacuagaaugaaugaguccucagugucucuggcagggauuacaacagggcaaggcccagagaagcuacugaaguaccuaauaaauugacccaaacaaucaauuagccagcaaauguccuaauacuugccuaaggaggcucuucaaguuacagaccuccucauaaauaaauuucuggauuuauaccaggccacaaacuuaauaucaaaggccaggagcaagcgaaacuuaccaguuccugagccucgaggggcaggaagggcgaugcggauacagcaguuggccacuucugugaauaugucuggauugcggcaugcggcuggcccaaggacacgaaggauguaguugaucucccgagagccgaggcugccagacacaacaccagagguagugcuaccagcuccacuuguagcugcugagcgaacaaccuaguaaagagagaaagaaacacugucgauuaaacacuacuuucuaaaaauacaacugcagucaagaguuaccaagacuaaaagcuuuugauuuuggggagaaugacauuuuauuuuuaagucccgucccaucccuucuugauucaaaaaaccuggcuuauaaaaaaguugcagcaugucucaaaacuaucaauuauuagaccagacugcaugugaucuuuauagaaacugggagaugugucaagacuauaaaccccacauaacuuccacauuaaaaugucagcuccugagccucuccaaaugcugucacaauuuuaaaccagaaugguucaaaaacauguaacacuguaauccacuuaguguacaggaacacaauuaaauauuuucuuuaugccucaaagucaaccaucagucugagauaaugauagccacuggagauacugaacuauuuauauauuguuugccuugauaacacagggcuuacauauagcuaugcuucugcucuucucauaaaauugcuuguuaauaauggaaaaauccaugaaagcacgaagaaaauaacucaauuguauuauuuuccauuaucuguuauuucacaaacuacaugcucacaaugaaaaacaucuuuugguaucuuaauuuuuuuuuuuuaaaccaaaucaaucaugcccuuuagcacauuauacccucuguaucuugccugucuggcuguaauuauaaaauaauuuccauuuaauaaacacagaaaaguuuaauuucaauauuaaggauaagccauaauuuauccagcccccaacugcuggacauuagaccucuaguuucuugauauuacaagcaauuccacagugaacacucuuauauaugcaucuugguauacuugauguuaguuaucagauaaauucuuagccauagaauuucuaggucaaaggauaucuuagaccaagaguaccaaauugcccucccauguggcuacaccaauuuccacuccuaccgaaaguuaagaguaugccugguuuuccacaccuguacuagcaaugaauaguaccaagacuuuacauuuugccaucuugauacguuaagacugucacugauguuccuuuguuucccacaccccaacuauaauuuaccuaaaguuaaaacuuuaaaaguuuucccucauccaaugaggaccuacacuuucuccuagcacuuugaacuuguaacuuuuaaacauuucuuuauagaaagcguuucaagcauuucaaguuucuaaaaucagaauuuaguuguauauaguuguuccuucccugcuggguuaucuccuggacuguggaucaccauacaagcuaccuuuaacagcucucuuucucuugauuuggcacaugugaggugaaaucaagcaggcuguguaaagaacugucugaagaaucuaaaauguauacucagauauacaaaaacugauaccacuuuucuggcaagcaaguuaaaaaauacuuguaaugccuuuugauccaauuacuaaaaaucucuaaguaacgaucuuaaacaugaacaaaguuaggcacaaaaacgcauauugcaacacugcuuauaaaugugggaaacaaugucccaagagaggaaaacggaagcaaagucuauuaacagucauuauugaugacaaagaaucagcagaagaaaggauuuuguauuaaguacugaggaggaaaagccucacuacuaggacauuugccccucaacccuccacuguugucuucuuuuuuuuuuucuuuugagacagagucucgcucugucacccaggcuggggagcaauggcaccaucucggcucacugcaaccucugccucccaaguagcugggauuacaggugcaugccaccacacccaccuagucuugaacuucuaaccucaggugauuuaccugccucccaaagugcugggauuagaggcaugagccaccacacccagacuauugucuuaacuuuacaaauguuuuuauuuuuuauaaguacguugcuauuucuuccacugguuuguaaguuuccuaaaauauaauaaccuguuuucugaucugcacaauggauauuuguuaagugucuaucacagugccuggcagauuacaaacauucaaaaagcuuuaacuauacuuuuauauuccaaaauacaguguuuugagaauagucucuuggcugaacacccgagagguacuccuacaaaggaaugauucugaagguaugaacuugggggaagguaucccaguucuuuacuaacgguuuuuggcuugguuaaugaaaccuagauuaaaaaaaaaaaaagaaaaaaagaaaaaaaagaaaaccagauugcuggagaggacuuucuagcaauaggaucauccuaccauaccuaagcaagcucccaagcauagaguuggaaaauucuguuggguggaguauacaguauacauaucuagcuauauacccuaagaagaaccagaagucuauuuguucucagaccaaggagaacauagguaugauguaaagcuaaaccagaaucugauacaaaacacacucaccuuuuccaugguaugacgaaggguacagggguccucaaugaugugucuuaagagaagggugaccaggggaguaaacccauugaagccugagcucugggucaaauucaagaucaugcggguacucuucaguucugcaaacaucauggcauauuuguggucccgggugagccucagacagagacgaaggguggcaugcaaaguaucuggguccacagggacucccagcaugcucacgcaggcccggauuaaaacagucaccauaucuucugucaagcccuggaucaggaucuccccgauuuuuguuuccuccaggcuugucuccuuuucaguguuuguacucucuagggccaaagggguaucuauaaaaugggaaaauaacaguuuuagacaguuuaacuugauguuuauuuccucccacgccucccuccuaaguaauuggccaagcacuuggguccuauuaagagaagcaugccaaauaccaauuuuaagaucagaugaaaaagcauaagggaggccuacguaucuuuaaucuguuaaucaagcugaugaaaauaacucacaaugaaauuggccagaccuuaagccacaaaggcacauuagcuuuagguaaaacacucuugguacauaccauugccuuuauuuucuuuacguuugauauccauuucuuugcuuucuuccagcgucuucucuaguuccuguccauugcuguuuuuugaauuuuuauucagccgagguacccugaggagagucagcaucacagggcgucgguucccuguuuccucauuaaccuaggaauucaaacagacauuaaaaaaaccucuaccaaaaaugaauuauaaaggugggggaggggagggacaucucccagguaaaaugcuacaacaggaaggaacucuggcaauuuaucccaccuuuaucauuuacagagaaaaaaccugaaaguccccagaaggcaaguggcauacacaaggccuuauaaugaacuguagaccuuccaacagagcaaauaccaucccuaaccacucccuagcccuugacuaaacacuuaaaaucauuucuaagagggauaguaucaaauugcuacagacccaaggucuaaucaaugaccuuaggaagacucgauuuucugaaaucuauacuuaauuagguaaugguaacucuccuccuccuaacacguuaggaaugcugguucagaaagaagaaaaccaaaacacauaccccucuuuuugauaaaguuuacaguagggguguccaaucuuuuggcuucccuggaccacacuggaagaagaauugucuugggccacacauaaacuacacuaacgauauuugauaagcuaaaaagaacaacgacaaaaaaaccucaaugugugguguugggcugcauucaaagacauccugagccauauguggccugugguccacggguuagacaagcuuggugagugagcauguaccugcaccauuguagugaauuggaccguguaucuucuucggccugcagugaaucgcacgcuugucucuccagauuuccaggcagaaucaauagugcuauuguugcuugcacuguaacuacaccaacgcccagagcgaucaucaaaccagcgccaguuguugcuguuggauugcagguacuaaacauaaaaguacaaaguuucuuuguauuucuuucaagguugauuagaagaaauaguaacuucaucaguguucacugcuaaaacucacccaggaaaaagaaauauacuggacaauaaauuuuaaaaaccaaaagaacauuuuucauaugcauuuacucucacauuccuuagucucucugcuacacgcuuaaaaacaugucuucuaaaguucagguguugaaaacuuaaucccuaauuuaacagugcugggagguggggccuaauaaaagauaauauuaggucauggggacuccgccccucaugaauggauuaaugucauuauccacggacuggguuaguuauugugacuggguugguuauaaaagcgaguuuggacaccucuugcucuuccaccuucugcaauagaaggaugcagcacuaaggcugucaccagauguggucccuuagaucagccucuagaacuaugagccaaauaaacuuguacaguuuauauuaaauauuuuuuuuggagacagggucugacucugucaccuaggcuggagugcagugacgcgaugccggcucgguucacugcaaccucugccucccaggcucaagugaucuccccaccucagccaccugaguagcugggaccauaggcacacaccacuaugccugguuaauuuuuguauuuuuuggagagaugggguuucaccauguguugcccaagcuggucuugaacuccugaacucaaguaaucuaccugucucagccucccaaagugcugggauuacagacgugagccuacagugcccagccuaugguuuauaaauuaguccgugguauuacguuauagcaacagcaaaacggacuaagauacuuuuccuagacaaaaaaacuaucuacagccccuuaucuugccauuuucuacuuuccuuuuguuucuacugauuuucccuaaaaggggaauguucaccugagauguacugaaacaaaaauucuguuuccaagaagguagugagaugauguggcacaauaaucuucaucuaaggaguguuugcuuuuugguaggauugcuguauacucagucccuuacauaacagaaaagccgcuccuccucuggagauagcacacuccuucaaaauuuacuuccagaguaaauuauucagaagagaaaccuagcuaugaaaaucccuuaagagauuuauacauuggucagagacuucuauauucuucacuacucucucauauucucuucuggucuacucuugccucaggaagcuaaaccguccugcagucauacauacuacauuacacaccuuagucaucugggcucuccuuuuugaggagauggcugucuuuucauagaaaucaaucaggagcaacacuggugugauccaccuaaaaaagaaaaaugaucuguuuugggaaagcaagaaaccugcacaaauugggaaaauauaucuuaauuucaucagaugcuuccuuuauaauuuuaaaacuacagaaguaccacaaauuugccccauacaugccccagaagagugccugauucaggcccaugucccagggaaauagaaacgaaacuaggguagauauaggguuacucacuuuggggucuggacuuccuucugcuccuuggcugccuggaggcagggcugaaccacuuccaagaguuugauuaggacauuaaggaugccacuugauucaaccacccaagcacaagguagcuucaacuccugauagaucaaagggaaaaaacaacaacaaccagauaccaauuucuacucaguaacaaagauuagcaugggauaggggaggggaacauaaggguaaauaauaauagaauugguugaguucaaauuuuaccucuuaccauuuaccaguuguguaaucuaagauguguuaaauuuucuaggcuuugguuuccucaugggucagaggaaauaauuuuuaccugcagaauaauugugaugauugagguuuuauauauauuaauauaaaguacccagugccuggcacuaauguauaugcuuaauauggaaaugguuuaucaccaagguugugcagucuauguugaaguuguaaagcuuuagauuuacagagaaauuuuauaaucuuucaaggaaaauggaauaauuaaacacaguuaaugguucgucuuacuggggcuacaccaaaguguuacuuuuaacaggaaaucacuggaaguaaauguccaaggauagguaauuauuuaaauaaauuagagaacauucaaaagauggacuaauguauauagcaaaugggaaaauagucauaauacuuaacaaaaagaauauaaaacuuucuauacagucuuaucccaauugcuuaaaugaacaggaaaaaacacuaaaagaaaauacaagacuguuacuugugauuuguuuuagauggggguccaugaaugauucucucuuuaguacucugaaaccuuucccacaaguaucuauuuacaaagugcuacaguaagaguuaucacuuccaugauaaaggaaacccccaagacagcuguuacacaguuugacucuuauauuggauuuauccccugaguuugcuguauguaaaggguucaguucauuaaguucagguuuuaaagauaaugagccacaaaugaagucauuuguccaaggucaauugccuccuaguuccuacguugguuggaucaggucuugcccaaaccacucucuugccucaaauaaucugcugacuaaauaggcaaggaaaagagagaggaaucugauuucaucuaaugucuauuaccucaauauugaccacauccaauuugcauacccuacucuacuauguggcugccaguuagguuuccucagaagagcaaaaaauauucuaugaccaagcucuguuaguaauuuaaauacuuuuuuuuuaaacuaccaccucacaauucugacucaauucaauuaaugcuuguucucagaagcccuucucacaugaauccaaagugaugcauaugacuuuccuaaacccagauaaaacuguuaucauucuaacacagaaugcuguauuuuauacguaauuauaugcauuucagccuaucagaaacugggcucaugaaaugcaggacucaugccuuauucuucgcuuuaucgucuucaaugccucauauauguuaaguguuugauaauucuuucaugaaugaauuacaaggccccaaagaucuaaaucuuaccucaaaaaguagcguuaaaagcaagauucuaguagccaaauuggaggccuggggcaguguggccaucugacuuauccacucugacacgguuuuugugucacuuguugucaggggaagagcagcuuugaucaauacaucagcagcuucccacaccuagaaaagcaaaaaaaggguuaagucacggaaccgcagagcaagaugagguuucugaaaauauucucaaccuuuuaaaauacucccucugccuccaacacauucacuaaagaaagguagguaaaucuaacauauuuaccauagggauuuagaaucuauaucaaaagauguaugcuacuaaaggaucaccacuaaacaauuacuuuauuaggcuagacuauaagcagccuaaaaucuaaguuaaaggaaaugaguauuuuaaaacuuccuggugcauacagucaaccccaaaaagguucuaucaacuuauacuuccaucagcaaucuuucauuuuaucucucucucucagaauuauuguuaaaaaauagacacuaaaacuuucugugaaaaaauguuuuauccaguuuuccuuuacuuguguucuugugcauuaaaguucuauuuuacaaagcccagaaaaaaguuuucccuuuuuuaauuucuuucccugcuucuagaaugaaacauuacauaaaacaagauuccaguaacuuaaauacaaucgaaauguuaacuggcuaucuggguguggggauuuaagguaauuccuuucuuaucccacuucuauaauuagcauaauuucauaaugagagaaaagaaaaagaggacaaauaucaggucacaaguauucaucaggauggggacucaguuguucaagcggcuguuacauaggaaaaaacauuuauucaguauuaguccaggggacgaaccugacucaagggugaggcacauuuuagacauuuuaagagaaaaguagaaaaggagagcuuuguuuuucccuucuaaagacauuuuugugugugcgauguaguuaacacacuguuucaggauuaccagaucgaaagaauccaaauagagaauauacccauaucagguagaaugaaaauaugcugauuuuucagaaaucagguuuugacacaggcaggcaaaccacuucacauacuccccucuucugaccccuugagagcucaccugauugacuacuugcuucagaaucaugucacgauaaucugcuccauuacguuugauugcugucaugaucaggucacacacacgguauacugugucuggcagcucaucaagaagguggaagcagccuggcaacauaguaucugugaaaguguggagcucaucuuguuccaacgggucagcauccuggaacuucucuagacauuuagccucuuccuccuccugcuuuucccgagcuuuccguuccucuuccuccuuccggcaagcaacuuccuggaagcagggaaggaagugugaauaauacacaggagaggugaaggaggaaagauaagagagacucugagaauguuuuugcucuaccauaugauuacccucaaccuucuccucaagcgguugauacuuucauccaggauguggcagccacaaaguuuaaggcaagacagggaagguagaagggagggaugcuucaaacaacuuucacugucaagucacuuguagcauucuauacuaccucccgcaaaaucauuucuagacacuguucuauauucugugccagcagggaaaauuaaaguaacugucaccuagaaauauacagccaaguucggccuaauggcacuacugaguacacauugggucucuuauuugacaauaaagauuaacgcuucauaugccucccuuaaagcuucaggucaauacaagguagcucaauaauggauggcaaagcugggaugaauuaguacucuucucaugucuuccuuuagauuugaauucuaucaauuaguuugcaauacuagcagaauguucacagaauacuaagauucaugugccaagcccuuuaggaugcaguguuccauaguuaccucaggugacucugcccuuugauccauuggaauauccugucccagagacauagcaauugcucucaucaucugguccucuucagacaugcugagauccuagaguguuaagagaauauccaguaaggauacacacucaaaacaaagaaacccaacaagaccacugcaacucacaggcaaucagacaucuugugcucaagcuaaagagagaggaagggccucaaaaugcugcucuuguauaagucaaacccuaucaggcuuaugugguuacuacaaacaagaacagaugaggaaaaucacacguaaaacuaaguauaggaaggaggcuuacagugugaucaucuauucuacaucuuagaaaagugugccucuucuauuguuuugugacuggggguucuugugcaaacaaaguauaguaauuuguauugcugggggacagaaaacuucuguuauuaugaaaagaaaauacuggcauggacaugucugaaaaugagaagcaguuuauagaaaggaagaccaaugacagaauaauaaggggaaaaaggacuucagcagucaaaccaauauccuggaaaaucacugcuucugagccaacuuacccgaacaacuccucccaugauuggaggaggguggguuaaaagguacucuguggccugcuccauggugcugguguucaacagugccuccauugcauguucccuugugaagcccauguccaugagcuacauaaagaaugcaagggcucagaaucacauaacggaaauccaaauacauuuuuaaaaggaaggaaccuuuucaagauggaaauaacuuuuucuaacuucaucugggcugagagcauuuaugagcuagggcaauuagguaaaaugaacaauccuuucuguuuggugcuucuauagcauucuaagcuacacauuggguaaggagccaagaagauucucgauuucauccucuaagaaaguuagggggggaugcaugguuauuaugauuaacaggguuauuauaauuaaaagauugagacucauacaaagaaguauaaauuggucccaacuuucuggaaaacaaacugguaacagagcaagugccugaaaaacugaccuaguuaaucuacuaccaggcaauaaucaugagauguauguaaggauugguacguaaggaaacuauacaacacaguguuaaaacaucaaacuguaagaaaauuagcauccaacaauaaaagaaugaccaauuaguaaaaaaaaguucuugauaacagcaauacaaguauauguauuauuugauguuaacgacguaaaaauuaggcacaagacugacugaaaaaggagacaaugacuaucuugugugauaaaauuacgaaugccuuuuaaaagucuuguauuuuccaaauuugguaaugagaguauuuauuacuuuaaugauaaaaaacgggacaaguguauauaguagacagauuugaacaggacuccagacauaaaagcugacacacauacauacaaacuccaggaagaaaaucuuaaaaugcucuuugagauggaaguggcaggacuuuacaugccuuuccccucuccucuuucuggccucccaauuuuuaaaaugccccuuauacauuuuauuugcaagugaaaacaaaaguuuuguaggugacuaagguuucagaaagcucuuguuggagaauaaaucugguucacaauauccauucucuuuacagguuaaccagaaaguaacugaggacaguuugccuccacugaggcagcaggaggcuacugagaauacucaucaacaugcuugaaaggaguauuaccugugcagagcaucaggacuauacuccaguuuuccucaggagaaaaaaaauaaauacuaagagaaggaggaaaucuaaacugucuccugguuaaugugaccagggacucagugguaugugagcuuagaaaauccguaagcaucacacuccauugggugcaaagucuggacccuggagugugaggccaguacccuaccuguugcaguuguugcugguugacuugagguucccggcgggagccaccuuccucuugcccuguauccucuucuccucgagaccccuccuucuccuugcuuagucucucucgaaucacagguucuccucggaggauguggcauagaauggccagcaucgauucagccauucguccaccauauaccuucagggguuuccgguuccauaaguuuuugaugcaaguaaaggcugccuguaaguaauuugaaaagugugugaaaaucauuuugcuucaauucaaagcucagaaggauuaaguuaaagaccuauggaacaguccuuccacaacuaguaccagcaacaaaauaauuggccaacaugaggaggucuaaggaggcacagagaagaggcauuuuacucaaccuuaagcagugauacaguuuggaauauuugcucugcccaaaucucaugcugaauuguaauccccaaugcuggagguguuugggucauggggguggaucccucauuguuuaguguugucuucaugauagugaguuaguguguaccacccccuccaccuccuggcuccugccaugugacaugcaagcucccacuuaaccuuccgccaugacugugaacuuccugaggccucccuagaagcccagcagaugcuagcaccaugcuuccaaagcuugcagaacugugggccacuuaaauaucuuuucuuuauaaauuacccagucucagguauuucuuuauagcaaugcaagaacggccuaaugcaaguaccaaucugaaauuuacagcucaaauguuuaucacggaaaauucucaaauggucuauauucccuuacguaaggcagcccuaucugggaguuggauccagugguucuuaaauaagcauguuauuucauuaagcaggacaaaauagagugggaacgacuuagcaugagaaauuccuuuugauuuuagaauacugaauacucacuuucugaguuaccacaaggaagcgcagugcacugaacuggggaaaguucuggacaccuccaggcaauuuggcaggcagcgaauguggagauucaagcaccguggugggauucaccaucuucuccaccagcauaagccaggcaucuaggaauucuccugugccaucaggcaagucugaguguuccaaucccucagaaacaggaacuuuaccucccauggacagagcccaguugaaaguucuaaauucaaauaaggaaaaguagacagaauauuaguauuuuacccuggcaagggggguuuacaucuaaaagguccccaaucucuauauuggcccuacacgucccucuucuuagagcuauuacgucuaaucuguccaacaguuuucagcuauacuauuuuuuucuuuuguuccgccucuccuccguuacuuuuuagagucuuaaaaaccuaaaccagcugggcgcgguggcucacgccuguaaucccagcacuuugggaggcugaggcggguggaucacgaagucaggagaucgagaccauccuggcuaacacagugaaaccucgucucuacuaaauauacaaaaauuagcuggacgugguggcgggcgccuguagucccagcuacucgggaggcugagacaggagaauggcaugaacccgggaggcggaccuugcagugaguugaguuugcgccacugcacuccagccugggcgacagagccagacuccaucucaaaaaaaacaaaaaacaaaacaaaacaaaaaaaacacaaaaaaaccuaaaccagugaaacucaucuugaaaucaucugaccaagaauagcagaaaaauuauauucagagaaacaacagaaaaagacaaaccuauuuuaaaaacccauacuuggaacuggaagccacaugagaaaaagcagagacccuuacaaacacaacucuaggggaggcuaaauccuacccuccaagguaaauggagacaaacaugguuacuucccagaacacugaaggauacaaccaauagcuauuucuauauaucccacuguuacaagauaggguacuuaaaagcagugggcugggaaggcacacagcaaagaucaaacuccaagaaaugcuccucugugaagcaacuugauccuuacucaaaaagagcauuguggccuccggagcagagaaauuuuugcagcaugaggugguagggauacuuccucucaucaaacagcauuggggaugugaaaccaacugaacagaugaagaaugucagccugaaaguggaaaaaaaggcaaaacuuuaaccuucuguaaagcagagacagaagcaauaggaaauucauguaaaaggcaagaguaaaauuuacacacugaagugacaccucccaccuacuaaagaauacaggaugaguaucccuaucagaaaauucaaaauguuccaaaaucugaaacuucugauugcugacgugacgcucaaaguacauguucaugggagcauuucagauuagagaugcucaacugauaaguauuccgcaaauauuccaaaacccaaaaaauuccaaaauucaaaacacuuucuggccccaagcauuuuggauaagggauacuaccuauauaagaccacugaaaugcaguuugacuguaaauacuuaaaauauuacccauguucuguacuagguacaaccaaaacaaguaacuuacacuucauuuucuagaguaaacaagggaccuccaaauucucaaauucaguggcucacacuccauuuuaaguaguauaggaacaacuuacauauuuuuuauuguaacuuucuagucccugaaucucaagcugaacuucaccugaaucggggaguagguguauauggugggggcugccaagauaaccccuuagucaagagcuuagugagagcugaggcuguugaucgcgcggcaggugucggugcuguaguggugcuggcagcaugauggcuccuucucuggcggacaggagaucccacacaaaguuuaacaagaaguccaaauagcucagcaagugcucggccuaaucuggaggaagcugaaacccagaaaucagaauaagacuguacaguauucucagaaugguuuaauuacaacagacauauuaccauuaacauauuuuuaugacucaccacuuccuccuacaaccccuaguuaacacuuggauuuguucuacauucaauaauccaaaaaggaagucccacaaggaacaaaugccacuuuugacgguaggagacagauauguggcacucaacagauaccaaauguaaaagacaaauaagcacucauacugcuagaggaacauaaauugaaaccauauuuaaguuaaaugauaucuaguggaugauaaagucacuuaaaaugccuacagaaaacuuuuaaaaugccaaaaaugauuagccacuuagauaagaaaagaucacugacaauauacauagucugaucacaacaaaaaauauguagucccagaggaaaaaauaaacuaggaaaagcaggaaaauuuuuacaaguagcuucuuaaggaauugggcagauuauggacaucucaaauuuuccauuucauaggaugcuuuucaauauauaauucaacaaggaaaaggcagcauacaaauauaaacauauguaaaagaaaacacaaaaaacugagugcuuuccagcuucucuuuaaauauuucauguguuuuuauauuucuacaaugaaauauacuuuuaaaaucauaaaugaaaauguugccauagcauuuuaaaaauaaacguuauuucacguuuuuucaugaaacguuauuucaugauccagagacaagaagggcuaggucugaaucaaaguacagcugacgcuugaucaacacagguuuucaacuauagaugccuacuuaugugugaauuuuuuuucaauagauauacugaaaauuuuggagauuggugacaauuugaaaaaacucucagaugaaacauguagccucaaaauauugaaaaauuaacaaaaaguuagguaugucauaaacgcauaaaauauauguagauacuagucuauuuuaucauuuacuaccauaaaauauacacaaauuauaaaaauuuaauauuuaucacacuuaugcacauacacuuauacacggugccauuugcaguaaauaagcaguauugaguaacuggauaaaauuuaguacauauuauacucuguaauaauuuuguagccacgaccugcugauacuguggugagcucaaguguugccacaaucugcuuaaaacacugugugaggcuaagcacuucuacaugaacaguucaucucuccaguaaauuguguagugaucucucaugguucucgcauuguuuuucauguuuaccgcaauacugaaaaccuggaauaaaccugggucacucuaugaccccauaugaagugucacuagugacguuggaagugcucccaagaagcagggaaaagucaugacacuucaagaaaaaguugaauuauuugauauggauugcagauugcccaccacuucaggaaaaaugaauucaguguaaagaccauuguaaaacaaacaaaaggaaauuagugaagcuguugcugcagcuacaccagcaggcuugaaaaccuugcacuuuugugaaaucuuuuuauuucauauugaaaaugcacguuuauguggguacaggauugccauaauaaagacaaaucuauagauucuaaugcaauucaagaaaauaaugaacucacuauaugaaaacuuaaagcaaaaggaaagugaaggaucuaaagcuggagaauguaaagccaguaaaggauaauuugauaauuuuagaaagagauuuggcuuaaagaaugucaagauaauaggagaagcagcuucugacaaccaaccaacaggcaacagauaaguucccagacaccacuaagaacaucauugagaaaggguaucugccugaaaggguuuuucauacagacaaaagugcccuacuuugaaggaaaaaaaaaaaaaggccacaaaggacguuuauuaguaaggaauagaagugagcagaaggauuuaaggcaggaagggacagacucacuccucuauuuugugcaaaugcuacuggguuuauaaucaggacugcccuuaccuauauagcuccuaacuuccgagccuugaaggagaaagauaaacuaccagcugcuggucuuuugguuguacaagaaggccugggcaacaagaccccuuuucuggauugguuccauugauguuuugucucugaagucagaaguaccuugcuaguaagggagugccuuuuaaaguucuuuugacauuagacaaugccucuggugacccagagccccaugaauucaacacaaaaggcacugaaguggucuacuugccccccaaaaccacaucucuaauucagccucuagaucagagagucauaaggggcuuuaaggcuauuacacacaguacucuaaggaaaggauuguuaaugcuguggaagagaacccugacagagggaacaucacgaaagucuggaaggauuacaccacugaagaugccaucauugucacagaaaaagccaucaagccugaaauaaauuccuguuggagaaaacuguccugauauugugcagaacuuaacaggauuuaugacagcgccaaucaaggaaaucacgaguuuguggauauagcaaaaaaaaggucaugggugaagaauuucaggauaugaaucucagugaaauucaagagcuaauaaacaccacaccagagcaaguaacagaagacgucuugauagagaugagugcuucugaaccgauaccagaugaugaggaagaagauguagaagcagugccaggaaccaaagugacauaagacaaucuggcagaggguucugauuacuaaagaauacuuuugacuuuuuaugauguggaccuuacuaugauaugggcaccgaaacuaaagcaaacgguggaagaaaaauugguauuguacagacacauuuuuagagaaaugaaaaagcaaccaagucagaaagaaaguacuguguauuuccacaaaguuacaccaugcauaccugccuuuccuucuaccuccuugaccuguucugccucugcuaucucagagacagcaagaccaacauccccccacuuccuuccuccuccucagcuacucaaugugaagaccacccagaugaagaccucuaugaugauccucuuaaugaauaguaaauauauuuuucucugaagauuuuaacauuuuccuuuaucuagcuuacuuuaagaauacaggauauaauacauauacaaaacguguguccaucgacuguuuauguuacugguaaggcuucuggucaauagauagcuauuaguaguuaaguuuuuggggagucaaacguuauacauggauuucugacuguguggaggaguugccucaacccccauguugcucaaggguuaaaucuaugucuuuucaggauauacaugcacauauaaacucaguguguaaaaauaggcucuacuugagccuagguuacauauccugcuaaaauuuaguaauaagcucaaauguauacaguauaggaacaaggaaaacaguccuuucuucuuccuauuacauccaaauuaagauuucuuuauccuaauuagggaauagucuacagauauggguauacccagacuuugaaaaccuaaugaauccaaucauuggguuuacacuuucucaccacugcuuucaggugaacagauagcaaagugcuuaaagguaguccaaagacaagaggauggcaaaaggccaguaaccaaagagaaacaguauauggacuggguucacacagaaaccucugaaugcuccaagaucaaagaaauaugacaaagcaaggagagagaaauaugaacaucuucuugcuuggucaauuuuccuuugaagguaauguugguagacuuucaaauuaaaauaaauggagaauuaaacuaauuaaaaguaaaauguaaaaugcaaugggaauuugagguaacaaauggaaacaccaaaggccauuuucuguuugcuuuuacgaagggccccagauuccucuaaguuaggucuccauuuuccucuauauuaaggugccagaaagugacgacaauuuacgaacacacaaauagguucccaaacauugguauuacauuaaaggggaaaaaaaagggcaaacagaccagugcaaaucauuaaugcaguuuuguaugcugccaauacagucucaauaaagcugccaaagugacuuuaauauaaaacaccuaucagacuaugucucuugccaguuauguucaaggaacacaaaaagagaagacuagguggaagagccagauaguuauccgagaaucaagauagcuuaauaacacaagcaccaaaggaagaauauuucuagauggagauggugggucaacuaccaugcugcagacaagugagaagggacuuaggacaaggacguuguagaugccuugcugagacaucucagugaaauggaaggagcagcaacaauaugcaauaguugaagaguaaguaggaggaagaaauuaaagaagggaggguaguagauauggcucucaggaagggauucugucaugucuguauccguagcagcuaguacaaagccugucacauagcagccacucaacaaaggacacuuaaaaaugagucacagaaguuuuaaacuuccuuaggugaaacaacauagccuuuccaacucaaucuguuucaagacuaagggacugaaagccagaaaagguaggagaaaggagaaugacucaccugauaacaaaggcuugauuugcuuaauucuggcagccauugcuggugugauuuuagauuugcccuuagagucugaagcaguagguucaucugucuccaugggagccaaugugucaccaucuagcccaaugccuucuaauaagcccuggguagaagcauccauacuuccagcugcuccauccuguuccccaucuacagauguauaagaggggagcaauaggacaauguagagccaacauuuaccugguuccuugagaaguacugacaagauuaccuaugguuuuuguuacucuuucaauucccauggcuuccuaaauuugaaaaacaaaaacacgacccaaauauuuuacugauaugcuccucuggaguucuaaguaccuaaugcugacaucuucaaaugacagcauaugaauaguauuaacccagggcuaccuuggaagacuguuguaggcacagcccaacccaggggguaccauucacauggacuacagugugcacaguacccaaugcugucaauguggaugcccuacuagaauguuauagcuuguuaaguucaaacuagacaucacagauuaccacuggacaauuuuauuuccuagcauuuaagaauuauguauaugaaugugacaugugucuuuuucuuugguauaugcuugcucuuagaucuaagaaugagcuuuaugcaaacuuauaaaacaagucaccaaguuguucucuuaacauuccagaaaaacuguggagaagcugagucguuuuuguuaaauguguuaaauugcuagaaaaaauauaucuguuagagaggcaauucuuugacagugaaucuaauuucauucucaguucuuagucaauuuauucuuucccugaguuaaauuuaguauguuuugacuaaauuugaaauucucauuuugucagguuucuuuauaguuuauuaauguuaucccaucccucacaauaaccagcugucauauguaaguccuuguuuguugguucuaagccuaugucagcuuuauuaguuccuuagaaauuucccuuucuaguaauuucuguacaaguuuuaagccugauaccuuuuuuuuuuuuuggagacagggucucgcucugucaucuaggcuugagugcagggguauacucauggcucaccauagccucaacuuccugggcucaagcgauccucccaccucagccucccuaguagcugggacuacaggcauguaccaccauggccggcuaauuuuuguauuuuuuuuguagagauagaguuucgucauguugcccaagcgggucucgaacuccugggcucaaacgauucaccugccucagccucccaaaguguugggauuagagacgugagccacugugccuggccugaugcauuuuuauacacagaauuaucuucauugcuuucuuaauaguuuauccuuuuuuauuuccucauugauacugaacaccagagaaaaaacauucuggaaaaguugcuuguauucauuuuagguuuguagcauuagagucagaaaauuguguaugauuucuacuuacugaaauuuggaauuuuuuuuuuuuuuuuuccugaggcgguguuucgcucuuguugcccaggcuggagugcaauggcgcgauuucggcucacugcaaccuccaccucccagguucaagcgauucuccugccucagccucccgaguagcugggauuauagguaugugccaccacgcccggcuaauuuuuuguguuuucaguagagacaggguuucuccauguucgucaggcuggucugaacuccugaccucaggugauccacccgccucagccucccaaagugcuaggauuacaggcgugagccaccgagcccggccaaaauuuggaauuuuuaucaugagauaauauaaaagcaaucuucuuuauaaaacagcacugucgauagaaauauaacaugaaacacauauauaauuuaaauuuucuaguagccacauuaaaaaguauuuguuaauacccucugauacaguaauuucuaggaaucaauuuuacauuuguagaaaaguagauacaaaaauguucauuuuuuaaaaauagcauauuagaaacuuaacagggaauaguuaauucguguaccuuuauaugguaccuaacauuaagugaagaaagagaucuacgaaauguuuuuaucuaagacacuggcaaauguauucagagaaaaaagacgggcagacacuuccaaaauguuuuuuuuuuuuuuuugguggcagaaauacggguaauucuuucaacuacauuuucuaaauuuuaccauuauguauauauguuuuuauggaagaaaugacuaaaaauuagugagaggaugaaaacuagacuauggaugauagaacuaacuaaaaauuuucauaauaaaccuauaaagacguaggaacaaaacuuagaaguaaugacuaacauuuuaguuucuuagaguuaccugaucuuuuuccgcccugggucguaccugccuucucauccuuuggaaccaguuucugcauaucugccuggccaaauucacacccagaugguaggcugcaaaaagagaaaugcugagcaaaagaaauauauauauauauauacugauaauucaccucuuauauuguaaauggucucuaauuugcuuggcugacacuaucccuccuauagcaggcagguuaaacugaauguaauaaagcaucuauaauuccugagguagcaccccacaagcuuuccaauucuuuuuuuuuucuuuuuuuuuuuuuggagacccagucucacucuuucgccugggcuggagugcaguggcaugaucuugggcucacugcaaccuccaccuccgggguucaagcaauucuccugccucagccucccaaauagcugggauuacaggcgcccgccauuacgcccagcuaauuuuuuguauuuuuaguagagaugggguuucaccauguuggccaggcuggucucgaacaccugaccucuugauuugccuaccuuggccucccaaagugcugagauuacaggcgugagccaccguguccagccacaacucaauuuuuuguaucuggcuaauaacaggaacacauuuuaaacaucuaccaugacgacaaagcauuugucaucaaguuccuaggcugggaagagggaaggacaaggaggccucugaacucucuuccauacccuccuauccccaaccaaagcaauccuccaggcucaccgaacuuagauaacaaaguaauaagagagagagccauucucuuaccuguuugggguacacagagagaggaggacagugcuuucccacaccagggaacaguauaacuggcucagcuugcucaaaacacucagacccaauugagagccccacugguuuacggagauggaacgaauuucacucugcaaucauaacaagaauuucaccuuugggauguucucugaacaauuauacuuaaaaaaaaaaauugaccuucaacaguuuuauaaggguaagggauuuuucuucauugcuauucucagaguuauccaccucaucaaaauguccacacucaagacgacaguuccacaagguauccucuuacaauauuuacaaacuauuuccacaacauccguucucauuguuuuuuauaaagugaaagaaaggcaucagaggcuacucuuuuuuucugaaucaaagaaaugguuuuacagguucauuaacuacuuucuaaauuauuugguagggguauuauuauuuccauucaauuucuuuacuucaguaaguaccuagauuuauuuaauuccuugaauguuucauuuucauuuuauuucauuuaauaaagaagucauaaaaaucaaucccuaagcuuuguuaaguaauuuaauuuucuaaauccuuuauacuugugcuuuuuuaaacuucagauuugauugauucacaauuaacagagaacacacuccugcucaauagcauaaaacagggcuguugaacccuguuuuguuuaauguugauaccauaaaucuuuagaaucaauuaucugaggaauaaauguaguaaaacugugaggacauacacaaaaugccuucuuucuggaacuauggauuauggauuacaggucaaacguuugauauguagaaaauuuuuaguaauuuguuaauuacuauugauuuaaauguucuuugguaaaauguccuaccuaugccaucccauuaucagaccuauaaggacugguggaaagauuagaaaguacuaaggccagaugaauacccaauugauguuugucuguaauaacauguuucgcucucaagaaaguccacuucaucacauaauaaguuauauagucacucaacuuuuugacagucaaaaaaaucucauccuaaauuggacuguucuuuuagcugcuaccucaggcagaccuccuuucaagcauaguaacccugcuagguguaugcccuagauauuucacugccuuuaaauuaauauguucaccccuaagguuauuuuuaccuguccaacucugcaaguaugaacaaacaucaugauguaggcaugggcagcagugagugcaugcagcagagguguggccugggcugagaggguagcaucagcaacauugccugcgcaagccaguucucgcaacaacacugagcccccaggggauucaauggggcgguguaagggcuccagggaggagaggauggaguccaacugaaggagacccucuugaaggacuuuggguucaugugacagugucugaaacaggaagaauaauuaaaguguuaauauacaaugaacuucaaauucaucaugucuuuuaauagucacaauggaagugacaauuaaauggaagccucucagauuuuggauauggccauggucucucaccugguaaaugguggaacccaaauaugaagucagguacaacauaccuuaacaucucuuucuagagcaacacacuacuuucaaacuuggugagccaauaacacuuaaaagcuuaugauggucaaacugaauacuguuacggcaaggauucuacacuauaggauuaauuccaaauuuugcucgauaggaaacaauguuaggcaaaguuccaaagcauggaagugagucacuauuacacuguucuuuucuucuuaaaacaaaagcgauuauucugagauaggaaucagguaggcaauuuguuuuuaucagacaacccaaggauuauacgacccuugugauuuccucucaagucuggagaaaaaucugacaauaaaacaccaucacuugccaugcaaagauaggagaaaucaugugccuuccuauggcuuuaaauaaaucuaucuauccuuccacagcaucuuauaggauauuuuccccucucugugaugaagagcauuuaauucaauauuucaaagaguaaaacaaaauaaacuaaaugaagucacgucacaauuauggaucuuuccaagucuguaagcaaauggauuucucauucagcaggaauuacuuaucacucugcagcccagcuaacaaaggaguuucacagauuuaaugcaaucacuaucaaaauuccaaugcuguuuuuuguuuugguuuugcagaaauagaaaaaucccuucuaaaauuuauaugaaaucuuaagggaccccaaauagccaaaacaaguuggggaaaaauuuuuggaggucucacucuuuuugauuucuauuacaaaguuacagugaucaaaacugugauacuggcauaaagacagacguaaagaccaauggaauagaauagagagcccagaauuaaaucuucacauauauauggucaaaugauuuuugacaaagguaccaagaccaugcaauaggaaaggacagacuuuuaccauauaaaaaaucuaaucaaaauggauuaaagaccugaauauaagagcuaaguuauaaaacuccuagaagaagccacagugggaaagcugcaaaacaucggauuuggcaaugguuuuguggacacgacaccaaaaacacagguguuuacacaggcaacaaaaacaaaaaaagagaagcugaacuuuaucaagauuaaaaauguuugugaauccaaagacaaccaagaaaaggcaacucacagaacaggaaaaauauaugcaaaucauauaccugagaagaaauuaguaucagguauuaauacguguacaagaauacacaacucuuacaacucaacaaaacaaauaacacgauuaaaaaagaacaaugaauuugaauagacauuucuacaaagaagauauauacauggauaacaagcacaugaaaagauguucauuaucacuaugcauuagggaaaugccagugaaaaacaaaaugagauacacuuccuacccaccagaauggcuauuaucaaaaaacagaaaauaaguauuggcuaggaugugggaaaauuagaauuaaaaguagagucucaaagaguuacauguacauccauguucacagcaucauuauuauucacaacagccaaaaggagaaagcaacccaagugucaaucaacagaugaauggauaaacaaaaugugguauauacacacaauggaauauuauuaggccuuacaagggaaggaaauuaugacacaugcuacauaaugguugaaccuugagggcauuaugcuaagugaaaaaagccggucgcacauacaaaauauuuuaugaucccacuuauauaagguaccuagaguagucaaauuuagagacaaaaaauagaaugguaguugccaaggucuggggagaggggaggaugagaaguucaauggcagaauuucauuuuugcaagaugaaaagaguucuggagauuggcugcacaucaauaugaauacacauaacacuacugaacucuacacuucaaaaugguuaagaugauacauuucauguuauguguaguuuaccacuaugaaaaaauaaagaagcuucauuuuuggcaaaauaugagcaaugaacuaccaugucaauuaugcuuaaaauacaugacuaucgggcuugaaaaggggggaauuaaguaucggcaaugaacuacaugucaauuaugcuuaaaauacaugacuaccaagcuugaaaggggaggaaaauacaugguuaaacauaaccauaaacauaaaauguguuuaaaaugcaccuauaacaaagaagggagagguacuaauaaaacccaacuagaaaagcuuucuuggagauacacuuuucccuccaauaaacucuaaugauguagaacuacauacccaaccgaugaacaaagaaaaaauacuuugacuuuucaaugagaaauaacauggcacacuauauauuagucacaaaauucacuuauacaacauaacacaaauuuauucauuauuuuuuaguugaagggagaccauaguaaaaacauauauacagaaguaucgcaaaauugauuuccagaaagaaaugaaaacauuuggccagaugcuucuuaccaauauggauuugcagacaccugcaacagccugacaggcagcagaugugggaaagucaaugggcagauugggaagacccaaaaugguaaccaaaggcaacaguccuuucugauucacaaauuccuggcaguggucaucuguuguauuguugcucagaauagauuccacaaauuucaucuagguaauaaaaauuuuuuaaagaaguuagagccugacagguggaacuaaauggccagccuggaauaaggaugggguagccuucuagucaugauauuaguguuuucuauagaguaucaaaaccucagauaaaccagauguaugauacggauucuaaaacauccaggaaguaaagaauaucuacaauuucugcccaaucuccauuuucaagcacaccaagaaucagauauuucgagauaacagagaaguuaagugacuugcucagggccacauuaugaauuagugguacaaucauguuuaaucucuuaauuugcuauuuagugcuccuugccuaccucucuccugcaggcaaacaucauggaaaauuucccccaaaugugcuuauaaugcaaaugaaacgcauaaugcaaaugaaacacugaacucuggaagaguuuguuucaaacaaagaauuuuuuuaagaguaaaaaaguaaaaugugggcaauaaacacacaggcacaagacaaacuaucucuggaagucuuggaagugauuaguaggcugaaacaaaugcuaagaggucucucccuuauugguaaacaauucugggaaaauucaaacucuucacuuuuuuggugagauacccaggaaguaaugggaaaaaagggggaaaauauauguuggacacauuuggaaaacauauuacagguuguauauuucauauucgaaaugcuugggcaccaugaguguuucagauuuuuauuuuugaauauuugcauuauacaguacaggcugaaaaugcuccagugagcauuucccuucaguguuauguugguacucaaaaagguucaaauuuuggagcauuuuggauuugggaugaucagccuguacuagacuggcaaaacaaaaccuguuacagauuccugucuggauucuaauggagaaugguaacagugaacaaaaaaaucuggaauacaaaauaauggggcuuguguuggcuaauuucuggcaaaccagucuagaacaaaaacaaaaggguggcacaucuuuccccucuuaauuggauuccaauuaaaaugaauacgguaauuacuggacucugauaacgaaacacauuuuccagaaaagcacauauacaucuuuacucaguuugcccuguguugaaucuuaccacauuaaggauguaauccaugaggggaauaggaauacguuccucuguaccaacaacccuguuaggggagaaaagagugaguuacacagaaauucacaauaccaauauuaagagaacagaggaggaggcacuguauaaaauucuaggccuuuuucuauuuauuuauuuauuugcuuauuuuuuugagacagggucuugcugucacccaggcuggagugcaguggcacaaucauggcucacugcagccuuugcuucccaggcuuaugggguagagaugagccuuuagacucauauaccgcaggaaaaaaacagcugaaaucaauccugaaucuaccuuuccaagccugaccaagguugaaagcauaaaggggacaaccaagccuuuaaaaacucaacauuaguauacaucacaagagaagcuauccuaucuuuggcaaacuacuguuagggaaauuuauccacaugagaacacuaaaaauaaguucaauuaaaagacucaacauuugcuugaagaaagaggcuagacaaagaaacacuuaaacaucauacgauguuuuugcaucacguuuaaaguuauggagaguaggaaauacaauuuaauuuaguucaaagauucauacaccugaggucucccuucccuaacaauugguauuugcagcaugacaguuccugaacuaucaaaaaacugaucaggucuuuugucuuuucaguugcuucaauauugcacagcagaugagaaggcuacaacaugccacagcugcagaaaaugcagcucaaugcaaaaaacuacacauauaguauauugugaugaaucaaaauauaccucuaagauaaaccccaggaaggaacaaauacuuuagaaaauggaguauuuuggacacaggcccuugaaacagauuugggcacagggugcaggagagcgggauggggcagagacagagggagagguagaggaagaagacaagaaaguuggcaagaagcuaguaguucucaucuuugagcaagacaaaauguaaacaaagauuugccaggcacaagaacauuuggcagcagaauauagaacaggaaaagagaguggagaggcauuaugaaugacuucagugacaaaaauacccagaaccagguuuggguaggauguugugaaccuccucaaugaaaaauguggggaagaacuuuguagaaagggaguauaccuauaaggcaagacugaaaugauuccaugagaagaccacaaaccuuucuuuaaguuccuccucagaaccacugcagcauuccauguuacuuauaucaauuaccuauauagauccaccucuaucgauaaggagugcagguguggaucccgcccagagacacccaacccuuugaagaagccagauauaauggcaaagagccuaaguaguaaaaucaaaugagaccuauaugcccccuucauuugcuacauggaaacuggggagaagaacagagagaaagcaaaccaauagugguucuuaauauaauuucaggaauaaauuuguucaguaaccacuuuucuccuuccccucaucuuuuggcucucaggcccaagaagccauacaggaauaaucaaaaugaucaacucuuuccaacaggacucaacuuaccaacugauuucaagaaaaguccuucuaaacuuccugucucucucccuuuccccaaacauacacacauucccaaacucuggucaauuuucaguauuuauggugguggagccccagcucaugcccccaucaaaaguaaaggaggauaucaauuuagugucauaguaugauguauaugggguuuuuugggauggggggauggucaggugcuuccuccagcuuuugaggagacagcugacucugacaaaggagcccucccagugggccacauuucagggaacaacugcgucucugcacucauugccuuuaaauuccagacaauugcuauucaaguucuaaagaugacaaagacuuuauauaguccauuucuuucaagcugcucaugaguggugggugguaagcuaggcacacuaaugcaaucaaccacaaagugaaccgugaugcaccaacuacaaacccugguuacuuaacugcuaaguauauucauccccagcaauaucagauuuucugagaucaaacaauucagaaggcagaagaaagggggcaaaagacagguauuuagaacuacuuguggugagugagucugaguguagaaaggcaccccacguaccuggcguagacuauagugccuaaguuuccuuacuccaaaucuccagcacaaaaccauguauuucaagaguaaauacaaacaccauuugcaaauacuagcugcugauuuuguaaaaaaaaaaaaaaaaaaaaagaaaggguagugucuaagccuggaaaaaacucagaaacccaaguccaucaacaggaaaauggauaaucacuauacaauuaucacauaacagaauacuacucagcaaugaaaaguaacaaguugcugacagaugcaauaacauggaugaaccuccaaaacacaucaaacaaagaagcuagauacaagaagguauauacgucagauauaauauacacauaagacuuuauauggucauuuuauuuaaacauauucuggaauagacauaauaauaugaugacagaaguaagaugaguaacagucucaauuuugggcagggaaacuggaaauguaaaaucuguauggaaaucauaccugaauuuaaacugcugauaaauuggccaggugcggcggugcacaccuguaaucccaacacuuugggaggccgaaguggguggaucacaugaggccaggaguuugaggccaacauggcaaaaccccaucucuacuaaaaauacaaaaauuagcaaggcaugguggcacgugucuguaaucccagcuacucaggaggcuaaggaccgagaacugcuugaacucgggaggcggagguugcagugagcugagcucgugccucugcacuccagccugggugauguagugagacucugucucaaaaaaaaaaaaauaaauaaauaaaauaaaauaaagauaaaaguuaaucauuuuauguguguauaaggcauuggaaaacaaaugagagcaugggaaacagaaauucggaagaacuauggauauggaggaagggaugggcaagacuucuggggagaagggugacacauauuccaaaucuuucuaagcccuuucaccauauugugagaaaguacacaauuccccuauaacaauugccugggauagaagauaaaaagaacuuuugcuguuaauauauugugguuuucaaaaugaagcuaaguuuagacagucucuugcuuuuucuuccuucccuaauaauuuacuuagugacccaaucuaggccucugaagauggcaaaagugaaaaaauguaugugucaacaucugugagacuccuggauuauccaaaugaggcagugaugagcauccagaauguagaaaacuacugauacugggguacaguaacuacuagaguccucugcaucuuagaaguuacauauaacuaucacugugguagaauauuaaugcuacuggguuuauauuucuaauuucucuucauuuucauucaugucucauuaggccuagcucucuaagcauuuaagacuucaggaauccuucauuuaaggcucuuuauucauuucaauaaacaaaccuacugacuaccuacuauauacaaagugauagggauacacuggugaaugaggcaaugucuugcucuugaggagcuuauaggugagugaggaaaaccauuaacauguaugaauaauuuuaacaaaacuguugggagaacacaagauugaguucucauuuggagguaaaaaaccaaccaaccaaccaaccaaccuaccuccuucaagaauaagacauuugaacuagccuuacagaaaucugguggauguaaaaggaggugaugugggaauggggauggcuguggauagaacacagugauacaugauagcccaagaaaggaaaggaggguaagcaaaugaggguagugugcugauuaacugugucagcuugaaaucugggcacaucagauguaaggcaucuggaaaauauccagguagggacgucacaugcagaugaauauauaugagcuugaauuaaaaccaccaccaccuacaccuuaaaauuuuuccuuauuuguagccaggaaaaggaaccccacacuccaguagggucacugacauucaagggugugacaaaggaagcacuaagacucgucuacaaaaaaaagucgugcuuuuuuccaggguguccuccucuucuagaaaaagaacauuuaaaagagaacaaaagauacugcuagaaugaagauagguuugccuucucagacaggguaagguaucuguucaacaaagcaauauacuuaguaguuaaugccucuccuuaaaacacuugacacccacaggcucaucacuauuuagaguuccaagaggacauaccaguuucggauucuaggccuuugcuccuguugucaacuccaccuuaaauuuuaagucccaaggugccauucaggaccagcucaaaugcauucauagcugugccuaaaaugcucaagcuuuucucagaaugacuuaccuacacacuaaaagaccacuuauuauaugagggagugcaggacuguccagaaagaucaaucccauuuucagcaugcaggugacuaaaaguuacagguauacaguuacaguucaucccugguaugugaauacugcucaaagagccugguggacuacccccuaccaaucacuaagccuuuaagcaaacucccugcuuccaucuaagcagucaauucuugacuauuuacagucauauaguaaauuccaaagccuucuacuaauuaaucuggaacgaacagauaguaacaaaaugaacaaaaauaaaaaaacaacaagcaacaacaaaucuucacacaccccuuaaggacuucuuaggagacaggcuucaaaaguacauuguuuuucacacgugccugaaaaaaaucaagcagucgauguggaauaucaaaucaacaaagggaaaauaaggucucugugcaaaguccauuaacuugauggaccaaauucugauucaauuucaucaacagcuuuuaagaaugagcacuuccuggccggaugcgguagcucacgccuguaauccuaacacuuugggaagccgagguggguagaucaccugacgucgggaguuugagauuagccuggucaacauggugaaaccccaucucuacuaaaaauacaaaaauuagccaaguguggugguaggugucuguaaucccagcuacuugggaggcugaggcaggagaacugcuugagcccaggagguggagguugcaaugagccgagaccacaucauugcacuccagcaugggcaacgagagcaaaacucucucucaaaaaaaucaauaaaaauuaaaaauuaauuaauuuuuuuaaaaaaagaucacuuccuaaggcaaccaauacaauuaaauaccaaagcacaaaugacacacaagggucaaaaaaggaaaaacuaauacauucuuagaaccgguuagaacuuuaaaaugaucuaauacaacucucuugcuuuuuauagaugaaaguguucauuaagacuuagagaggugauaacaugcccacgauuauauggcuagaugaucuguucuguaaacacuuacugcugauuaggcucaguuucauuuugcuggguagaauuaaagcucugcauggccuguacuuccucuuccuccucauccucacuagaggcuucuucugcggcaugauuagaccuugggggaggagcaguggcagugccaucugccuucuggauugauggcuucugacagauguauuuggggucccuuccaagauuacagauuucuucaaguaacugaaaggcacaggaaauaagauuacuuauuaguaaucauggaauggggaggaggagacagcuaacauauuuagagcguuuucuauguguuguguauuugcccaaacacuuuguauacauguuauauacauaauucccagaauauggucauuaauuacauuuuauaaacaagggaauagaagugcugcaaacuuaaauaauuuguugagcgucacacggcuguauaagugacugacgaaccugacucccugucccaauucaccaagcaccaggaacuuauauaccaauuucaacaacaauucuaaaaggaaacuggcagagcuaauaaggcggggguggggggcagccacagggaucaacaaacggagacuagaaaggguaauaugcuuuacaaacuuaaucuaagccaugucugcuuguccauauaauauauaaaagaaaucauuauauacagguuacauuaaauggaaaaaaauuuuuaaggaaaacaauucucaaucuaaaauacuuuuuuuuuuuuuggagacagagucuugcaguggcaugaucuuggcucacuacaaccuccgccucccgaguucaagugauucuccugccucagccuccagaguagcugggacuacaggcacacgccaccaaacccggcuaacuuuuguauuuuucauagaaacggggcuucaccauguuguccaggcuggucucaaacuccuggccucaagcgauccaccagccucagccucccaaagugccaggauuacaggcgugagccacugcacccaggcuaaaaaaauuuuaacagagacuucuuucuaagaugaacuaaaaugacaacaucuuuuuauaaaggaccaaccuaaggacauggaaacaaugaggcagacauaaugcucuuacagcuauagcccaagaauccuaaugaccucuaguaggccaaucuucuaaaaccuuccccuucucugcucucucaugcucauggucacauccuuaucacuuucuaccuugaugauggcagucguugcaucuguuuuaagggugggcugaugucucaugagcucaucgacagcacuccccagguuggaugcaguauccccuuaaggcaaaaaaugaacuguuagaauuagaaagacugaagaaaauagagcuugggcucuuuucuguaccaacauauaaaguggaaagaagaaacugagccugguuaugauuuucuuuccuuuaaagacuuuaugucacccagacuggagugcagugucacgaucuccuggacucaagcgauccucccaccucagcccuccaaguagcugggacuacaggugugcgccuccgugacuggagaaauuuuuuuuuugguagagaugggguuuggccauguugcccaggcuggucucaaacuccugagcucaagugaucugcccaccuuggccucccaaaaugguaggugugugccacugugccaggccaggcuguugugauauuuuuuuccuauuuuuuuuuuuugguugugauuuucuaaugccacaacuucuuuaaugaauuuacacccagccccuauccccccaaaucacuagggaaaaggaaggaaucaguuuaguaaacuauuuuaaaguaacuaugugugcugcacucuacucuggcaaucuuugcugucaagaucuaaacuaguauuacagagugagagagaagaaagauguacaaaccauuaacccucuggcugcuccaguuaagaaugauagugucuaaaugcuacaguggugguugaaaaguacaaagcacauuuuugaaaacuguaaucuuucuggagcccuaccuuuuugcuaauaaucucucaauuaucuggucucaaguauacugaguaaaaaaaaaauauccaugugucguuaucuuagagaguuggacaucagaacacuagauuaccagaugaacaccucaggacuccauauuucucauugcugcagaccagauggugaaccuggaaaucuaccacugcuucuuaauaccuauuuucuaccaguaccaugaaaguacaauggugaacuguugagaagcauggaaauauuaugagcagagaagcugaaguauuccuucugaaguauaauagaauguaugaugauaauucccauuaaacuuagcacaccuaaccaguaaaacgaugagagagaugaucaaggaagaguuuccuugcaaacuaaaucaauuuucuacuauaaaauaaaucuuaacaacuuaccaaggggaucagaacuucuccuccuccgcauggcugggagguaaucuggagacagaagaacuuugaagaggcguucaaaaggcugacacugaacaaaagacugaagaccucgggcauucaaacagagugcacugaauacauuugggagggagccaaggacuucacggguagcaggaaccuaaagagaaaacaaagugagcuugaaugcaucuaaaagaguguagaugcuaggaaaauccggccauggguaucaagcugagauagaaggaauuuugacaaccaggucccaauuagauucaacacuacacacagaagagauaggauuuucacgcccuaagacauucuuuacagaguagcagaaaagacuuacaucuuugauaagcagugcaugcagcaugacaucugucaauccauuguccuggagugaggagagcagugaugguucuugaaauacaaacacagucaccacuucaguagcuaaaaaaagaugagaaaauauggaaaacugagagauuccucacagaaacugaaaacaaaacaccaaaagcuuaaaaaaaaauacauacucaaugucuagcaauuuaaacccuugugcuuacuaugaaauuaaagauccuaauacugcuccaucagagauucaauacuauaaagaaucuagugacuacacuuacaggauuuuuaugggcauauuuuuacauaaaugagguuacacuguuuuauauauuuugcuuuucccccacaacugucauaccguauaauguccucucccgacacaacgacccauucauuuugaauggcugccuacuauuccacuaaaugcauguaccacauguauaaaaaccaguccucaauugugaaaaugauaaaccuaaacauauauccguuuuugucugcuuuuaacaggaaaaaaaaucuaugaugugggcuugcuggguuaaagcaaaugcaagcuuuacugaugaaaauagauaaacugccucauacaaagguuauucaacaauuuuaaacuaucaccagcaaugcaagaguccuugaauauuaaucugaucaguuuuugacauuauaauauuuuaaaaugugcaguaauaacuaccaaagcuucuggaacaugggaaaaacucuacucaagaggaaauaguacagcauuaaaguauuuauuaaaaaguaaccaaacaagcuaugaagaauuaacagaaaaaagaauucagugaaaacgaaagcaaaaaggauaaacgaagccaauaucuagcuuugugaagacacuggaaaagcuuauaaaccuauagaaaauagagcaauaauauaaauuagaaacaagagcaguaauauacauuaggaaugagaaaggagauuuaacuagauacagaaaaaaaaaauuuauucuacaaaguguaugccaacaagugaaauaauauaaauuagaaaaaagagcaguaauauacguuaugaaugagaaaggagauuuaacuagauacagaaaaauauauucuacaaacuauaugccaacaagugaaauguauaguuuaauaagaaaaugucauaaaaaucaaaucucaggaagugacagcaaagcagacuagaccaguaagaauuuucuuuuuuuuuuuuuuuuuuagacggagucucacucugucgcccaggcuggaguacaguggugcaaucucggcucacugcagccuccaccuccuggguucaagcaauucuucugccucagccucccaaguaguugggauuacaggcacccaacacgccuggcugauuuuuccauuuuuaguagagaugggguuuuuaccagauuggccaggcuggucucgaacuccuaaccucaggugaucugcccgccucagucucccaaaguacugggauuauaggcgugagccaccgugcccguuccagaauuuuuaaaaggggaaaaaaaaaaaaaauccagguaauagagaggcaccaagccaauaguuuuauuaaaccuucuaggaauaauuaagacaaagcuucccaacucauaagacuacaauaacuacaauaacuuuaauuaaaaaaccugaugaagaggaauauacauacaacacccauaaaccauguauacagaacaaacuuguuuauggugaugccuaagaucuaaaagaaaccagaggauuuucuauucaagauggugaauacagcaucucuccuuuaucccaaaugcuaggggaauggcagauauauagcaguuaccggggaccaacaguuuucaauggccuuugggauuccucaugggcuauaaacuucugaaaaauuuaaguccuuuuugggguuccuauugguaugacacuccccucgauugacuuacauuuguagaaauguaugaauucuauagaguuacuaaaauugaguauuuaaaaacuaaaauuaguguucuacaagcaauuacuaagacaucaaaccuguuauuuuaucaagaagucgcaacgacacuaugcacugggaccccuauacaaaaacacugauaaccaagaauuagaauuaaaggguauauacacgcacagagcaaccagcuguguguggaaccaagcaacuaagaaauggaaaaaagguaauuaggguuuccaggagaaaguuaaaaggaaucagagaaauagaagaaaaaaaaaaaaaaaaaaaaaggcagaagcaggaacuauauacagauaagaacaagaaccagugugacaccaugguuaucuacaauaauguagcauuagaauacaaugaagaaaacagccaccaacuucugaaagagaagucugacaccuuaaaaauuacccacagauguacuucaauagaacugaaaaugaauccaacagaguuuggaaagucaagguuacagagaagagaguaaaggaaggcagaaggucaucacagucccugggcccaaaugccauugcauccccaugccacuagcccuacucaaacccuagccucccaauauguucuuugugcccugucgugccaucggcaucaucaccagugggggcucaccauaccagagguaaacacuccuuuucucacuggcaaaucaauuuuauugggccacugccccaaucugcuggcacaaaucgcuaugcccucacaacugauuguuauacagacccauucuuggcuuauccuuccugcccaacuacugccaacaccaccacuauuauagcccucaguuaguucccuuugggcuucugguaacaccgacucugaccaggguacguacguuaccgcucauucagucugggcaugggccuuuucaaacaaggcaucaccuuggagcuuccauuugucuuuuuuuuuuuuuuuugagacaaggucucacucuguuccccaggcuagagugcaggggugcaauuauagcucacuacagccucaaccuccaguacuuaagugauccucccaccucagcuuccugaguagcgcaccagcaugcccugcaaacauuuuuauuuguuguagagacaggauuucaccauguugcccaggcuggucucaaacuccugggcucaaggcucaagcaaucugccugucucagcaucccaaaaugcugggauuacaggugugagccagugccuggcccaucuguuguacuguucacagaaagcaggccuaauagaggcauaauggcuuguucaaugcucucuuaaacuuacuaaauggacaauggucucuuaaauugaucucucuuuugccgauugccuuaguuguaugacaucugaaaaaacacaauuagugcuuccuuuguccccuuucuagccucaaaaugagauacuuuccaucuaugagucuauaauacccaaacagaaucccccucacuuaacgacaccuccucauuugauauuggugcgauccacgguggacaggagccuagguugaaaguagguaacaggaugggacccacagaaaauugagggcccucacccucuaagacuaugcagaaggucucugccaaaguccuuuccuaauaugaugguuuuaaaggacugcuaacuggagaucccucuucauaggaaaugaaggucuuagucucucugccuggguugacauacacaacuguaugguucuuccaaagaggaaagaaaaaucuuaaguuaguuccuaguaccaacauucuuagacaggaagccaguucuggaaccaccuuauuacagagguauugaaugggagacuauugcaggauaugggauggcaaugccugugauucccauaauaaacuggcacuucggcaugccaaaagucuacgcaccacaggccugaaaauaucuuuguggaauauucuggcucuaguuggccugucuauaccucauuuggcucauggucugggucugggauacuacuaccccagcucaaugccaaacuucuugggcuccuuuuugcccaugcugugaucccacuuguuuagggguaaucagugcauagcuucccuaucugaaauuauucuaaaacucuuguaggcaaagggauacugaguuacuuuuauaauaauuucucaagugcgagccuagggcuucuauccauccagcauaccaaagcauccuagaugaugauuucaguacaacugacagucccagccuugacgcuaacacccucaagaugguaacugcccuuguaacugcccccacauaacucaucauaacuccacugccccaucaacucuuugacagcccacacuccacuuucacuauuuacacucuaauuucacuauuccagucacuaccuauauuuccugcuuccccucacucaaccugauagauuguaucuauguauuaguaacagagaaugccaccuacauacuaaaccuccagcaauacuaacagauacccuagcccaggcaacuacucauacaacuauaucuugcucccuuggaggauuucaauacucauauugacaacuugcuacacucucugguuaaguggucaaucauaagcaugaugacauuagcauaggcuacaaacagacccgaacagauaacaugagggguaaggcaggaggugagaaagaagagaggggaguuggggaaguuaaaugggauacuacaaaugaaauacagguggcuaaaaguggcauagaagagccagaggucggacacgugagggagaaggagucagaauauuuaguggguuugagugugaaauuauaagcaggacaucgugaccucacugggugcuuccauauuaaacuucccccuuaaggauuucaugucuuucccagccucugccaccaacugauaguacauacaaugaugccccccuguugagaauguccacccugauauaaguuugcccccuagaaacuccaacuuccaaccucuugggcuacugauucuucuguguuacaacuccugcucagcaggguuauacauuuuauucagcgauccuguucccuucuacccauacaagcugaccuauguacuauggacauuuagugcccagggcaccucaaauucaacuagaaagucuagcuguuuuaucaagucuugccacaaaaaggagcacuuuuuaccuauucugggccucaucagaaucuuugguguaacgggcacaaguuuagguauuuccaauucuguaacacagacucaacucauagagguuaccgagacauguuguaacuccugacagaccacauuaaccaaacaguucaggccuaagaagcccucaaugagggacaaagcaguuuaguuacuaugauaguugauaacagacuggcaugaaacuaccuacuggcauuucaagauagugcuugugccuuaaagggacuuccuguugcaugaucauuaauaaagaaaagguauccagaauaguucaacaaaaauaaacccaaacugccaauuauauuauuaaaauacuccaagagguucucagaacucccugaugucuuuccugggccaucuccuuccaccuggagugaaaggcucuguacuaucauuuggggagcuaaaauaacaauggcuagucuaauuauuuagguuucgcuuugcaaauuuguucucucucaaguacaaguguauuuuaugggaaaacugggagguugcuaugcuaauuuaaaugugagggaugaauuaagaaaaccauagggaaggaaguuggaccuucacugaccuuugauuuagugcucuaagucucauuuccugcccgugucccucacuucuggcaucauccucauagggcucaccugcuccucaccacuaucccagcaccuaagcacuauauccucuugcugccucccucuuuuaaacaauaucccugucaauggcaauugcuccuucuucuaagcuucccauuuauagaaaaaugccuguguauccuuuucucuuucucucuguucuggacuuucucccagaagacgggcauucucccugccccuggccuugagacguccccaccguaaaacaaaucuuaaaaaaaaacaaaaaaaccccaaagaacuauugucugaauuuugccaucugaacauaaccuuagcagagagcuuuuccauagcaugguagaguugcuacaccacaagaagacuuccucaaccugacaaaauugacaaaaccuucaacacaaaaccucugcuaacuucauucuuaauggugaaauauuaaaugcuuuucccucuaaauucaggaacaaagcaaagaggcccauucuuauuucuauccagcacuguaucagaaaucuuugcuaaugucauaagacaaaaaaaaaggcacaaagaccauaaacaaaguaaaaaugcauuugcagaugacaagauuauguagaauauucuaagaaaacaaaacaaguauguacuaauaagugaacugugcaagauuaaaagauacaagguuaauauacaaaaauccuaaauuucuucagcaagggggcaaggaaguaucuaaguuguaguagccaaaacuagucuccccaacaccccaaacuguaaaacacaaugcuugcuacuacaaggagacuuucccuauuuccacgucuccuacuaaauuccuuuagcguuuuaagaauucuagcacagauaaacaaaauguaugauaauguuacuuacuacaaauguacuacuuaucgaagguauauucagcacccagaaaauagguauuuacuuaaaacugaauucugaccuuuauuucaucaccaauaagacagauaucuacccggccucucuguuuuauauccuugcaggauuuuacuauugacauuugucuacuguccagguagacaguagagaugggguuuugccauguuggccaggcuggucucaaacucauuaccucaggugaucuacccgccucggccucccaaagugcugggauuacaggcaggagcuuccaugcccggccucucuguguuuuauauccuugcaggauuuuacuauucauauuugucuacuaaaaauacaaaaauuagccaggcaugguggcaggcaccucuaaucccagcuacucgggaggcugaggcaggagacucgcuuuaacccgggaggcagagguuguagugagccaagauugcgccacuacauuccagccugggcaauagagugagacucugucucaaaaauaaauaaguaaauaaguaaguaaguaaauacagagagagagagcucugccagguuaucccaaauuguuauaaccaacuaucaacuccacuuaccuaggaggaagagugaugggccauaguauucugcauugcugaugauguguuucagggagguaggcagagaaccauccaucacuaaaagaaaagugaacauuauggagaauacgaauagucuggaaaggugugaggaguggggauaauugagugauauguuauguauuaucacacugugguccucaaagccuguguuaauucuaaucuaauggcccccaguugucuccuccuauuuuauuauuuguccaugcaauaggcuuucuaacauggguuaaaaaaagaaagaacacaaacacuuaagagucagaaagggguaauaagacggaauuaagcacagagucgaaagcuggaaaaggggaaaaaaaggguaaaucauuaugaaaauagcuaagcaacacuuacaucuaggaaaagugacacaaaacaacuaaaagcuauugaaaauggcauggccuuuaccaaagacugccuuguaaaacaacaggugccagaauaguaugaaaagaaccaaucuuugagagaguaaaauauccuccaaaaaaaguuaucuggaaucaaauaccaugucguaugccaucugagaaagcagggucuuggauggccuucuugaggaaauucaacauggauuucagaagugcugcucguuguggaauacacuggacuccuggcaaugaagaaagacaaaagaauuaugcugaguucgccauuaaaccacaaugaucaagcacauaaaacaaaauuuuaagagauccaaauacacuauaauaaaauuagaagacauucgaagugaggucucugaauguuaggaagaauacuuaauuaagcuuugaaauuggaaaaauuacuaauacuuuuaauuuuaccaauacuaaaagucuaaaguaaaaaagaaaaauuacaaaguaaaaagguucaacuuuuuuuuuaccucacucaguucccauuuuggauauuaucugcccuccaacauggcuguuuugauaaucaaugugcaaauuguuggaaaaguauaaaaugcuaugaaagacauguuaauauaagaaaauggaacaccagaauggugaaggagcaugaauagucaugggaugcuaaccuccaaauguaccauuuaaguucugccuaaagccgccuucuucaauaguuuaauaacucuaccacucugaaagacugcacaucuauguguguacgcaccaggacgggggccagggccagggccggggccagggccgggaccaggaccggggccggggccggggccagggccggggccggggccggggccggggccggggccggugccgggacugggaccagggcuggggccagaagagauguuagugcugcugcuggaaccugaugcccuuaauucaacauccagccugugcuccauagagauggaugagccuggacugcuuuccauagccacaucugcaacuaaaguacaaguuaugauaaagaaacuuacuagaauaaaagguaccacaaaaagaaaaauuuuguuugagaaaauuucuuccauuaaugugaaaugaauauaaaaaugaagaucaggaauacugaaccccaaaaugaaaauauaucacuaguugcauguauuaauacguacauacauacacguguguguguguguguguguguguguguguguguguaaauuaacaauccuacagaaguccuucaauauuucucaccuaccaaauuggggaagagggggagagugguaaguaaaaugugcaauuucauauacuacuaguugguaguauacaaauagguacagcuuuucaaaagaguaauuaauaaauauaaaaagcaugaaaagauuaauacucaauauuccgaucuggaagaaugucuaugaaacacugaaugagcaaugcaagaugaacaguauguuuaugaucucaucuucccauucuaaaauacuacauacauacuuaacaucaacauguauuugaauaugcauaaaaaagccuggaaagauccgcaccgaaacuaguagcuaugguagguaagugagcauucauuuuuacuuuauacacuugaauaacugaguauaagauacacaaucauugacuacaguuuauaaaauguauuaaggcuccaucagugauaaaauacuauuuacauuuugaaaucacugcagccucaaacucccaggcucagaugauccucucaacucagccucccaaguagccgggaccacaggugcaugccaccccacccggcuaaguuuuguauuuuucguaaagacaagauuuuugccauguugcccaggcuggccucgaaccccugggcucaagugaugugccagccuaacggauguuguugccuacccaacaaccuuuuuaccucuccuuucucuucucaaaauagguaaaguuuuaaaaggucccauuuuagucucucucucucuaccaagcauauuucuaacaccuaggauguuaucaggcacugcggcagugaaaaagacaauauccugaucccauggagcuugaauuuuaguagaaauaagacaauaagaaauacauaagaaaauuacgugaugaaauaaaacagauuaacaccacagcuauagcaucugcuuuaccugccaucucuacuccaaagaacuaguaccuuucuuuucuuauuaucuuugugaaaaacaaauuugcaaaucacuuacauagaaaaaaaauuuuuguugcugaaaguauauacucaaguuaauuguguacuuuggaauuuaugaggaagaaugaaaacuggggugggaugacaaaaaaucucaagcacaaaaauacugacuuaauaacuguuaauuaccauccauaucaguuuccauuuccucuccuucuuguguaguauugggucucuggaucuuuggcuugaucacaaacggacauucuuuucggcacaaaucuacuucaugcuacaaucaagagaaagguuauaagaaaaucaaguauauauauauauauauauuuuuucagggauuaaaaacuauuauaauggaaaaacacugcaagcagauacacaguugauuucuagaaacagaagagacuguaagaucgcucuuuaggguuaucaggacaauccuuagguucagcucugaguauuaaauucugugcaaagcauuccuuguauaauaauaccucaagucuauaaaugaagauagaaaguccacuaugggauugaaaagcugccauauccagguuggugauaaggucaaccacucugacggcucuggugacaaauguuaucugguccuguucaucgccaagaaacuuuaugaccuaucacggagaaaaagaggcaaaaacaaugaacuauaaagacacaaaguuguaaaaauugcaugcuuuuguauacauguagucuggggccucaguaaggcagcacaguaugggggaaaacauguguuuuauuuuuggugccugccaaaugacaguucuaugacuucugcgacucaaccucugagguaauggggacaucaauuacuuugcaggauuaaguaagauauuuagggagaaaaaagcuggugcucauugcccugcacauaguaaaggcuauuacuacuacaacacaacuuacaaaguacccugacauauauuuucccuaugguuguguaaaggcaugauaacauguggcaauguuuuaaccagaacccaugaccuccugaccauucuacacuaugauaaaagucucaauaauggaaguagcugcucuuaaacauuguuaauuagauaacuagaaagccaaacuggccuucuacuuaaguauaacuuuuucuggauaagcuuucuuauauuauuugcccucacugugaaacaccccaaacuugcaucucuacacccuuaguugauuuccccauguaguuuaaaaaaaaaaaaaaaaaaaguacagcaccuucaauaaggcuuccaucauuccacaggagaccaaggcuucaccaccagcaucguagcuggccagaugguauaaaaaagagaagagagcaguggcaaacuggugaggguauggauccauggaaggaucuacaagggagguggggagagggagaacaaaaacaagcucaaaauugcuguuaagcaggcaggauauuaaaaagacaaaggcagagggcaaauguuucuucuugccuaagauaaucaccaucaaaacuuaccaaucauggccuggauacaguuccuuacaagcacuggcaaaaauccaugguaggaggcaguuccaguacagucaauaauacugcugaguuugggaguucucuccaaguggacaauugauguuaauguucguaaagaagcugcuuuaaucuccuauuaaauuagaagguaaacacauaaugugucaaauauaauaagaugacugaaccaaguuccaguugcuaauauccaaacuuuaaaauauaagucauucuacugguaacugcuugaggggauggaggucuguugagagcaacaaugaaaaucuaguauuuguuaguuuugcaguuuaauacccaaagagggaaguacugggaguucuuucuaacccucugggaaaaaccaaaaggcaaacaaguauaagccugauauacagagaacauuaaugcaggaucccugauucaaaaaucugaaauauucccaaauccaaaacuuugggaauaccugcaugccagaaguggaaaauuccacaccugaucucaugugacaggucacaguuaaaaugcacaaaauuauuugaaauauuguauacaauugccuuaagacuacguauauaauguguauacgaaacaucaaugaauuucguguuuaaacuugggucccaugcccaagaugucucauuauguauaugcaaauauccccuccccccccaaaaaagucucaaauccaaaauacuucuggucccaaguguuacagcuaaggguuacucaaccuguaaaauacuuaccauaagcugcuuauccguuaucugaaggacaucuaccaacuccucuaucaagccauuauacaagauacuguuugcugauuccugcaaggcauuggaauacacugcaaaaggagaaacaaacacuuuaggcaagaaggcaguggucaagccacugcccaauaacaaacuuuuugguaucuauagguucuggggaagaauuccauucccaaccagcaauggagggcagaaucaucaccaaauuaaauucugaaggacuggaucaaauacaacugauaaucucuaaacagacacugaauugacagauuccacuacuaaagguauuauuagucuugagaaagaauuuuggggauggaaauaggaaaagcucugaguuaauuuuucauaacauuacuacuugauguaacuccacuaugccuucaauauaagauuuccauuuuagccucuuccuaugcuucugcuuuuacuguaaacacuuguaaagaacagaauuuauggaccauugcagaguaagucagaaauuugugugacacuguaguaaaacuucagaauguguguaauucacauucaaugaauuccacgaugagguuaauaccggacacaguacccugaagcauaaacuaaugggauuuaggcauauucauuuaguuuucaacaaagauuuccugagcacccacuaacaugccagaaaucaugcuagauaugaguacacauaaaagagcaagaauuucacgccaagaaacucauaguuuaagagaaggcaagucauaacauaaugaacaucaauaauaacagcaaugguuaccauuuuauaucuucuaugugcuuguucugugcuagauugcuuucuagguuuucauuuaaucuuuagaccagccucuacggugaguaccucaauauuaaacgaauaagcugaggcugagaggauaaguguggcuaauaaucuacagaaucagggacagaguacaggacugauuacaaaaccacguguuuuccauuuuacugugccacaguaaaagaaguuaaaugcacaguauugacuacugaauauuuugugacuuaauucaaaaugauaucccugaaaggaugagagaggaggaagacacaauggcaagagaaagaguagggggacagugaacgauagcuacaagcauaucuauuaaaaaaaaaaaaaaagagacgaauaccaagaauaaacccaggugacaugucaaucaacaucaucauacccucuuucucguccaacauuaaggagcucaaggauaaugaauaaauacagugaacacugggagggguggaaguauuuaaguugcuaccuagguaacuauaauaggacucauagcaacaaagaugaaugaaguucaaaggaaaucaggcccaaacugucuaauacggccugguaauuaaaguauucuucucuuaccuaauauagauauugcaugcagucuggccugaacugccugcaaucgcuuccugugauuagaaaagccaugggccagucguauguguguaaauaacagcaucuguagagagauaagacauacauuuuaaaaacaucaaugaaaaaggugaauauucuuuaugagggcuaacucaaaaaacaacacaacuaaacguuuucuccuuugauauccgaaguguucagaaagcuaccaccacuuauuaccugcucacggugagguaguuuauguuuuccucaaacucucauaaggccuaggaaguuauuaaguguuaaccucauaaaagacaaggaaacuaaggcucagagaagcuaacaauuugcccauggucugacuccaaagcugacauucuuucugcuaugcaaucucccaccccaguacauaucauuaaucuauuuagauaacaaccacauccuguggauguuuuaaagccacaucauaccugcuuauccuuaggaaugcuguacauuuugguaagagauuccaugauuucagaagggcuuucugaaaucuacauuaaaaaaaaagauauaguuaggaacaaaaagugaaccaaacauuaagaaacgagccaagagucaaagauuccucuuaccuugucaaguugcucuaugugaauauaauguaguguguuacuaguugucuaaaauuaaaaaagacaagagagcuguaaggagucacugaacacucuagcuuccccuuccauagagcuccaaagggcugucugaaaaccaagaugucaccuaauaggcugaagccuaagugaaugcucuuaaaaucaagguaaauugagaaucuuccaaaacauccaucuuauauguagaauauucuuaggaaagcuccuuuaaaaccaguaguaucaaacuauaaugcacauagccaggcacauuucauauucuucuuuguccuuuuuuaacccuccacugacuuaauauccauagcaguauuaauagcaaagaccaaauucaugaaaauauuuucucucugaauauguauuagaguugcuuucaaggcaauuaagcuagaaagauuauuuauuuauugaauaguauagguagaagagaaauuguauuuucacuaagcuacuucuaaaccaaacucuuuaguaccuccucaaacaauacaaaaugaccagauaauuuaagcaggacacuauccacaauacauaaagacuuuugcaggcuuccuaauuagagaaaccugagccaucaccauccaaacuacuauacuacauguuggaauucucagagacugugggaaaagcacauaggucauagcagugccucauaauggaugggacuugcaucuuuuggcagcucccaacauaagacccaacccuaucagaguuggggaugcaauuaacacuccugaggagcugcuagguauauuuauaguuugcgagggcagcaguguagcucaaaaccauuuauucauuuaacugaggaguucuagaagaggcaaucccaguuacaguaaauuguagacuuugucagaacaaaucugaaucagacucacccuuuucucaauuuugaccucggccccaggaucugcauagaauucaaaguguaguguaguugcacuggguggauauuucuguguauaaagcacaucaaagaaucagacauugaguuucaacugauuauaaacauuaucccccacaucuucccucaaaguccuagccacuuguucaacuuauuguggcagaagaauaagcaguacauucaguaccuacagugccuuuaacuguuugucuuagagcagagcucagauaggaugagacuuuucaaacagaaucaaaaggacagagcccagagcucccaaaccuucugcauuucauacuuauaaauuuccaguuucccuuuaagagaucaauuuugacuguggcuauucccaagggggaaaagaggggcaagacugccaagcaguaaugaauaagaauccaagaaaggauggagaacaaauaccagggcccagaaaccagcuaaagaauggaaaagaacauuccuacgaaaaaccuuguaccuaucaucagccuucugaaauauuuaauucaaaguaugccucauaggcauaucuucauaauucuucaaacacuuuccuucuauaccauucuacaccacuucucaugguauguuuucugcacagguagauaccaagacaacauaaaccagacccugacaaaacauucucuuuaacucuagaaaagcaacaugaugaacaaaauuaagaugacagcagaaugcccacuaaaaugucucacugaaagacaccacuugcagugguugccucuggaaaauuaagaaguuaccacugcauaccucuuuauacucugaauuuuuuaacauguauauguauuacuuccuuuuaaaguacacguuaaccuuuauguugucauaauuagaauuccaaacucugaauauacuucaagauuuauguaguuuugauuauuaaacagacaacacucaccuacuguaucacccaauaucucuucauaaaauaaucacuaaagaaaaguaugccagcuaacgugggaaaguaacuugaucuaaucugugguuuucugagaccagaaaagagccauucucuuuaggaaaaaaaggcuugcuaagauaaauacacuaaauuucacugcagccauuugugcuaaacacgacaaacugacaagacaaaucccacguggaaaauauaguugcuuccagaugcaaaauaauuauugaaaaucaaauuguguuuuguagcuccacagcaacauaucaaagcagaaaggaggauggccugagcucauaacuuaaacaugggugaaaggcagagagauaaacaaggaaagcacauaaaacauuauaaguucucaauaaaccuaaugguagaacugcucuccaagcagccauuccuaaaucacaccacacuguccagaguucugauacaauaguuccagugugagaaugcaagcgaacauacuuucugggauuuaaaaaaaaucacauuaaaauuaauucaacaaauacagcuaccuacucaagaacuggguaugaacacacacucuauuucucagauuuuuuuaucuaccaccagcacaucaagagcccaagcacugcuagacugcuuccuauagacgugguucagcuaugucugaacugaucuuagguuccucaaaggucucgaugugaaggcgucacuucauauaccacaauucauuguaaaguaagguucacagagaggccacagcucugucaaaagacacccauaucccaaagaguuacuuaccaucauaugcaagucucugcaacauucugcaaguccaaagccauucuccuuuccaccccagcucuugaaaaaggaaaaagauaguguuaagacagugcuuauggugacuuugcgccacugcacuccagccuaggcaacagagugagaccuuaucucucuuucucucuauguauauacacauacauauauauauuuaagaguguguggcugcuuggaacauaauguugagaagacauccaaugugaaagucaaacaagaggaaaaaacgaacagaaauaagaacuuaagaaucaaggcaagauggucugccuaaaggugauuucuucaaugagaucaauuucacuguucagugaggaugcuccuaggaagaacucaagcagcaacugccagccauuauauuccauaccccuguagucacgugugcugacaggucccuccuguccuaucaggccuugccugaggcucugccuacucaccuuccgcacuagggaggaaagcacuagggaggaaaucaugcuuuccaguuccucucuuuuugacaugagcugaguuacaaagcagauucuaccuuauuuauuacuacuguacuuugccacucaaaucuaaaaccucaucaacaagcuccugagauaauggggggaguggcucaacuggcuucuaaauacaaaacuucagccacauagucucacuuacuaacuagccugcaucuuaacagccuuuaaaauaucacuuuaacauuaagagcauuaacguauuuuuauuuuuaaaucauucauaauuauuuuacauauauuacauaaaauauguauuuauauauguaaaaaauauauaucucccugccucauggggcaaggcauauaguucaggcaaacaauugacgaagugaaagaaaugagauauuauuugaaacaaauuuauuaauuuguuaugucaaacugaagagauuuuuauauuacaaauauaaaacauuucauauaaaaagauauuuuguauauuuuuaaaaaauuauaaauauguaaauuauauaaauuuuauauaaaauuuauaaaaauaaaaauuauauauauguagcuauauaugaagagagugugagagauagacaaggucucccucuguugccuaggcuggaguggagugcaguggcacaaucacaacucaccacagccucaaauuccuggggucaaaggauccuccugccucagccugccacacagcuaggacuacaggcauaugcugccaccacgccaggcuacauuuuaaaaauguuuguaggagccuugccauguugcccaggcuggucucaaauuccuggccucaagugauccuucugccuuggccucccaaagugcugggauuacagcugugagccaccuugcccagccaagcauuaucauauuuuuaagucuggcaugauugaagcacaaaaugcuacuuauauucuaugucuucauuuuauuccugucuagugugggucccaaucaccucggaucugggcugccaccaugaacuaacauggcucucucucuacaucuaaguguuuccucuuuguuaaaugcuauuauaucacuacuugccaaagaagucucaaaaacaaacaguguaaaccacugaagaugccagucacaaagguacauacuauagaaugcuauuucuaaaccuguaaauaaauaaaugaauaaauaaaacaucaucugacuauccugugagaaauaagcuuucucaaacuacacuugaucuacuggcagcauuucucaauccagguaucauauaugaaacacagaacauggugaaugaucauuuuauucuccaaauaaugguacauaacuagcaccaccuuagaugcacaagagagaagucucuuugcuacauuaauaauggauaccuuagggcauuagggcuuacuucucuagugaaaaccuaagugagaaagucugccuggacacagauauguauaucccccacucccagcugguuaaaaacagacuguucuacuaggaaugcugucagugaaaauggcagaauggggaaccccauaagcccacaccuucacaaaaacagugaauaaacugacugucggaauucaagucuaucagaacucuaaaaaauaaucagaaguuuaaaacaacuagggaaguuuaaggcaaugagacaagaaucuguaaaauacaagguucgacauucauuaagauguuuaacagacggccaggugcgguggcucaugccuguaaucccagcacucagccagugggagcccgaggcgggcagaucaccugaggucaggaguucgacaccagcuugcccaacauggugaaaccccgucucuacuaaaaauacaaaauuagccaggcauguggugcaugccuguggucccagcuacuagggaggcugaggugggaggauggccugaacccgggaggcagagguugcagugagcugaaauugcaccacugcacuccagccugggcaacagagugagaccccaaaaaagguaacaaacaccuggugcuaaauauggccaaauagucacguauuaaagauauucacuguagcauuauuuaccacagaaaaauacuggaaauuaccuaaguaagaagaaaacugugaaguaaauugagauaaccauagauggcacaauugacaguaccuaaaauauucacagacagaagguauaaaaucauacuguaauggaaucaauuucuucuuucauggcauuagucucauucuugaaaauaucuugccacuucaagcagcauacaaccaugcaguuauacuuucuuucaaugcuuguauaacuucauguuuuuaacauuucagcuuuuuauuacaucuuaauuuuacuuugaugagguagaaucuaccuuaauugccucccaaagaguaagccaguuuuuacaacaccaucuuauuugaauaauccauucuuuuucugcuaaucugaaaugccaucuuaaccauaaauucgauucuuacacauuggaucugcuucuggaaccuacugauuggucaauuccacucuuaauuaccacacuauuuaaauuacuauagcuuuauaaaaugguuuaauaccuaauaaguacuucauuacauuuucaauauuuucuuggcucuucccaggacaucuagugaagacgaagacacaugcaauuugcugaaaaccauaaaguaaggaugaggguauaaaggcuugaugcuacagagaacagacagguaagucaaaccaaaagucugaaucugcaaggcagaauaagcuugaaaggcuguguaucuacacaauuauuuuccuuuuguuucuucuguuauuccaacuaauuguuucagaauacuuuuauuagugucaccacaaaauccuucuugccaacuuuugcaacuugauaaaaaacaagcaccuuuaauuagaaaguuuugguaagcugagauccuuaaaaaacccugccaacucaaacgugacucacgaaagucugugcuguuguuauauuuaugaacuaguaacauuauaugaaauauaaagaaauguuucuugugaagaaauauucaucagauaaagacuaagaaaauauaccaaaaugaguagauacacaauuaugauaaauuuuguugcauacauaaaacaccaagcaccuauuuuuaucaggaagacaaguuuguuucgcugccaacaaaaucaacauauuaaauguuaagauucuaggguacuuuuuagucaguacuauucagaauaacacuaguucuuugcccuuauuauuauuaauuuauuaucuauuuaucuugcuuucucaaguacuaaguaagcuuguuuuuauuuaaaaaaacgaacaugaccaugcucaaagaauccccaaaugccuaagacaggaagaacagauauuauucuucacauuuuagcagaagcaaagagcccagggccuuuguccaaaaauaauggugaaaccccaucuccacuaaaaauacaaaaaaauuagccgggcauggugacgggcgccuguagucccagcuacuugggaggcugagacaggagaauggcaugaacccaggagguggagcuggcagugagccaagaucgcgccacugcacuccagccugggggacagagcgagacuccgucucaaaaaaacaaaaaacaaaaaaaaaauacauaaguaacuucugagccucacaguauucaccuaucugguaguguuacuguaacauccuagcccuuaaguagauaacccauaaauaacuauauucauuaugccacagaggcauauacaacacuaccucacacuagacaggauuugcuaaauauucagacaucaggaaaaaggcuugaugcucucuaagauggaauuauaagaauuugauaaaaguuuguaacuuaauaaaauagacuaggccagugguucucccuggaccagcagguuaguauuaauauuaccugggaacuuuauagcaaugcaaauucugaggcccacuccaagccuaaugaaucagcaacucaggaguuaggugggauggaggugaggaagacuaauauauuuuuuaauaaagugauucugaugcauccucaaguuuacuagaccuagaguauaccagaccuucacaaaagccagccaacuggcuuucaacugauucaacaagucuuucuggagaauuuucccuacaucuguaguuaacuaaucacuguucacauucacaauuagcccacaucacuggguugaccuagucauuaaaaacuacuaugaggaaagacaccauauccaaagucacuuuucauaaagaccaaaacacgauauucaaucuuuuauauaaaagcauugacugaaccauuuuugaaaacaucacauacaaaacacaauaaacaaagacaauauacaugaagauuaggggaaaaaauacuuuuaagaugacaaaggacuaauaucuccaauaugguuuuacagaguaggaaaaaguaaccaaauggaaaaauggacaaaagauaaaaccuuucacaagaacaaauccuaauggccaagcauaaagaugcucaaaaucauuacugaucagugaagugccaauaaagucacacugagauuucugggacucuaucuuaugaucuccauaucaucucuuauaauaucauauuaaauguaucaguaacuaaauucauauauaagauugcuuaauguagcaucauucauaacaaauauaaguaugcaucaauagggaacuugaguaaaauaugguacauccaaagcauggaauacuaugcagccaucaaaagaacccuauaguuauacaggugacuuuaaagugauuuuugaacaaggucugaaauaagaaaacaaggauguaagguauccugcauuuguaacugaaggacaaaaacacccucaacagucaauauaauaugaagauaauauauagagaagaauacauuugagguuauggggaggugaaccaagagggaaaaggcuguacugaaaauaaucaugugacaauaugcaugcacuuauaaaauaaugcauguguaacauuuuaaaagaaagcaaauacaaaagaauggcauguaguuucucugguugacauccaucuacaaaugacagcuguuuauuaaguacuuccaacaugauggcauuaacccuacagguuuuauuuaugacuuccuuuacucugauccuaaaaaaacuaugagguagauauuguaacccccaauuuacagacacagaaacagguuaauauuuguuggcaaaaguagguuucacauccaaauccagguucuuauacacaugcaagugaauguguuuguugcaaaggaaguugccugaaaagacugaaaagacaugaaccaagauuucuaugagcauuguuaaagaagcccacaaggacaggcaguggcucacgccuguaaucccagcacuuugggaggccaaggcgaguggaucgccugagcucaggaguuggagaccagcaugggcaacauggcgaaaccccaucucuacaaaaaauauaaaaaauuagccgggugugguggugcaugccuguagucucagcuacuagggaggcugaggugggaggaucaauugagccugggaagcggaggaugcagugagcugauaucgugcaacugcacuccagccuggguaauggagugagacucugucucaaaaaaaauaaauacauaaauaaaagaagcccacaugaacaagucaaguuuuuagagaaauuuuacauuuuagagaaacaugaaauuuuuaaauuuuaaugagggauauuaguauuggagguaccauuacuaaauaccuaauuaucucuaaaccucaaaaaccuguaaaaaucuuuuauugcaaagcaccaaacacaucaaucuauuaccaaaggcugcaauguacugcaccugucaagauuccaaauucuccaggacuagaaauuaaccuccaaucuacaaucucuuuagaucaauucagagcaaaaaguagcaagccucucaaagguaaaaagugucaaaaaugcaaagggacaaaaaagcaaucauuuaagcaguccuuucugugguaaaaucauccaaaggaagaacaacaacuggaucugaauuaccuaaaaaacaaaacaaagaaacauacccgauacuuuauauaugugagccacuuauaccaaaaacaguuugcauuuuaacuucuacuuaaauugucagaacauuuaauuaaaguaugaaauauuaguguguuuguaucagccuaaaaguagggugaugugaauucugucagaugcuauugugguccuauacaaauaaccaaauuaacaugaucaaagcuguauuuuuaaugacuucuaggucuguuaacuuucuuagcaaacucuuaucaaagaucuuaaaagucaccuguauuuaccucuaaauacguuccuaggauuuaugucaagugugaagaaaaguucuaaacacauuuuccccucaaaacagccuacugucccacuguucuaagcaacauaagguauacucuuucauuuugcagauguauugucuauuccugugccaacugcaagacuuggcuuaaucauaaaaagccuuaugauaaaaacuuggcuuuauaauaaaaccacuauagcuuuaugauauuaucugauacagcaacucacccugauucauuaucaguguuuucucauuuauuucugugucucaguugaugcuauuaacagacuuccacuuaaucaauuugacugauuuaaaugagaaagggaauuauuucacaaaaacuaagucgaauauuuugcaaaauauucaucuaaaaggcaagaugcuaaaauaaaaagugucaaauuaugaagagauucagggguaaacucuaaaaaauuuagaauccuguaugcaggcuccuuuucuucaaucggugcaacaccauaaaguaaucacagauuauaguuguaguuuaugucagaaaacagacugcuucuuacuaagucuuauggcccacauaagaugggaaagggaauuauuuuaguuuuuaaaaaaucauauguaucaaucacuuuuuaaacauuuccugcuuuaacaagauuuuuaaaauaauuaaacuaccaaucauugguccuaauuucauuaaagggcuucuacuacauuaagucuucccauuuaaaaaauguuacuugucucuauuuagaccaucuuuuaaaucuguaaguaaagguuuaguguuggucuaacagaucuuaaauacugcugguaagauuuauuuucccuuauccauagggauacauuccaagaccccuaguggauacccgaaaauacagguaguggcaaacccuauauaauacacccacacacacacacauuuuuucccuauacauacauacugaugauaaaguuuaauauauacuauaauacaaguuaugugaauguggcuucucucuuaauauaucuuauuguauuauacugcaaguaacugaaaccauggcaaucgaaaccucggauaaggggagacuacuguacuuguucauguaucugucccauuauugcccauucagauucccuucuaucaaagguauaacuuuugaugucuguuaauuuuucuuucuugaaacuauauguugcauuguguacaucuuuuuaaguuucagaaaugguacugagcaaugaaaacuguugcuuuuacuuuuuuaugcacuaaccacuauguuuagaagccaucaauguugcuguauuauuugguccacuguuucuaacugcuacauacuccauagugugcaugugccacauuuuacuuauuugaguaucuacuaaugauggauaccaagguugcuuccaacuccucacuaccacaaaugaugaugcaauacucugacagagaucacguuuauggaaaugaugcgaucucaccuuugaaauauauacccaugagaaccagucuacacuccuaugaacaauguaugaggguucccauugcuucacauaccugccaggacuuaccauuauauaguuuucuaauuucugcaaaucugaugcuuacaaagcuguaccuuguuuuauuuuuauuucucuaauuacugaguaugggcaucuacucacaugaauuuccuguucuauaaauugccuauccauauccuuugcucauccuuguugaucuggaagaguuccuuggauauucuacauuagcagucccuuuucaguuuuaaaacacuguuaaacauuuuuaaucuaccaugggucuguuaacuucuguuguacaaagugcugccuaauuuuguaugcagaccagcugcuugcuauuacaccaauuguuugcaaguuuuauugguccaugacaaaaugagguuguaccagaauguuauuuaacuacauugguaacuauacuauuuaguacaacugacauuuuucuugaugaaggaagcaguguguugauuuauauucuaguguaagggccuaaggaguagccuggagcuauguguuuuuuguugggaaguauauuuuuaaauacaauauucaaaauuuuacuuucagguuuaugccauggggauuuuaagaauucuuuccccaccauuguuauuacaacacaaccuccuacauuaacugcucuuaaauuuacaguuuuagccaauaugacuuauuuuacagacagaauauuugcuuauacugugaauggggucuuuucaccaaucauuuucuuuuuuuuuuugagauagagucuugcucuugucacacagccuggaaugcaguggcacaaucuaggcucacugcagcuuccgccucccggguucaagcgauucuccugccuuaccguccugaguagcuaggauuacaagugcccaccaccacguccagcuaauuuuuguauuguuuuaguagagaugggguuucaccauguuggccgggcuggucucaaacuccugaccucaggugaucugccugccucggccccccaaaguguugggauuacaggcgugagccaccacgccuggccucaccaaucauuuucuaauugguugcuauuaauacauggaagagcuaucuguuucuguauauugaucucuuggcuaccucacugugcuuuuacuaguuauaauaauuuuacauuaucuccccaagaaacaaagagacucaucaccuacauacaaauaguaacaaauauucucuuuucuuuuuuagagacagagucucggucucacucuguugcccaggcuagaaugcaguagcacgauccuggcucauugcagccuucaccucccaggcucaagugauccucuuaccucagccucccaaguaacugggaccacaggggugugccaccacaccuggcggauuuuuguacuuuuugcagagacgggauuucgccauguugcccaggcuggucucaaacuccugggcucaagcgauuugccugccucagccuccccaagugccaguaauaacaggcauaagccaucaugcccagcccaaauuuuuucuuuuaauauguauucuucgcuucuuucuuuucuguugguuagcaucuguacuacaaauguaaaugacagaaguuaaugucugacauuuuugugugacuuuugaauccaauggaaaugccucagcucccccauuaugacuucugguagguaacucuaguuuucuuaaaguuuauaugaagcuuuuguuaaugagauaaauuuuaucgagugcuuuggaagcaucuauugaguaauaguuccuuuuuccuuuuaacuguggacuugggaauccaauguuaaaccuccuugugguuuuuaauaguaagaggaaauauuuacaguaucuuaagaaaacaggucacaugcauguauacauguguuuccaaaugcaagaaaaaaaugcuccaacuuuaagggaggucucauagggaugaauuauaggugauugacauuuugucuacauuuuccuagaauuuucagaauacauguuauauuuauaauuauacaaaacuaauuuauaaguaaucauggcaccugaauuagccugaaaacuugaauuacuuugagguaagcauuaaauaugcuuuuaaaaagccagccauaacacuuuucuucuaagaaagcuuuccaacaguggguuaccucucaaagcuaaguauguauuaagaaguugccucugggaacacuggacaauaguuugguagagcugaacuuuuauaugagagcuucuggcuucaauuacaaucacuacgacuuacugaucacagcacugaguaccccacaauucauuucauucuaaaucaacccugaaguagauauguuaaauucccagaagaggaaaccagugucggcgcuaguaagcagggccaggacucaaaucuagaucuuauuauugcauuauacuuccuucucacacagaauugaaucuaauuuugaacuuuccuuucagaagugaaauugccacuuuugaacagagagauuuuguuuggugagcagagauuaaagaauuccuucaaaauuacuuaauaacugagaauacuuagguuuuaaaacagggcaccaauaguucuaacucaauuaggccagugaaguuaacuuagggauucuaauauauuuuaacacuccaagaaacaccuguugaaaggaaccauaugcuccaauuuuugcaccccuccaacucuucacccaagacucaccucugccaaauguuguagccgaguuagcagcgggguccucuugucagaucccagacgagugauguaguuugaucuuuugcuaaauacauauaggagauugaggacugccagcaccacuugcauaucagaggaagccaauaaaguugucaaaugcuaaagggacaaaaaagggcaaagcucaagguaucaggcacaacuggccuugaaaacaaaacaaaauguacuugucaacauuuacaaagcuaucaagaaguuuagucacaacaauacaaaaaauauauaaguauuuguacucgggaggcugaggcaggagaauggugugaacccgggaggcggagcuugcagugagccgagaucacgccacugcacuccagccugggcaacagagggagacucugucucaaaaaaagaaaaaaaaaaaaaaaaaauauauauauauauauauauauauauauauguauuugauaaucuacaacaugcaaccuuauccccaaggagcuuaaaaucuggcaguuagcuauaaagugcaauaaaaguaaaaaacguaaauagugguucaaaauugcgcagguuuucccacaggaaggaaaagagacaaauacacaugugggacucaagaagaacauuaagucucuaacuggacuaaaaguauugugaaagaaagauauuuuauguucucuucuguauccuuuaugacaaacauaaaauugaaauuaauuaaaacaggguccuucauauagaagcuaaagauaucgauaacagcucguggcaauuauauaacauauaaguguuacaguacaguauaugcucauaaggaaccugagugacuacucuggauuuuguuguuguugcuguuuggagacggggucucucuguugcccaggcuggagugcaaaggcaugaucauagcucccugcagccuugaccuccuggguucaagcaauccucucaccgaagucucccgaguagcuaggacuacaggcacgcaccaccacgccccgcuaauuuuuguauuuuuuguagcgauggggucucacuauguugcccagacuggucuugaaccccugggcucaagugaucuucccgccucaaccucccaaagugucaggauuacagacaugagccacugcaccuggccuuacuuuggcuuuuaaauacaauuaaaauucaccaauacauugaagcaguuggucagaauuaaaaucaguauguaauauagcuagaaaugaaccaaggcauuuccaguugccaauuauaccgaaggucauggacuuccaugggcagcauaucuauuucaucuucaacagacugccuauuuaccucccacuuaaagcucuguauguuaggccuuuaguucaguuaucccacuucuuuuccuaagccauuuucuuuuaaguuguuuguucugauucuguuucucuacugaagacguaggaaaacacaccuaaaauuaacagggcaccuaacuaaugaugauaaaaagucuaaaguugggcuucuauaaaaagaaaauaauuucuucuuacagugauuuuuaaccaauuaaaaagcucacugauugcugcaccuaccuuacucuucaaggacacaaaggaugcuaugaauauauauuuugggauggguguggcagaguacagagagacuuuaaagcagcacacuaacacuuagaggaguaguaaguacauuaaugugaugagaaaaucaaacuauuucuaggaauuuaaaaguaauguggggcugcucuaacaaccuagggcaaaaaucaauucaugcaaauuuccuuaaauacuuuaauacauauauaacauuucucauucauuucuugaaucuugaaaaggcaaagcaaaggugauaguacagaaucuucccaucaacccuaugaaggauaguaucuauauccaagaaacauucuacuauuaucuuugacaaugaaaaacccagagcuccacaaugaaaaggaaagaagcaauagaaauagcaauuuccuuauuucuggauguacacaauucuagucaagaacaggguacacaggcuuuaaccuccccuaccucuauggaacuguacagaugccgggaaaagcuguacucaaugagcaaggcugugaaguucaacacagccaagagaagcauuuucaguugcucucuuucuggccuaucacauacgagcauccaugacauauucuccacugucuguccagcaucugccaguauuccaucgaagcgguccaacagguccacccagugauauaacucgcacuggagaggggaggaaaaagaggauguaagaauaagguagaagcgccgcaugggugcuuucuaacugagcuuuguuacaagagauugcugagcaugacaccuagacaaguucacgucccacccuugcccauaugagaaagaucauacucugagcuaaaagugcuguaguucauugucauacccaucuagauauaugugcuaacaccaauagacaccauaaaaccccuagagcuaggucuuuagauggagaacuccgguuacauucuaagaucuacgaagacaagagaacuauccuugccagaauccauuuuaucagaaaaauucauuuuuagaguuaucuaauaaaaauucuucuaaacuaaaaauccagaaauuaucucaaacuuauauugucaaaccacaggaauucugugauugagauucuuaagcaucaccugugaaaucaauucuccauccucagccagcaaaauuuuccuugccacugguuuaaagcuguguuaggcacauggcacaugcuagaugcuuauuaauugcugaaugaggcuaucccauugugguuucuuauuccauaucagagcauacaaaaugauguauuaguauggugaguccugucuuuugggagcuugacuucacauaccuuuccaauguuccauguuuugaucugcugcaguuccaagagaaguugcucaucauuacaaacuuugaguuugucuauuaaggcucugcagucugcaggcugagaaaagaaaaguauucacaaaagauguuuuggaaugagggaguugcaaauaaggagaaucagaaaaggaacccuuaagcucacacagcaauuuuccuuuugcuaggauuuacuacuuaagaaaacgagaugugccagacaaucucuugggauuaaaauggaaaccucaugagaaaaugcuuuuauucccccaacaauccaccugggcuuaaaaaacaaaaaaaaacaaaaaaaaacaaaaaacaaaacaaaaacccaccuuggauuuggauaaagguagaugcagacaaacuauuuggaaaggugcugacaacaaaaacaauaauaaguuaaacaucuaaaaaaaaaaaaaaaaacaauuaaggaaucuauaccauggucugaaaguuaaccagaaugccugguagguuauauugaaucagagacugaaaaguccuagugaauucacaauuaaaggugaagauuagcacuagcuauauuuuucuguuacauaaaauccuucacuuguaagaugguaaacagcuuccgaacuucguaaaacuaggacuccauucuuucuugggguuccuauuuccauacauuucugcucucuucuacugaugaauggguccauuugucagguaacaaggaguggauugagcauuuauagucaaguuucugaaaguggaaggagggaaagggauaggggcugggagagagaagccuuccguuaaugaauggcagcugggagaagugauuauuacacuuguucuuuaacuccauaaaggcaguacagcauccugggaauggaccagaggucuggaaccaaacaagucuggauucacuuuuuaacuucauguuuacuaagcuguuugaucaugagcaagucuaaccucuaagccacagcucucuuaucagaaaaacagaccuaauagcuaccucacaaauaugaaacucaaacgucugccacauacauaaaauacuuaucucccauuacaggagcuuaaauauucagagacagcauacuauuaaaaagaguaugacccuuggaaucagguaguugguaagcuaccucuuugaaucucagcauccucuucugcaaaauaaacuaacauguaccuauauauccagcaaugcugucgugagauucaaacugggagaaacguauuuucggcaucugaaacaacauggaaccuaacagggguuucuuuaagcuaaguccaaaccuuuucucccucuaagcauuauuaagaucuaccucaaauguucaugguaauuaaauauauguaaaauccuuggcacaaaauccuuccauaaaccaggccugcacuuuuuccucuucuccucuaagauguaaguugagggagaggcagugaagcagcagaaauagauaacauggaaauuugaaccaccugcuuaugcaguucacuugugccugcuggaccuacuuggguccagcaucaaacguguuacuucuauuucuaauggaaugcagcuguacaaauccaauuuuacgauguguagguaagaugcaguucaugaugaacauuuggauccuguaauaauuugguaugucccauaaccaggcauucagucuuuaccaaggcccaguagcaagccagaagcugcuuuugugaauguagaauagcugguggcagaggacagcacagccaagaaucuaggggucuuacuuguaauucuauuggggcuugccaaaagcacaacauggcaucuuuagcugacaccuaagucagucaccugggucuacuaggucauaauguccaagugauagggcaacuuguaucauagccuggaccuuuugcagagucuuuucuagauccaaaccuuacuaacacuuuagugguuccccacuaaauguguuagagguuauccaguaaauaggucaaaauagcaugccuaaaugugaccaaccaauauguuggcuccaaaauccaaacgcaucacacauuguuccucuuucuucacagugugugguacaagguacagcaacuucccucucacuuuagaagggauaucccaauauuucccaaacccuggggccacuagaaacuuuccuaaugugaaaaggcccucaagcuuccacaagguuuguuucugacucucuggcacaaauaugucugaggcaucuaaggugugcuuguguuuucugcucacaagauccaguuagcauaauggcaucaauuuaauguaccaguacuauggucucuguuuuaucagacuaucaaggucccuugcauuuugcaggagaaagcagcaagcacaacguuaagauauaagaaagcauuugccaguucgauagcucaauaacaauugccaggguuuacagugauuuauuucaauagauaccaaaucuggggaaaaaauccuuugcacagcuacugauacacaaagugaucaauaaaagccuuucauaauaguaccuagcauugaccacaguaugggaaaugggggcaaucauguaugcugcucaaggaaaauagacaacucaagucuuaaaaauguccauaaccagugacauaaaaauuccacuucuaggaguuuaugcuaaguaacuugcuaguaacuaggaaauaagagccagaaaucaguauaugacuccaagagcaaccccuuacaauccacuagguuaaaaauuguuuuuuaauuugcauuucuccaauuacccgcuaaguugaaucuugcuggacguuuacuggguuuguucuuuucuuaaaugcccuaugcccauuuugucauugggauauucauuucuccugauuuagcuacugaaaauauuaacuacacuggguuacaaauauuuuccccagcuugucaugugucuucccccucccccaccccaccugagcuuauuaagggguaaaugguauacaaaaaaacugcacguaauucaugcauacaacugggugaguuuggauguauguauacacucacguugccaucaccacaauccagguaauaaacauauccaucaccuccaaguuuccuugugucccuacgugugugugcaugauugugugugguaagaauacuuaacgugagaucuacccucguaacaaauuuuuaaguagaguagucccucuguauccacuggggauugauucuaggacccccaugaauaccaaaaucuaugcugcucauccuuuguauaaaauggcaaugguauuuguauauaaccuauacacauccuccuauauacuuuaaaccaucucuaguauuacaauacugaauucgauguaaauagcuguuacacugcauugcuucaaaauuucuauuuuuacuuuuguauuguucuuuuuuauuguuuuuucccccaaauauuuacuauccaguugguuccaucugcaaauguggaacccacacacggagggcagacuauacucaauaccugacuguuaacuauaggcacuauguuguucuacagcagaucucuggaacgaacuugccugguauaauuuuauacccacugagcagcaacucccccuucucucucccaccauuuccugguaacuaucauucuacugccuaccuuuacaccuuugacuauuuuagaugccucauauaagaggauucaugcacuauuugucccucugcggcugacuuauuucacuuugccuaaugucuuccagggauuaauuuccaaaauauauaaggaacuccugcaacucaauagcaaaaaaaucccaaauaacacaauuuaaaaacgggcaagggucuugaauagacauuuauccagaugucuauuuacauacaaauaguuuuaaaauauauaaaaaggugcucccuaucaaggaaaucaagggaaugcaaaucaaaaccacaaugagauauuacuucacaccuauuaggauggcuauugucaugucuuuuuaauuuuggauacaguauuuaacauuuccauuaugguuuuuuuccuuuguuuuaaugcuuggaaagaccaugcccacuuaagacaaaguaaacauucaccuacauguucuacuucuccuauagcuuauuucuuuuaaaaacauuugacuuuugguuuaucuaaaauuuaucgcaauauaauagucccacaugcucuacaagauaaucauucuagcaugguuuccuaauacugucccuucuuuccaauuuauaaucccucuauuaccauauaucuaguucuuauauacacuaggaucacuuuucuaggucuucuauucucguagcaguagauucuuacauugguuccacuuuaaauuuuuaaauuauaguuucuuaagcaaguuuucuuuuuguccuucaguaaaagacauucaaguacacaguugucaaaacuucuagaugccaaaacacaucaaaaacaaaaucaaaagcaaaugaagauauuuccaacagauaugaaaaugaguacguucaauauauauggcauucaguaagagaaacacugauauuccaaugucagauacaaaaugaauggcacaagaagauaacugauauagaacagugaaauacuuucuuccccacuuaugaaauuaacaaaaauuuaaaagacaaucuguaauacugacaaggguauaugaagaaagugcugcucauacucauuaguacaaugcuaaaugaaaagggcaggauaauugugugugcacauguaauaauuuuuuaaaagacuggaagaagccugggcaacaaggcaagauccugucucuacacaaaauaaaaaauuagccaggcaugguggcaugcaccuauggucccagcuacucaggaagcugaggugggagcaucgcuugagcugggaggucaaggcugcagugagcugugaucgugccacugcacuccagccugugugacagagcaaaacccugucucaaaacaaacaaacaaacaaaaaaaacuggaagaaaugcagcaaaauguuauuguuaucuuuuggugauacuugccagguacuuuuacauuuuuugaaaaccaaguggcuuguauuuacgauaugaacuaacuuaugugccagauacuaugcuaagcaauugccucacaucaagaaggaaaaaauuuucagccccauuuugcagcuguggaaaccaggcaaguuaauaaccucucagccacaaaagucugguaagauucaaaccuaggucuaauuucaaagcuugugcucucugaacuaagcacaaggggucaacaggacuaucacaaugcaauaccacuuccucaaccuuagaaagcaguucaagcuagcugguggaauauuacuagauuaaagcugggauuucuacugucgacaaaggguuaauugauaugaccacccaauacacaaguuaagcugaauugugugauuaagaaucaguaauaaagacaagcuaaaacacuggccuuaacaaaaaaacuaguaagaaagauguuaccacuuucauuuucuaaaaaacaaaauugcaagaucccagaaguacauuaaaaaucugaacccauaucugcucuuuccauuauaccacacauccuuucugcauaggaaggaauugcacagcagccugagagcugacuucaggcacacacagcuacgaagaacuaacugaucgguguucacuuuccacuggucucuuggcuauccauuuuuuugauccagggaaguucaaaagaaaaucuuacuguuucuagacaaguuguuguuuuacugccuuuuguauauaugggugaugagauuugaagagcauggaugaacuguucacaaauauuuuuuuauuuuuuaaugaagaaaaaauaagcaaaguaaacuuuuggauacuuacagccucaguaggugucuucuucaguuuaguccugucuacuuucaugauuucaauuuucagcuuuacgaucugaaaaaagaaaaucccaaaagaagugagaacuuaaagcuacaaucuugagcucuacaagcuuggacacagacaauacagaaugaagagcaaugcaaaaugcuuaaaguaaaaacacuggaguuaugaugcuaugccaacucagaggcacagcuaucagguagagagagguaaagaaucucuccagaucaaacuggcccacaucccuauguugcacaagacugaaaccaaaucaggucaaaaugaaaauuuuuucucuuuuacaagcaucucaaacucuuaauugaaaauaagaguguacaauguuugcaacacaucucaggauggaaaaauucaccauagcccugcaguuuccugauaacuuccauuucuaggaauuaauccaaagaaagucguaaagauguacacaaauauuuaaccacaagaauccauacugcaugaccauguauaauaguaaaagacugaaaaagaccuacuguuccaucacaaggcuaaaaaaaagaucaaauguccaaaauacgacugguuuaaaauggaaugucacacaacuguuaaaaauauugcaaacuauguaauacacaaagauguucaugaugaaauaaaaagauuacaacacagaacauacgguauaaaacuuaugucuaaagaaaacagcuuagaggugcuaggcaucagaauauuaauucauuguuaaccaaaaggauuaaguaugacuguuuuaccuaugcaccuuuuacuguuccuaccaauaaaaauguauuaguuguaucauaagagcaaaggcaaaacaacacuuuuuucaacuagaaaaugaaguauaaggaucacaacagaaauauucugagcacagaaaacaaucauuuuauuaagccauguaauuuggaaggcucaaaagcagacaacagccugaucagauccacuguauaaucccuagaucuuugauggcagacaaguccuccaaagcacaagaagaaauaaguuucuccuguuagcaacuaagacacaugcacagagguagaaguggguugcaggcucuuuacacacaaaagauucugcuauuaacaauguauuuaacucaguggcagucacuagaaaucaauguuccucccccgagaaggcugccauaauauaaagcugaccaauuacaguauaaauuuuaggcagcuuuuugccuagauuuaguccaauauacucaguacuauggaaauagcguguauuugccuguacgaccuguauccauucaaucagcaggcauucaaggaagaguuugugaaaaauucagaauacguucuaaaacauuucugcagagaccauuccuuaagaagaaaaaauguuuucuaugguugauauuuaggguguguaauuccagauuacuuuuuaaaaaguuaucucaguaucaauacaaaaugaacaaaaugccugaugccaacaaccucaaaauaucucaaaugaagccaacaggauucuggcaacaauccuguccaugugguggaaacuauaagcugagcuauuuguacgcuuacucucaaggcuuuuuuccuccccuuuucucauaaacgucuuacgcaaguggcugucacacuauugucgcuucagucauuugcagggaggcuauuaaacugccccugcugcaagacguagcagccagccucaauacaacucaaauaacugaugcuuucccucuaagauuaggaacaaggcaaagaugucuguuaucaugacuuuuauucaacauacugcugaaaguucuagccaauauaauacaguaagaaaaagaaauaacaggcacacagauaagaaaagaaaaaauaaaaauggucccuauuugcagaugucaaaggaucauccacauagaaaacccaagaaaucuauuuuaaaagccucccagaggaugggcgcaguggcucacugcacuccagccugggcaacagagcgagacuccaucuuaaaaaaacaaaggccaggcaggcgcaguggcucacaccuguaaucccagcacuuugggaggcugaggcgggcggaucaugaggucaggagauggagaccauccuggcuaacacgguaaaaccccgucucuacuaaaaauacaaaaaaaguagccgggcguggaaggacaagccuguaaucccagcuacuugggaggcugaggcagaagaauugcuugaaacuaggaggcggagguugcagugagccuagauuguaccguugcacuccagccuggcgacagagcgagacuccaucucaaaauaaaaaaaaauaaauuagccaggcgugguggcgagcaccuguagucccagcuacucaggaggcugaggcaggagaauggcaugaacccgggaggcagagcuugcagugagccgagauagugccacugcacuccagccugggugacagagcgagacuccagucucaaaaaaaaaaaaaaaaaaaaaaaaaucaaagcucuaaauacauggagagaucuaagacucuaguaaagaugucaaaucuccuaaaauuguuauauagguuuaauauaauuccuauucaaaucccagcaagauguuuuuuuguaaauaagcugagauuauucuaaaguguauauguuguauaagaacaacaauggcugaaacaauuuuggaaaaaaauaaaagagggaggaauugaauuacccuacccacuuuuaagacuuacuauauagcuacagacaucaaguaguacugauauauauacaaguaucaauagagcagaauagagaacccagaaauagacucauacaaauaugcccaacugauuuuugacaaagguuaaaaaaaaaaacaauucagucaaggaaagauaguuuuaucaacaaauggugccagagaaagcagacaugcacaggcaaaaaagaugaacuucgaccuaagccucacacuuuauauaaaaaauuaacucaaaaugaaucacuuaaauauaggacaauaaaauuuacuaggagaaaauauuugcaaaccauauauaguaucuaaaauacauaaagaacucucaaaauucaacagugaaaagucaaacaaucucaguaaacuaggaauagagaacuucuucaaauugauuaaaauaucuacaaaaaaagcuacaacuaauaucuuaauggucaggaacuaggagcauucccccuuaaauaaucacaaacaaaaaaggccaggcgcaguggcucaugccuguaaucccaacacuuugggaggccuaggugggcagaucauuugagguaaggaguucaagaccagccuggccaacauggcaaaaccccuuaaucccagcuacucaggaggcugaggcaggagaauugcuugaauccaggaggcagagaucgcagugagcugagaucgcgccacugcauuccagccugggcgacagagugagacuccgucucaaaaaagaaaaagauguccucucuuaccacugcuuuccaacacuguauugaaaguccuagcuaaagcaguaaaggaaauaaaaauuauaaagauugggaaggaagauacagaacugucuuuuugucagagaugacaugaucauacaugcagaaaaucugaaauaaggaaaaacacccuggaacuaacaagcaauugcaccaaguuugcaggauauaagguuaauauacaaaagucaauugcuggccaggcacgguggcucaggucugcaaucccagcacuuugggaggcugaggcgggcggaucacaaggucaggagaucgagaccauccuggcuaacacggugaaaccccgucucuacuaaaaacacaaaaaauuagccaggcgugguggcgggcgccuguagucccaacuacucgggaggcugaggcaggagaauggcaugagccugggaggcugagcuugcagugagcugagauggcgccacugcacuccagccuggggcgacaaagcaagacuccgucucaaaaaaaaaaaaaaaaaaaaaaagucaauugcuuuccuauauaccagcaacgaacaagcagaauuugaaauaaaaaacauuuauauuagcaccccaaaacugaaaaacuuagauauaaaucuaacaaaauauguauaaggucuauacaaggaagacuauaaaauucugaugaaagaaaucaaagaacaauuaaauggagagauauuccaaguccauggauaggaagauucaauacugccaaaauguuaagucauuuccaacuccacagauucaaugcaacuccaauuaaaauuucaacaaguuauaugaauacugacaaacugauucuaaaauuuauaugaagaggcaaaagauccacgauagccaacacaauaucaaaggagaagaacaaagucagaagaccuacauuacccaaaaucaagucuuaucauaagacaacaguaaguaagaguacuguaccgguaaaagaaugaacaaaucaauggaacagaauuagggagcccagaaguagacccacauaaauauugucaaccgaugaucuuugacaaagaagcaaagucaauauaauggacaaaagauaguuuuuucaacaaauggugcuggaacaacucgauacauacaugcgaaaaaaaaaaucuaaaccgaaauuacauguuucacaaaaauuaagucaaaauggaucacagaccuaaauguaaaauauucugcucuguaaaagacacugucaaaagaauaaguggacaagccagacugacagaaaauauuugcaaaagacauacaaaggacuguuacccaagauacacaaagaacucuuaaaacucaacaguaagaaaacaagcugauuuaaaaaugggccaaugggccaaagaccuuaacauacaccucaccacagacagacagauggcaaauaaacauaugaaaagauacuccacaucauacggcaucauggaaaugcaaauuaaaaccaugaugauauaucacuacggccaaaacccagaacacugacaacaccaaaugcuugugaggauguggagcaaguggaacauucauucauugcuggugggaaugcaaaauaguacagccacuuuggaagucaguucagcaauuucuuacaaaacuacucuuaccacaugacccagcaaucaauacucccugguauuuacccaaaggaguugaaaacuuauguccacacaaaaaccugcacauggauguuuauaguaccuucauucacuauugucaaaacuuggaagaaaccacaauguccuuugguaggugaauggauaaacugugguacauccagacaauggaguauuauucaguacuaaaaagaaacgagcuaucaagccaugaacaaacauggaggaaaccuaaaugcauauuaguaagugaaagaaaucaguacaaaaaggcuacauacuguaugauuccaaccacaugacauucuagaaaagaaaaaacuauagagacaguaaaaagaucagugguugaggaggguuaguggggagggaagaaugaagagguggagcgcagaggauuuuuuggccagugaaacuacucuguaugauacuacaaugguggacacauguuauuaugugucuaaaccccaaaaguauacaccaugaguaaacccuaauguuaacuauggccuuugagugauaaugauguaucaauguagauuaaucaauuguaacaaguguaccacucuagugggagauguugauaacaagggaggcuaugccuguguggaggcaggcaguauaugggaaauuucuguaccuucugcucgauuuugcugggaauguaaaacuacucuaaaaauaaagucuauuuuaaaaaaacaauccuccaaaacaagagcacagaguaacuuaugcacugaaauaagcaaaucacaaccauuuuacuuuuuuaaugcagaugagucacugaugaaucuucaaacaaauaagcaacuugcucuaaugcuguuuugaccuaguguacuauacuagucaagugucuguaacuacagaaagacuggauaauuaaugcagccaaguaauuuacuggagaguaucugauagcucacagaacugacagaaggcuagagcuccacgugcagaaaacuaagaggaaccaaggaagcuagggagccuggaacuacagccagaccccccacggaaacagcuuagcuugggguacuucugcugccaacacaagacucuggaugccuagaaacuaugcugguggcauaauucuaaaucaucucagguuauuugcaugaguggcgcuagacucuaagucccaaguguaagcauuugaugcacccaauaaaauaacagagccaauaugaaugcacacacacaaauguucccauaacaagugcaguccuaccuuggugucuauaauucuacugcaagaaacauuuguaguuuaaaaaaccaagacaucacuguccaugagacaucaacuuuaaaaauuuagaaguuguuguguucucauauuucuaaaacugguuucaacagugggaggggggaacguuaguauacugaguguccauuacaagccagacaauacugagacuggaguuccccaaaguguguuagaaugucuugcucuauaaagggagacaagaauccuguaauuugggaaauguuauagacagaauuucucuuccacuagggcagucacauagcuaauugacauuauuaauggcucuaagacaucuuagguaaaggaggcuuauuagcgcacagaaccauuuucucaaguggcaucuacucaaaguccaauugaaguauuccaaagaauacaguuugagacaugcuaccuagggaauucauaugauauuuuuucauacaguccucaccacucaagucaaguuuugccucuauuuacagauagaaaacugaaguaagagagaaaaaaaguaccuuucuuggucaguaaauguuagcaccaagaucuaaauccaggucugacuaccaaguccaugcuuuaauaacaugcgauucacuuuuuuuuuuuuuuuuuugagauggagucuugcucugucgcccaggcuggagugcaguggcgcaaucucggcucacugcaagcuccgccucccggguucacgccauucuccugccucagccucccgaguagcugggacuacaggcgcccgccaccacacccagcuaauuuuuuguauuuuuaguagagacagaguuucacuguguuagccaggauggucucgaucuccugacguugugauccgcccgccucggcuucccaaagugcugggauuacaggcgugagccacggcacccagccucaccuuuuuuuaaaaccaguuuuauuacuacaaaauauuggcagauaagaauaaaaauuugugacagauucuucuagacugcugaauccuauuuguuugaaaaaauuacuccaagagaggaaacuagggcccaagaugagaagcugagaugcuguaauuucacuaaugaaaggaacaguaacuggggaaugaguucuaccucuuagaaguuaaucaggugaaaacccuauuacauuuaaaaaaaaauccuuccauaaaaauaaguuaguuugaaacaaauuccuagaaauggccuacugccuuuguugggucagaaccagaacucagggcaccaagcaaucucuauauauaauaaacauugcuuccuaaacuuagguuagaaagauagccaacuuaaaagaaaacaagugaauuacuaugaaucaccauccauaucuauuaccauuacuucaauacuuuuaucuaauauuuuuuuucacuuccuuauucccccaaccuuuccuuacaccccugagguuugaaucuugguuuuguacaguuuaccugcagaacaaguguacacaacuaaaauauccugagggaagccacucaaagcgugacucauauucuauaguaaucaccuccaguugauaauauuuaaaaauaaugacuuucaauacugaaucaguuuaagggcacaggacaccuguaguucccaaaucuggcucaagagcaguuggauguagugaaagacuagccuuacuaaucaagugugguccaaggaucagcagcacugacaucaccugggaguuauuaaaaguugcagaauuucaggccccaccuagauaugaggagucagaacccgcauuuuaacaagauccuuaggugauccauauaacaaaguuugagaagcacuagaucagaauacagacucagaaaaccugggcuagaaucccugcuauaucacuuacucacugcauaaccgcagacaaauccaccucucuaugcuuguuuccucaacuguguaauuauucuuuccauuuaguucuuggaacacucuaauuucuaaguucgccgcuggaauguuuuugccaccccuccuuucccacaacuaguuccauuugaggaacugacauuuaaacuaagacccagagaggcuuuccaugacaacccaccucaaguuggucccacuguaauuuuucuauuauagcacccaguuuauuuccaauuuccuucauaacaaguaucaacuguaauuacugguuugauuuucuaagauguuaagcucucaguaccuagcacgguaucuuccacaugauagguaugcaaauauuuguagaauggaguucaggaaagacguaugcauuaagaauaaaaucugugauugucagcacacauauauuacuugaagccaugggucuggagaugacugcuuacaaagaaggaaaggaggaggcccgcaacugaguuauuugcucuagcauuuaaagguaaggcaaagaaggggccggguacaauggcucaagccuauaaucuuagcacuuugggaggcugagggcagauuccuuaaacgagaccagccugggcaacauggugaaaccccaucucuaccaaaaaaaauacaauacaauaaaaguguaaagguaaggaaagaaggaaaacccagcaauggagaggcuagugaggaaagagcaaaacuagcuaauuaugcuaucacgagagacgaaagauggcaagagugaucaacugcaucaaaugucaaaaugagguauguccacugaaauugguaauagagacaauuugacaagcaauuguuucagugggauggagggaauggaagccagacuagagucagggaaucaauggaaagugagaaagcauaaaugguauguguaaaaaccucuucugaaaauguugggccaggggcaguagcucacgccuguaaucccagcacucugggaggccgaggcggguggaucacccaaggucaggaguuugagaccagccugaccaacauggugaaaccccgucucuacuaaauacaaaaaaauuagccgggugugguggcgcaugucuguaaucccagcuacuucggaggcugaggcaggagaaucgcuuaaacccgggaggcggagguugcagugagccgagauugcaccauugcacuccagucugggcaacaagagugaaacuccaucucgggggaaaaaauauauauauaggcuguaaauggaagcagagaauuauggggucacugaaauguagaggaaaagguaaauaaagacacuagcuuauguucucaaguggcugcaaacugucuugaaaagacggaguaacuguaagaaucccuuugaaaauuggggguaggggaccauuuagccucuauuucacuguaauauaauaagcacuuaugcagguuugaacagaaugauauccagaauuuggacaaucuucucccgaaccccucaaaucuugacuggauaucccaccauaugugauuacauuguacucuguaccuaucacuucccuauuuaugagaaaaugucugccacagggugggaaaguuaaaaaaaaaaaaaaaccugggaagggaagaaauacacauuauuaguaguuggccuuuaaugguugccucuagcuggcaggguaacacauaguuuuauuuaugcuucaugcuuuucuaauccuuccaaauuuccuauaaaucauggauccauuuauaaucagauuuccuuuuguaauuuguuuuuuuaaagaaacagggucucauucugucaccuaggcuggagugcagcggcaugaucuuggcucacugcagccucaaccucccaggcucaagcaauccucucaccucagccuccagaguagcugggaccacaggcacacucuaccacgccuggcuaauuuuuauauuucuuguacagacaggguuuucgccauguuguccaggguggucucgaaguccugaguuaaaacaauccuccuggccucagccucccaaagugcugagauuacaggcguuagccacugugccaggccuaaaauuuuccuuaaggaagaaaacacuggccccugagccaaaggacaugcaccagauuaagaacaccaucuaaacaaaugccuuagauuagcugcugccuacucuaggagcuucuucccuacaucuucugguguuuggagcuuggcacacaggaggcacuuugguugauuauuagcagguaagagauguugcacguaaguacgggaguggggaugaaucaaaaugagccuaaaauccccauagaaaucauggaagcauuacggcaguucuuaaacaaaaaaugcuuagagaaaacuaaacuccaaaguaccacaaagcaaaauacuuuauuuuuugccuugcaacgauuuccuuuugccuuauagucucugaaaguaaauucaggugagagcugcccugagcauucuucaugucaacaagcaguaagaugcaucuugaaauccagccugcuauucacuauuugauuauagaggaauaggugucacugauuaugauuuguuaaaggggacaccacauaauugucaggccuuuccauccuaucuaguuucugauuaucuauuaauacauuaauauccacucaacaaauauugugaaaaacauuuaugaucauaaaaaaauagcuaacacuuacucuauaccuauugugcauuaucuuuaauccuuggagaugaagacugugcccaguuuacugagaguggccacauaccuauuaagugguaaaacguggauucaaacccaaaucuguuccacaacucuacauugcacauaaugucuauaugcacagcccaccuugcuacgccccucuccuacagacaccagucucccuauccuuagccacauaaaacaugacucucaagugcccugagaacugcugaccuagguuuuacugggcacugacaguaaagugucauaauaaagcaacugaaaaauagccuuuacucacccaagacaaaucuggaaauuauuugcagaaauaccuugaaggagucucucauuuaaaaucugaaaacacacuauaccucagauuaagaguuuaugcuggcucuggguguuucucugcacugcaguuaugcuuaagcaaggaaaauaugggcagggagggauacuaagaaagaggaaucugaaaccuccaauguugacuuugaacgugagaauaguaucugagaacacaucuccugccacauccucuauucaaacagucuggggaagcugcagaucugggaguuauccuucccggauacucccaauuacuuagagaaacuggcaucagaagaacuaggcaaccaaacauggcucaccaaaguugcagauuaucaauuuuaccaauacagaggaaaugacagcaugcuaaggagcccuucuugguauucucaacaaaaaauaaaaacagcaaugccuaaguguaaguuaagcaaauuaagcaggagaggaacagacuccuugucuacacauuuuaaauugguacucuggaauauuccuagucuacaccuuaagaauugucaguuucuggcugcaugccuguaaucccagcacuuuggaagccugaggugggaggauaagccugaggugggaggaucacuugaggccaggaguuuucccgagaccagccugggccacagagugagaccuccgucucuacaaaaaauaaauaaaaauuuauaagaaaagccugccuguaucgaauaggugaauuucacccagaagggccacaggcagcauucaaugaguucaggaaaguauuuucauuugucagaaguuauuuuaaaauuaucuuaaaaauaacuuacuucacccgagacuuauuuugaaaacuaaaaaugccugaccacacaggcauuucaaagcuaucuaauucaguaggucugaaguggggauuauuuuuuucaagcuguacaggugauuuggcagcacaggccagccuugagagccauggcauuagauuauuauucaauauaugcuuugccauucugugacuuaggaacuugcuuuaauaaaaauagaggggaggagcgggguauaaauagaacaauagcccuguguugaucacuguucaagcugggugacaguuacauggguguucauuaugcuuuuuucuauuuuuguauauguuuugaaaagucucauaaauugaaguuauuuuaaagugagacuuuuuccugcuggauccauccauucuauccuccacauuguugccagagcaaucucccuaaaacucaaaaccuaccuacaucaaguacaaacuccuuauuuaaaccagcauccaagaccucuaggaccuggucccugcuuaccucucuuaccagugcuaugauauuacauaauauuucccucagcuccccacaugcuuuauuuagccccaacuauauccugcauauugauccucaaucagcacaccucuuuacuuaccugacagucuccccacuaugcuugcugaguucugcaagagugggacuguaucauauuuaucuuugcauuccuguaccagcauaugaacugucauuuauuaauagcagauuaauaaaugaauaacuauccaguaaaugcuuaacaaaacuaaaaaaaauccaagucacauuaaacucuuggugaacugaaaaaaacaauuuagauucauuuaaccuucaucuuuccauucaacaauuauaaacauacuauaugcagggcauugagaugaauacucagauagccagguguacagaaauguagaaaauaaggaaaaaaaucagaaauaaaauagauuagaagcaaucguaauauaaaggcaacgaagucaauacacaaaaaaagagaauuacaacuuccucaugcccaaaggcugaaaacacaaccaauuauaagaucaauacagaagauaaauuaaauuugcauaauacagaguauaucuuuaagcaaaagugacacaguuagccaagcuuacccuugaccacuguguagaaaaauaagucuagaaaaauauauacaguugcucuucaacauaugaugggauuauaucccaguaaacccauuguaaacuggaaauaucuaagucaaaaaugcacuuacuguacccaaccgaccaaacaucauagccuagccuaccuuaaacaugcuugcaauauuuacauuagagccuauaguugggcaaaaucaucuaacacaaagcccguuuuauaauaaauguucaaugucucauguaacuuaauaucgacugaaaguggaaaacaaaaugguuauguggguacucaaguaugcuuucuacuaaauguguuucgcuuucacaccaucguaaagucaaaaaauccuaaguugaaccaucauuaagucggggacgccuguacuaagaaauacaagaacaaacaacauagcaauuuagacaucuuaaugacauauagagaaaaacaaguguagaggaaucuuuagaauuccucauccuauacugaaggaugaccacuacaaaaacccugaaauucugugggaaauuuuacauauguuggucuuuuucccagaagacggucaacagcuuucauuggcuucuuaaaaggaucuaugaccugaagaacauuaggaaccaaugcccuaaagaaaguuaagacacugucuaucuagccaugacaauguuuucccuuguauuucccuuucauuuaugaaacacagguauaugguauuuuuuucccaaagccacaugauagacuacugucaaauacaauaaagaugguaccagauaccaaagaaacagaauuccaccccuuuugcauuauucagcuccaauucucucauguccuuggguuugcagagaaacaagcagcaucucuaaagaucaaaccuccccggccgggcgcgguggcucaccccuauaauccuagcacuuugggaggcugagguggguggaucaugacaucaggaguucaagaccagccuggccaacauggugaaaccccgucucuacuaaaaauacaaaaauuagcugggcgugguggcacacaccuguagucccagcuacucgggaggccgaggcagaagaaucgcuugaacucgggagguggagguugcagugagucgagaucaugccacugcccuccagccugagugacaaaguaagacuccaucucaaaaaaaaaaaaaaaaaaguagaggcugaagacuaccacuggaagaaaaguaaaaaugaaguaaaggacaacagcauaauggaaaagccugggaaacagacagaucugggccuaaauuccauuuacuaggugugugaucuuagacaaguugccauacaucucugaguccagucaccucuguaaaauaaacaagucuaucucauaggauugugcccagcaaagaguaagccguauugcuauuuguucuauuucuuuuggcuccagauuaaucuaaaggcagaaaccuuaugcuagguauucuacagauugauaagacagaaauacagauauauaaaucugaucauaugcaaaagagcuggccuucucaaucuuucuacacauuaccugcauaugaaggagaacauacaguauauacuaaucuccauacuguuagccauaacugcagacaaccaacaacuuaaacucuacuuugaugacaaugagauugggaggcuccaguuucauucucaaauuauacaguucugcaaaagguaaacagucuacuaaauaaugugcaggccaugccacuuaaucaaaaauuuuaacugggucucaacuguuuugagcugguucaaaugaauuuggaaggaauggagacaaagauucuuuugcaugguuuaaaagagcaaguuauuuauagcaauuaucaaccuggcagcaaacucuuuccaggauguugaaaagaauuccaacuucacagguuuguuaugaggcucaaauuaguucacugauaagaaaguuguaaaacaaagccuuuaaaaacaaaggugucccaacauauagaaaaaaauggcugucugaguaaauuuuauggugcuccacacagccugacacauaguuauuucaaauguucuuaaauaaaccagacaauucugaacaaucuacugcuuuaaaacauaucuauuacaugaaagaugcuugcuagaaaugaaagugaaguaugcaaagguacucuaguucucagccaccaacuggcuuuaagaccuuaugacauucugggcuuccaacaugauguaaaauggaaguacaauaacuaagaucccuuaaagcacuaucuguaguacuuugccuucagucuaagacaaauguuaaauauuaaacaugaacaaucugaauuauuuucaaaaacuaaacagcuaaaaguaaccaugcuaguuuucuacuugccacaaauuccuagguuuuuaaaaaauaaaacuacacuucugcaaauaauucacuuuuaagcuaagaauauuuuuaaagaucaaauagacuuugccaggaagaaaaacaggagcuacuggcuaaccauuuggaugaaaauaaaaguacacaccuacuucacaccauuacuucagcauaaaaagcuuaacauaguauaaaaauacuuaacauaaguauauacuuaacacaguaauacuuaacuauaaugcuaaaagguguaaacuauuauuuuguuucaaucuuuuuaaaaauagcaaacauguuauaguuuaaaacaguugaaaaaaggaagggaaaauaagauggacuuagaaagcagcccuuuaauuugaaaaaguuuuacaagcaggaaauucagucucaucuacugauuuauagcauccauaaaugcaugaaaacacauggccaaaucgaacuguuccaugaaagagcuccaaguugaucucaugucagaaaguaguaacuacgguuaaaagggcaaagaaacugagcuuucuuuggauuuuugccuuucucacguugacuuucuacuuuaaaauuccccuauuuggggaguaacuuucucauaggaagaggaccacuuacuuuguauuucuacagaugacaccagauggcacauuuagaaauaaaguucaguuuuaaggagagauaaaacauagugaaaacaauacuggacuagguaaccuggguuugaugcucaauuucaccacuauccagccauguuaccauggauauguuauuacuccuacaacugggccuauaaaauaaggaguuugauauggauaauaggaaauauaggguaucauccagcuuuucuguuggacaugaagacuacccuuuuaaagcuguugguaauuugcuagagggagagaucugaauucacccauaaaagcagccugucuuuacuuuuuaaaagcaaaaaucuaaaauucucuacguaaaaggauaucuucuagugaugucugcaucucuccagacuauacuuccuuuuaaggcuggucucaccaagauauuuaaagaaauguaagaagccggggccuggacuccagauuggguuaacaaacugcaaagcccuccaaaguagaagagucaaacuagccccuggaaaaauauggcagcagauauguauaugucuauguauauacguguacguacguauauguauauacguguauauaugcagugagccaucuacaacgauacuggcuauauccagauuuauacucuucugauuuaucaaggcuuauccugaugugcuacaauauuguaaaucaugauggaucauauacuaaacauaucacagugaaaaaugcaagguuagccuuucuaaaggccaauuuagcaaugaguauuaaaagccuuacauuuuuacauuccgguuguagaaauuucuuaaggauauaaauauggaugucacgcaauggacuuuggggacucagggggaaaggaugggaaaggggugagggauaaaagacuauaaauuggguucaguguauacugcuccagugaugggugcaccaaaaucucacaaaucaccacuaaggaacuuacucauguaaccaaauaucaccuguuccccaaaaaccuauggaaauaaaaaauuaaaaauauuaaauauggaucucauaaauauuuaucuauuaggauguaccuaugcuucuuucauucgacacuuauuuacugaaugcugaauuaccuguauguuaggaggcauuacuuaaaaucaugagaaacugggacuggaaaagugugaacacagcaaacugguuaaauaaauucugcauacaauaaaauacaauguagccauuaaaaaugcuacagaagcugggcacaguggcucacgccuguaaucccaguacuuugggaggccgaggcgggcggaucacgaggucaggagaucgagaccauccuggcuaacacggugaaaccccgucucuacuaaaaauacaaaaaaaaauuagccgggcgagguggcaggcaccuguagucccagcuacucaaaaggcugaggcaggagaauggcgugaaccccggggggcggagccugcagugagccgagaucgcgccacugcacuccgaccugggcgacagcgagacuccgucucaaaaaaaaaaaaaaaaaaaaaaaaagcuacagaaguauacauaaugacagagacauggaacgggucaauacgugggaagagcaaauuuaacaauaccauuucuauacuaguuuggagaaaacagcuugaaaaaagacaguuuggggacaccugagggaaaaguaugaacacagcaaaaggugugaacaaagcaaacugguuaaauaaauucugcauacaauagaauacaauguagccauuaaaaaugcuacagaaguauacauaaugacaaagacaugaaacaggggucaauaugugggaagagcaaaguuaaaaauaccauuucuacacuaguuuggagaaaacagcuuggaaaaaaagacaguuuggggacaacugagaaaaugugaauaugaaccggauauuagauaauauuaagaaaaaauaaacucccuaggcgugauaaugguauugugguuuuguagauguccuuacuuuuuuuuuuuuuuuugagacagagucucacucugucgcccaggcuggaaugcaguggcgugaucucagcucacugcaaccuccgccuccuggguucaagugauucuccugccucagccucccgaguagcugggacuacaggugccaccacacccagcuaauuuuuuuauuuuuaguagaggcaggguuucaccauguuggccaggcuggucucgaacuccugaccucaaaugauccacccaccuuggccucccaaagugcucagauuacaggugugagccacugcgcccggcugagauguccucauucuuaagacaugcagcugaaagauuuaaggauaaagugucauccuuacuucuaauguugagaaaaauuaaacacacaucuguacauauaaaucuaauauggcaaauacuuaauuguuggauccagcugaugguauacagauguucauugugcuauguuuucagcauuuuuguuugaaauuuuucauacaaaauugaaagcuggaagggagguaaugaauuacauuuuaaaaagagcauuucugaaaaaauauauaauauggcuacagagcaguuaagaaaagccuucgaagaagauacugcauaccaaaauguuaagaguauuuuaucugugaguuugggguuugcggaaauuugucuguuuaucuguauuuuucaacaauaagccauguauaauucuacagucaugaagauuacuuaaaaacaaauucaggaaaacguuuucaaacaagaguuaacaagaaaaugagcaaacgaaaaaaaguucuauucccaaagcauucuuacuaaaaucagaaugcuucuuacaaacucuaaaauacuguacaaauuuaauauuauuuaauaauagguuuuuguguggccaccacaucgguuuugaacuuuuacuuacauucauaauuuauaccauucucacaguagaaaaauucaagcaauucauuguacugauuguaaggggggaagggaaugcuggguauuaaaaaaguaucuccuguuuaccuauacagguuaaguaucuccuauccagugcuugggaccagcaggauuucagauuucagauucuugaauaucugccuauacaucaugagacaucuugaggaugcggcucaaguuuaaacaugaaauccauucauguuccauacacaccuuauacauacagccugaagguaauuuuacacaauuucucguauaaauuuagguggcacaaguacaguucuguuacauggguauauugugcaguagugaagucuagacauuuaguguaaccaucacccaaauaauguucguuguacccuauacaauauuuuuaauaauucugcucaugaaacaaaguguuaaguacuuaggcguagaauuuuccacuuguggcaucguguugaaacucauuuuggggcauuuugaauuuuggauuagggacacucaacuuguguuacuuccaacuccacaaaaaaauguaaggcaaaaauaaauguuaaaaaugaucaauucuggaguggggguagggacagggauuguuguauuauucucuguacuucucaguauauuuuucagaaguagaaaugcacauauuacagaaaaagguaaaguuccccaugaucccuccucccaaauaaaguugucaguuugccaugguuuuuuuuaaaacauaaauagcaucacauaguauguacucucuugcaacuugccaaaauugccuccaaaauagcuguaucaauuuacgccacuuguaggcaguauuauaaggccagacucuuccuuauaccuuuuacgaugacuugauauuaucaaauuauuuuuuaucaaucuaaugacuaaaaaugaccuuauuuaaauuugcauuucugauuauuaguuugaguaccauuucuuguuaguggacguuuuuaguuuccuauucugggaaaugccuauccuuaaaauuuccuacuagauuucuuuucuuauuccuuaaacacuacccuuaucauuaagaugugaauacaccaaaauguuaacagugacuaaacauugugguggaauuauguauauccucuccccaaauaugcacacauuuucuaguuuuuccugaauucagugauuaaaaacuagaaaaugauaaaauggaugaaaaaaauccuuuuagacaaaagcauuaacuuucaggauacucuacuacagguuacccuuaaggaggucauaaaaucuagcucaaagaaauaaaugcaucuaaagaguaagucuugugaagaaaugaaacaauaaugguuugagacuauugauucauuugggguacguuuaacuaacuuauuuguauagcauuuuugaauucaugaaguacuuuucauuuaucuugcuuaacccuaacaaaacucugugacauucucugaugccuucuuguaaacugcuauagcacauuuuguucauuccucauauuaccauacugacccuuuugugugauuugcaagucuccuuccccuagaccacacuguccuacauucuccagucacuuaucuuuguauucccaggauguagcugcaaugacuacguccucaauaaauauuuguuaaaugaauaucaccaucuucauuuaaaggaugaggaaacuggcucagugaugagguaauuugccccaaguaacauagcuacuaaguauuuuauauaaauuauaaugaccuuaucuucguacuuuacaagcauuuaaaaauacaucaucucgcuuuaaugcucacagcaaccuaugaaauaggcuuuccgauuacuguuuuauagauaagaauggaaauuuagugauauacccuaggcccacucgaauccuaguuuauaugaaguacagcuguuucuuuacauuguacuugaucacuaccuggguaugggagccucuauuuuuauguaccaaguacauuaaggguaggguauaggggaggaaagauggaaguaaggcaguuuaaaggcacaggaaagaggcuggagcccagguguacaggcccaucuaaagaccauaaacugguauuguaaugucaacugcacaugccacucugaaauccaauauuggcccaaagguuuuucuugauauuacccuguauuaauagaagacaauuguuggcuuucucacauaucagcagucucaaaggcuggggaggcacacagaauuaggaaagcugugagaaacaauggacaggcuauaucaugcauagacagugcaggggaagaaaugaugacacaaaggaaaaggcuaaggaacuuuaaacaugauuucacaguccuuaacucgacugugaguuucucaagggcagagaccaagucucauucauuuuaugucccuuacuccuuauacuuagcaacauucaguaaauguuauguuaaaagaaaaaaaaagauauauuaagcuaaaaacugaacaaugacuuccauuuauucagcagcacuuauuacaugccacauacuauacuuuagauauuauguguaauguuuaaaaaaauaagauuuaccuguuugcugaccugccaugcauggugcugcccaaauguguuaacaguggugauacugaugacuauuaggaauacuuauuauagguuacuaagguuacaacagaaccuugaacaccuugaauaggaggggccaguauagacggagagagaucaagguaaccaauguaauacacauuacagaacuagcuaagacccuucagaggguauaaaugugacuccuaaggaguuccaaagugaaaaacuacucuauggaacauucaguuaucacuggccaaagucucagacccaaaauaacucaagaacaaacccuauccugccucaccacugaugaucccacacagaccuaaaggguccagacacauuuuguuaaauggccauuauuuucaccacccugacugcccaccucugagcuguugaaggaguuaaguaaaauaguacauuaaauaaauuaccaucuacugaucaccuaccauguacuaacaccuuacauuuucucuuuaauuccaauaaccauaugaauaagguauuuccccacaucauaacugauauagguuaacuugcccaaacugacagaccuaguaaguggccaggccccaaauccggaacugccugggcuccaugaucuuccuaugauuaucaaggcuucucaaaccuuuccaccuuaacucuaauaaaaagguagagaagaaugaagaggcaggcuagggagguuaaguggaaagagaaaaguggaacuugauagaaaguuccaagcuacccuuggcaaaaacagaauuucuuuugacuucaccuuuuaucuuaaucccauuagcuaauuccaggucuggggcagaaaugcacaagaaugcgccuggaaacaucuugacauaccagauagcaaggaagcuaucaaagacuacuagagagcaugucaguaagaaucaggagccaacuuuaagagaguuccacuagccacaagaagggcaauuugaacuucgcuaaggaucagaacugcaauguauugaaacccaucaaauguuuacaucuauggaugcauaguuauauauacacuuauauguguaaccuuuugaagaugacaggggaccaauucaucaucuugaaagcaauguuuuaaaaaauugaguauuuauccugcucuuccuauauaaacuauauugcugaguaaccaaauaaaagaugaggggaaacaaaauuauuccagcuaacagaugaaaacaaaaugauagcaucagaacgucaccauuuuguagccccccaacaaauuaauggauccaaaaaauucaagucaucguaacauaaucaauguugugaaugaacacccccccaccccacccccccgcaauauauuugccaaagggaacgaaccugaaauuuaucaagucucuggauccagcugccaauuugcaggaaauagagaaguaucaccugggaacuuaucagaaaugcaaaaucuggggccccuccuagaucuacagaaucagaaacucugggaguggggaccagccaaucuuuuaggaaguccucuaggugauucugauguucccuaaaguuucagaaccauuguucuaagcacuuuauaugcauuaacucagcuaaauuucuucagaacucuauaaggcaggcaguauuaucaucauuuuacagaugaaggaccguguggcacaaagcaguuaaguaauuugcacaacaugacacaccugguaagaaaugggagucagaacuugaacucugugaaucuagcuccagaguccauguucuuaaucgcugugcugaaaggucuuuccaccuguaagaacucaauugucagaaugccguaauaaagaauauuggaaguuuaaaaaaaaaaaaaaaaaaagcaaagaccaggagaaacaugccucacuauaaaauagacaggaauauaagaaaauaaucauagcaaauaauguacccaaaguaaucuuccaaaaucauuccaaaacauuaacagccaccaaauguaauauacccacgcacuucuggggcaauuaucucugauaucuaaucacaaggaccuaaaaccuggauugugcuaaaggugguacauaaauucaugacaguauccucagacucaucaaucuuuuaaaucuaaaugguuauagugaaaggucauuccagaauaauucaucucccuacuuuuagucaccauuuacuuaaugacuacugaaaggaaaaacugcugucuuucaauaccuaagauuauaccaucagaaucucagaguugaagaauuuuaacauucaucuaguucaaucagcaauccagacugaaucagaucuacaaucccaaucuccacguaaugguacauucauaauaaauuaaaacauuccaacuuucuguaaaaucacauuaugggaucauucuaugccaccaacuguaauuuuuaaagccaaaugacuaaaaacuuuuaaagagaacuuaaaaguugaaaaugcucagguuaacagcccaaacaaaaccuacaguuguuuuacucauagagccacuucuucacuaccugaaaggauuucuauauccagaagaccaagcuggucaacaaguacaucaaguuuuaacaacaccaccuaugaaacaucaaacgacuuaaaaguugaguuauuccugacauuaacauauauaaacaucuaguaaccagucguugaggaaacaacgaauaauacagcaaaacaccaaaagcccaaguacuuaugaauaucaaccuuauagauagugagaucaucauaaagcagccuaaaaguccuuaaaggacuuuaugcuaaggaaacauaaauuucagaugaaaugaaaugaaaaaucacaguaggaaaacuaagguuguguauaauagcugaaaaucaacauguaaguagaagcucucaaaaacuguuuuaguauugccauuucaagaacuguaugacagccaggaacucauuauuaggucuuaauagcuuagaaguuaugggucagaacagcugagacacuaacaucaaaagaauaaaaagcaacauuauaaaguaguauaaaaauaacuaaaucaccuaaggaaauugaaaccaugcaugaaaaaccccaaaggcacaaucaggucauuaggaaacacuagcuucuuccaccaggaggccuacuuuucauguggagcaaugagcaaggccaagacauggaacugaagucagguaucaaaucagacuuugccacagaaaaaggaauccaugacuaguuauuuuaggauagugccuaugacagcacuaucaacuccaacuaggauacaggagauuauagccauuguuccauuauaauggguccuccagggucuuuaauugagcaagaauggguuagacaccacuacugggcuguaauccccaaauauggggggcgggaaacuauauauaggacaauuucuucaacaaauaaauuggaagaaaaaaaaaacaaaagacagaaccugcagauuaaaauagauuuaacagcuguaucaaugcuuugcaauaaaugugcuuucucaggauccugauucaaacaaacuguaaaagaaaaaaaacaaagcuuaaaaaaaaaucagaaaucugaacauuuuauauuugauauuuuuaaauaucuguuaauuuuuucaguugugauaauaguuuugaucuuauauuuaaagagcccuugccuuuuagaaauacaaacaaguauuuuacaaauaaauaugacagggauuuauuccaauauaauccauugaggggggcagugguuagaaguauagaugaaacaggcugggccugguggcucacgccuguaaucccaacacuuugggaggccaagaagggaggauggcuugagcccaggaguuugugaccagucuaggcaacacgaugaaaccccaucucaauuuaaaaaaauuaaaaaaaaccaaacaaacagaaguauagaugaaauagaaugugcaaguugauacuauuaaagcuggugauggguaaguggggggauuauuauacuauucaauguuugcauguuugaaauuuuucguaacuuuaauaagaacugguuagacauaaugacuugcaauuuuauuuuuugaacgaugccuagggugauuuaaaaaaucauguacagacaucauucauuuaaacaauucccuuuaauucaguaaugagcuccacuuuaaaaaaagaagcaaccaguaccacaucagauccagagaauggaagaaaccaaaguagcuccauuacagaaugggaauacauccaccccuacuaucuccauuccaggaaguaaaauacaaauacuucccacaagauuuacaaaaacuaaccuaaaaucacagccaaucauacucauccuggugggaaauuccccacacugcuccaacagcuucccgaaccuuccugaccaaguuggccugcugguuucucuggaucacuaacccacucaggucaggcugcuggaggaccuacaaaaaaaaaguugggggagaggagugagauacacaacacauuuauuagggugugugaggaggguuaaccauucuauuauguucaaacauaacuaguuauuauuucuaaagcaauaguccuuacauaucuauuugcauuuuuuaggaccugcuuugagaaguaacugaggaauucagaaccaacaacucuaauacuucuaacgcuuagacaacauuccugaaaacugaguucucaacccaaaugaaauuauagaagacaguuuauuuuuuagacaaguuuauacccucaauauaaacacuaaggacguauuuguuucauuguuucugugaaaaaaaacaacaacuguacauauaaaaauuauucuucaccuucauacaugcuuuuuggccauauugggagacaaacgauaaacauccuggcaacucagguugaacuuugccauugaaccuuagacaaaguuuuuauuugguauugucacuccuuccucucuucucagagaucuaccuagaauaaguuaaacuuuuaggucacaccuagauuaucauucccagauuuauucuauugcucaauaagggucaaauugaaauugagguuuaauaaauuugugaucacugcuuaacccacgguaaaaugcaccaaugcaaaaucucaaaacagaaagugauuuccugcccuccaaugaaaauggaagaaaauuuuauuaccuacaaagcacuucaaauuaaauaaagcagacccugaaguucgaaacuagaguccacauacagcuaauugugggaugguuaccuccuguaaauuuuaaauccuaguaaacuuuucaccacguuucuacuucaauucccaucacccagccgaaguaaaauaauggggauaguugugcuuguauuaaaggguuguugcuagaauuaguuaaaaaaaaaauuguaaaaugcuacacuuuaauauuggucuaaucaauauauuaacaguaaggaagccuguaaucucagcacuuugggaggccgaggcgggcggaucacgaggucaggagaucgagaccauccuggccaacguggugaaacuccgucuuuacuaaaaauacaaaaauuagcugggcaugguggcgcgcgccuguagucccagcuacucgggaggcugaggcagguaaaucgcuugaacccaggaggcggagguugcagugagccgagaucgcgccacugcacuccagccuggcgagagcaagacuccaucuuaaaaaaaaaaaaaaaaaaguaaggaaaacuuucuccaagucaaauagucacaucuguuuaauaaguacguuagaaaauauaaaauggcaauaacacaacaggaaguaguguauuaaagagccagcaguaauuugcuauggaaaagaagcuggguauuccaaaugaucuuucucucucggacaggaauuaucuugcucagguaagaagaugccaaauagcagauccccacacugaucugaggaaccaaacaaaugagggaggugaaaaguagcaugaauacuucaaaacuagcuaacagaaguuccuuuuaccacugugaaaugcaugacaccaaauuacuuuuguagagugaaugacaggacagacugccuuugaaggaguggaagaaaugaguaggcagggcaugaggcaccccuuccaaaagguagaacacuugggugugguucuugacaggaacauuauggcugguggucauuccaggauagugauuacgcacugaaauuccuagaccauuagaaggaaacaaagagugggaaucacguucaaacaucaugaaccacuggagauaaaaaguuuggccuaugaggaaaaaaaauauaaacguuauagaucuggccuagaaauacaccaagaauguacaguuaaagaaacaaaaaucucuuacucuuucccaggucauaaaauuagcauaugacacagguacaucuaccaaugcauucuuacaccaaaaaguaauccuaauuuauuaugugccuaccaugagcuaaacauuuuauuuuauuuuauuuuaacuaauucuagcaacaauccucuaauguaagcacaacuauucccauuauauagaugaacugagaaucugaaaauuugcccaaggucacaagguucaaugugaacccaaaacacacccaaaacacacacuauuaauuucaccauaccagaccgccgccuaugacuggggaauguugguaucuccucaaucuaugcaacacuggggcuaaaagaaaacaaugcugaacauguaaucuacaaaggagaaacaaaugauagggaauuaacugccuauaguaacgguggcauggggggaagaggaaauaaagaacagggcagacuggggggcaggacaaucaaugcuguuuucuaguaaauggaagggguaaaauguaguggagccugagaggaggguuaucuuccuucuaagggauucagcuccuggaaaaggaguauggggagugggggauagaaagauuaagaagugagaagcagguaagaggugcucagcagcaaaaauagauguccacagaccaagaggcuccagaaacucagagcaaggcagggaaaaggggcgguucccaggcuugcaggggaaauggaagaggcagggaagacagaaagcggguuuacuggagaguuauccucuacagccuucugagggggaggaaugaggaaggcaaggcuaauggccguaaacgaaaaggccacuuaaacugcaauauccaaacaccgacccguucauaguuucgcuuaauagugguuuagcagcaugcagagcuaagaaauccggaucagagucauacaaacaugaagacuuaaggaaauggaaggcuacuauggcaccauccacaaagauggaguaaaugcaggcaacaggauaagcucuauucaacgccugcgccaaggggaccaauggaagggggagacagagcgggcuagaggacuuaggcuaaacucgaauuuagaacuggggaaggagucacagggaaaagcuuugacuccccccucccuuaaauaccagccucaacuauccacguagaugaagauuagaugggacgacagaauuaggagggguguggggagaggaggaggaguacaccagugacacuacugcuugaacccuaagccuuagcucuaaaaccgcgagaguuggcgaagaugaccccaccucgagaaaaaccaggguauucauccgggucgucggaggugcugagaacggagguuggccggcagaaaagguaggggaaaggggccacucuucauugguugcuccucuuucccaccguucaauuuaacccccaaccccacuccccagcgaacuccagacuccccucccacccuucccaauccgcccacugcggcggcgacaacggaggcguugaccgaucgguggggcaaaggcgggcccacacgcggccgaggcccaggaaauggugucgccucaacggacaagaaacgagguggucuucgccucaggucuaguuuaccggcaccccggcguuucgccaaucgucaccuccuuaacgcugggcaccucagaggcgucauaaaggcagauagccaacaccucugugcuggguccuggccggacagacaucagccuccgccgccaucuuaacagcaggcggaccgacccuagucacugcccccccaccccccacccgcgagcuaccucagccaccgccaacgaaucccacgaggacguaacccugcucccgcgagaauucuccggcuuagaacggcacgagccgaagaccuugccgccgccuccgcggcuacugcagucaguaaccgagccaccgccgccuccgcgcgaucccgcgagaaccucuaccggacgggaaaagccugagcccagcccuuuccagaccccuccucccucccaccaaagccgaaguagcuacagcuucacccuacgcgaagcgaaaagcaaaugacgcacaaccuaacgaagcagugaggggcggagccaaccuaccacggccggcucccgcaugcguugagaacuaucgcgauauuacgcuuuagccucggcgagaccuucuuaauucaccgcaggaugccgcccgcgccucgccuuuaggaaacaugagauaucgcgagaccuggugcacacuccuaaaaaggagaaaggcggagcuucaugaaaaugacugggaguuuuucgggggaagggaggaacccucccguccugcagggaucucgccuaccacgagguuuccgacccacugcggagcuggcugccaaaccucgcgaugacacagcucagcgccaaaucucggccauguccugaaaacugccuccgcccccgaucuaggugucuagagccuagugcuugaggaaaauuuaaaaagucaaccuguuuauucucacgcuuccgggcaaggcuguaccaauuagccaaacuccauucuggaagcggagcaaagagucccccauuguuaccugucuccaggaauaacauauuauccuggacuaacauuuaaaagacguucaaucucacaguaagcacacaaaugcaaaugaaaacaaugacauaacauuuuuugcccauuagauagggaaaaaaauuuuuaaaccuacauuauccagacuccuucccucgccgcacugcaggcuaaccugaauccaucuuaaucuaacuaaaggccauaucauuaguucuaguuccaaagccaccaauuuuaacuacugaagcuuuaccuuggcauaaccaaaaagauccaauaaagugguuuucuccaaacaaaggagucugcccucaaaggaauauucaagcuucggggauggggggaaaugccugaagcuuuuaauauggcaguuuuuccacgucuagccaacaguguuucuccaauaaaucuugggauccaaucuggcuugauuugugggcuuuuccauucuaaugcauuguucuguccguucuaauuuaaauaguuccuuuagaguacauuuuaauagccaguaguacaaauaucccuaucuuuacuuacguuuuaaaauauuuuuuuucaguuauucuuagccauuuuuuucccccggaugaacuuuagaaucauaguaaguuccaaaaaaacuugguauauuuauugaaauugcaucaacuguauaaaccaauauaggaaaaauggacaucacuaaaauauugagccuucuuauucagaagcauaguauuccuucucuuuucaugcagauguucuuuuaugguauucgucaauaaaguuuuauaguuuacuucuagguauuuuuauucguuucucuugcuauugcgaacagguuuuuuauuauuaaaauuucaaaaugcuuauugcuuauagauaggaaaacugccuauauaaacuauugauauuugccuauuuacaaacaaaaauaugaucaauuucgccaguaaucagggaaaugcaaaugaaaacaaugacauacgauuuuuuugcccuuuaaauuggcuaaaauuacaaagauugauaauacguguuggcauaacuguggaaaaauaggcacucucgcacaacauuaaagaguguaaauuaguacaggcuuuugggaaggcaauuuggacaaaucuaucaaaauucaaaaugcauauacacccugacccagcgguuacucuucuaagaauuucuccuacagaaauacucauacauggcaugauacauauacacaaacccauucauuauggcauugcuuguaauaguccccucccucccccaacagagaaacaagcuaauguauaucaaucgggaaaugguuaaauaaacuguaguacaaucauacaaugcagcuguuuaaaacccaacauaaauuuggauucccggauauaagaagaucuacaagacauauucucagauuuuuaaacaagcaguuagucgaaaugaauguguguguguguguaguaccauuuagauaucaaaacauauauaugcaacgccuaguaguuacccgcgaagccugccugcccgccccucaccuucccucuccucugaggccgccuuccucgaaccagugagaaacgcugaaggcccggccucuacucucucuuuagggccacuuggccauggcuaaugccgguaccucgcauccccucugucagccgcucucucgccgcgccgccggcagcugccgggcugcccccgaagaugcggcuagcucuccgcuggcgccugccgaggccugggggaggggagaggaggcgggguucagggaggguuggggcaggccgccaugccccuccagcagccuuucccgcaggcuccccaaggccgccaccuccgcgccuccgcgcagggucccgugggaacuccccccccaaccucgccacugccacccgcgagaaaccgagaacggccgcgcguacagagcucgcccuccagcccagggauagacgcucaccucggccgcaauggcuccgcggggcccgcaggagcgugcgggguccgcggcccugcuucagcccugcuccagcccugcuccagcccugcuccagcccugcuccagccgugcuccccucgcuagcccucagucgaaagccuc

SEQ ID NO: 192862 - RNA, 3118 nt, Homo sapiens
cucugugagaaaaagagacuuuauuaggcacagagggcgacugguaggcaguuacaaaauggcuacugggcuuccucccaagcuggagaguaguaccccagggaaaggaagggcagaggagcguguguuuucucugccuucucccuucaaggcugcauacgaauggccccauccagccggaugaccucuccauugaggaauggguucucgaugauggccuguacgaggugagcauacucagcagggucacccagucggcuagggaagggcacuuggcuggccaagaaguugcacacuuucucugggaggcuggucagcaguggggugccaaacagaccuaaacaauauagccaaauucagagacucacccuugcuuucaugauuaccugguucuuccuuacuuuagcccuacuucuuggugcuucucuggggcccaaagauaaaaggcugcugcugcuuaggugguggauaccuuccccucucaacuguccauggaucccacccaaucccagguaugauggagagaggggauaugucuaccuggggcaauggucaucacccggauaccuaugggagccagaucccgagcaaugggcagugucaugcccacuauuccccccuuggaagcagaguaugcagcuuguccaaccuggagaaagaguagaagucauaggugggagggccccaacaagucacuuaggaggcauaagucuuaccccugcccacacaccugacccucgaaggcagccacacuggcaguguugaugaugaccccacguuggccucccuggucugguucauucuggcccaucucaccagccaccaggcggaucacauugaaggugcccaugagauucaccuguaggacagauggagacaugcuauaggaccugaggcagaagaagccuuuguccccuaaaaacuuugggguccuccacagccagauacuucuuacuaccacuaucccuggagaacuuccaaggccuuacaucaagaacucgcuggaagucuuccaagguaugggucuggcccuucuuuaaguuguacgucuugcuagccaccgcgaugccugcacaguugacagcuacauccacacggccaaacuuuccuuuugcuagagccagagcuguuugcacauccuucucagaggucaccuucaaagagagaaguggagaagguauucaucucccagcacccacucuucccacuaaaccugagggagggcagggcagggcaugcccaguccuugggugagaagagauuugugagaagggagaggccaagagaaagguuguaaaacuugagagauaggcugggugcgguggcucaugccuguaaucucagcacuuugggaggccgaggcugguggaucacuuaagaucaggaguuugagaccagccuggccaacguggugaaaacccgucucuacuaaaaauacaaaauuagccggcauagugacacaugccuguaaucccagcuacuuggaaggcugaggcagaagaaucgcuugaacccgggaggcagagguugcagugagcugagaucgugccauugcacugcagccugggcaacagugagacucugucccaaaaaaaaaaauugagagaguaggucaaaggugaaaauauuagguaauauagagcaguguugcaaaacauuuuucaaaucaauaccuucuugauaaauucacaugcuccugaagauucuuaauugcuguggaucagagcacuaaugcaacccuguugugaggcugggugcaguggcucacaccuguaaucccagcacuuugggaggccgaggcgggcggaucacgugagaucaggaguucaagaccagcccggccaacauggugaaaccccaucucuucuaaaaauacaaaaaaaaaaauuagcugggcgugguggcaggugccuguaaucccagcuacuugggagguugaggcaggaaaaucgcuugaacccagaagauggagguugcaaggagcugagauugugccacugcacuccagccugggcaacagagcgagacuccaucucaaaaauaaaaauaaaaaauaacccucuugugagaauuauugauaggaagauaaacuagcuuuuuuguauccuuaccugcuaagaugauuucaucaaguuucacuuucuguaguuuguuucaugaaaacaaguuuuuugacuuuguaaauauaaaauuacaaggcacaaaaugcauuuucaaaccauacauaacuccuccaggagauuguuacguccaauccccauccucauuguugugaaucccagcuuuagagaauccuuaucacagguggucccacagugcuugaaggcucaggccaaaagagacaaggagaugggucuaccgcccccauagaggagacccuuaugggagggacccccacagguucccaggccgguguuggugaccucaugcacacccugggagaggagaggugaccccacuuacgucggcuggggcgaaaacgcaguuguuuccuaacuucuuggcuugggccuccccacccgaguugggcagguccagaagcacagcagaggcucccugccccacaagucgcuccgccguggccaggcccaggcccgaggcuccuccgguuauuaccgccaccaggcccugucaaaagggacauggucagggucagcuguuacauugcccagaccauccccacgcugucgccugccuguucuccaggcuucugaggagaaggggggaggggagaggucguggucaccccugcggguaaacuaggugugcugcuucuccucagcguugggaccucgggggcagaagggaucucauccccagacagcccgucccgugacgauagauagauagaugauugauagauagauagauagacagacagacagacagacagaugcgccgcggagugcugacuuucaccucuugagcccaacggccacaauaccaggccuacauaagcaugacccuuucccucgaaaccgaucucuuucuccuaguuccacggccgcgcugucccggcccguaaaggaaggcaagcaacagaggcaaagaaccuucuaccuucacgcuccgacacgcugcugccaucuugucgccggccacuccacgggauggggau

SEQ ID NO: 192863 - RNA, 31291 nt, Homo sapiens
auuuagaccagcccggcuguauccacggcaacagaagcaggagugucacuggccgccagaucacugagggucccacaauguggcccgggcugugauuuaccugggugagacagcuugagccccaucguggauuccaagacaucccugcugagagagccaagguaagcagucagcaucccuccaccaaggauggggggcugggacuucuguucugucuccccacacauacuucagagucuccaucacugccaugcucucugucucugucugacucuguuagucucuuucugcuccaucaaggggcuccuugguacccaagccuggggacuccucaucuuccccccaucuuccccaaucccaaaugucccaugagaaagggaaccaccaccuguuuccccucacagggucuguuuuuaucaucaugguugcguuugggcaugaggcuguguuaaucuuuccuugugugcuggcuguggaagggaugccugggagcccggcggccguguucccuucacaaugccugcacccugggcaggcucagccucuugcggcugcuccucucccucucccuccuccuccacucuccuccaggaucccuggccugcuggccgggugugugugugugugugugugugugugugugugugugugugcaccuggguagcaagcagguggguagacaugacagagaagcugcucccagcccagaccaucccccacuccuucuuuccuccuuuccuuccuuccuuccuuccacccuccccaccuccccaucucucccuacagguagcagaguuuugcucacucaccacugaagauguugccgauucccagcuagggggaggaagucacuguagggcuaaaggacagugaaguggugguggggagcacuuccaggcccuaggcugccugaugguucugugggggcaaagaccaaucccaugacaaccugcaggggccaggaacaacaugguugucccuacagugugggacccagccuccaccacaaggcucucugucucuguuucagauguccauguugugucugagaccccccggaucuuguggccuugugcccaguagccggagguccauauaucuggaagggcaggaaagccugguacauggagaacauggauccucccagggacacuucccccaacuacuagcucugcaacuuuaguggaagcaugccacuuaccgaaccucaguuuucccaucugucaaagagacugguaacccuucccugauggguguguguagggauugaaugaguuggugcauguaaguaagagaugugcaucgagguggcacugaagcaaugucagcaaagcucacagucaauauuguugcugauuauucaugauuaauaguguuaucgauuacuuggaggagggacagguccuucuucuccagggucucagcagagaucuggggagggcagcaagugggcaaauggaggguaguggaagggaggcaggagaagcccuguguuaauacuucucauuuguagagaaugauaagugguuaugggcagagccucccucccccaccccacuccagucuucuuucccugcacuugucccuguuugugcgcacacacacacacagaaccuugagcccccaugagccagcagaggccuggcuugcagccugcagccuuucuggcccuggugauguaugugucucccuguugaggggagacuuggcaagaguuuggccuguggucagugguuggcagggccuggagaugaggcugaagcuccugagaucacggggcuucggguagagcugggguguggcccaugcagcagccagaccugugagggacgcgucccagggagcugcucaccuagagccuggggugggggaagaacggggucugcuggcugauuucagggcauggagaugugaugggacacagaguguggggucgguggccaagggaagaggaggaauggggaaagacugaggcccagaagaccaucucugugggggcagggaggggggcuuugaggcauaaaguagacuuuucugaagaagcauuuggugugggagaggaccuggucuguggucuggaggccucugggcccgagcgugguuguauauaugcuacugaaaauguguggcugaguguguagucugugugugcaugucuguucaugggcaguguggcuguguaugaaccuguguguguaagcaggccgugugauggcaugugugugaguguguggguaucuggguaggcuuguguguguacuguggggugggcaugacuuugcaugucugucugggugaucaaauggacauguuugauuuugagccugaguguggguguguuuucucugagccaucaggccuguugaaugucuaguuguauauguguguggcaucaguuuuucuuugaguguacgugucugguuguauguguaugaguguguggguuucagaaugccugggugugcaugcccaauuagaugaaugccuaguuguaucugcuugugcauauuggugugugcucaugaguguaggugcaucuaaagggugugcuugugaguguuaagggcauauaugugcauguccaugcauguaugagaggguguauauguguguguguauauaugaguguaucuguccugcauuuguguaagcaggcuuuugacuuucugugaaugucuguauguggguucuccagcauuuuaaauuauauagauguccgugugugcauguuccaguguauaucaccuguagacaaaccuuuauguccacauccgauuagagaaauguuaauauaggugggcacacuaauauaaggagaacuaauuuuauggguaggggagagugugugaaugaaaaucuauuuuguggguaugccuacaugugcacauuugauuauguaugugaguauggcuguguguggggguguaugccugucugcacacaaaaacacacacacacgcaaaaugcugugugcauaggugaaaugaugcauugucuauaugucuaauuguguuuguguguacacuguuaugugugaguacaugucuguggcgugcaugaguagguacuugggugugcaugucucauuauguguuuugucugaauuucugaguaugugagugugaauguguauuugaauaugccugugauugugaguguauauguggguguauaugcuaguaggugugaacaucuggcuguguguguuucauugaacaugucuguauaugccugccuguccauacacauauguccacacacaucuguccacacacacacgugugugugugugugugugugugugugugugaauaugccuguguguaugccuguacauucagacaggcauacacagagguauauucauaugugugaaugugccaguuuguacaguucuaauuauuugcauguauguguuuguguuuaugcaucuuuguucuggagcauauguuguagaacacaauguaagguaacguccaugcaugucacucucagccuacaaguguguuuaagugugugugugugaggaugugugugaggaugugugugugucugugaugaguguggaucaguccuucuuguauggauguacaguugugugcaugugaguguacuuccauguguacaugugugugaauauaccuuuguguccaaguccaucugugagaauguagguguaaaugauuccucuuuauuguguagcuucucauauggguguaugaacuuguaggaauguacaugguguacauaucuggcugugauagugugggcauguuuugugaguacauuuguauuuccaugucugaguguaagcauaugggaaugaauuaaugaacaagucuaugugcaugugaacaugcccaguuguguguacaagucuguguuaggaaugucugcauaucuauacuucaugucauuuacaagcaugugcauaucuagguguuuaugugugugaguguguaaauauauguggucaugucugggugugugugugcacacauuugggagcuucccugucuguguccauguuuguucaucaucuccuugggugugauacaaagucugucugucuguggacaugugaagguaugccuguauguaccccuguguuugugagugaauguacgucauucaugggcauuaugucaugugaauguaugucacgcaugcgugccuauguuuaagaguaaauggauguacacguaugacuaaguacagugugaguguguccauguguaaggaugaguguagguauuugugcaugugucugucagucgaugugagagagagauacuuggccuugggccugugcggauugggccuuauugacaaggggauggaaagggagaauacuuacaagucuguguaccucaguauguauuuguguguaugacugagagucaguggugcccugcgagacuaugucugucuguaaguguguagacauccugcagauuggcaaacuaugacaccugaugccugugacccccauucuggggcuucucuggccuugaccauguacugggcuuuugugggggucucaggauaauuccugucauuauucacacucaagaagugggcaccaaucauggcugauguccuacuggggaaaagaggccuauuuagaaaaagauuccuugaaacacaaagaccucccuucucauccccccaaccaucaaaggcccagaguagaguggcauuguaugauaucuaggguugguaaauaguuuucacugagaggacccaaauuaugccauccaggcagaaaucuagaugugaguguguauauauaaaagugaaaguaucuuaauagaguguguguguauguguguguguguguguguagacugguauaucuggugagagagaaaggauguggucugcauguguguaagagagagcaugggccgggugcgguggcucaugccuguaaucccagcacuuugggaggccaaggcggguggaucuccuaaggucaggaguuugagaccagccugaccaguauggugaaaccccaucucuacuaaaaauacaacugggcgugguggugcaugccuguagucccagcuacuugggaggcugagacaggagaauugcuugaacccaggagguggagguugcagugagcccagaucaugccacugcacuccagccugggcgacagagcgagacuccaucuaaaaaaaaaaaaaagagagagagagcacauggguguauggguguuucuggguagggugugcgugugaggcauuuggguguguuugggauugggggggugagugugguuguauguaaaguggccuguguguguggaggaugguaugagugagaguuggguuggggauaugggugaggauguguguauuugaggggugugugaguauggguuuaucuggauggugagauagggugggggauaccuggguggcguauguguuugcugguguggcugugucuguacuguguguguaagagaguguggguguuuccuggguggaguauguauaugagggaguauggguauauuggggucagggagauccaagugugguuauauguggaugauaugucaguaggugagagcacaaguguaucuaggcaauggaagugugugauaggguguauugugauggugugcaugagaaagagaauuugggcacaucugggugaggguggggguguauauaauugggggugucuauggaguguguguauggguggugugugugagacaguauggauguaucugcauugugugugugcagugugaguagaucuggcugauggugauuaagagagaauugggggucgagauuguguuugugugugagaguggggguguuucugagugugguaggggugugagcacgcaugucuccugugggaagagcauguauguguaucuggaugaggugugagaguuuggguuuaacuggguuggaggagaguguggauguauccagauggugugugaaagagaaaguguguagguacguuugggcugugugugagacaguguguggauguauuggggguggaguggguuugaauguggguguaucuggaugguaggugagugagagcacggauauauuugggugauggaguguguaguaagguaugucuggauggcguguggugagagcuuugguuguaucuggguggagagugcaggcguauacguacuuggguguggaugugaauguguauaacuggauggguuguguaaaagagaguugggggcacagcugagugggaaguguguguauggagugugggugcuugugggugguguggaggagaugagagcauggguggaucuggggaguggggcgugugcagaggugcacuggauggcaugugugagaguuggauauguccagguggguuguguguggauguaguuauaccuggguggugcauguggcuuugaguggaucuccauggucuauaugggaugaaucuggaugaugauauaugagaggguggaugugucugcauggggcugugagaguggggcuguauuuggagugugcgugugcuguaagaguggggcuguauuuggaguguguguguguguguguguguguguauggguaugagaaugaugugugugucuguguguguggauguauuuggcuugggaauuugugagugugaguaauuggaugggguguggguaaguguagugccuuuggaagguaugugugucauugugggugugucuuaauacugugugugagagagagagagauuguaggugugccugguucagguaugagggcucugaguuggggugggguacaaguuugaauguaucugugugauguuugugagaguguggguguacugaauugggaguuugcauaaguguggagggccugugcguguaagugcauuugagaugcguguauaugagaacgggaguauuuagaugggauuugugugagaggguguggguguaucaguguuggguauauguaugaaaguagguguauuugaggagaaugugggcacaucugaguuggaguaugugagagcgugggguauaucuaagaccgcgaagaccuauaggaugugagcagggcucagccuaugucugaacgucuacauggcuaugaaucaggauguguauaucuaaauaggaugugucaucucuggguggugugagagugugugggugugugugugagugugagugaaucuggggggugugcauguggcugcauccggccacaugugugaguauguggccagcaugugaguaugaggauagcaugugugaguauuugggugaggaauauaucugagaaugugaguguaucugugugugaguguguaggugguauaucuggagguuuuguguguucaauaaugugguuuuuucuggguagggugugugauugugggcauguguaugaauguguauauauuucccggggcauauauaucucugcuggaaugucuguaaaugugaacguguccauguuuguuuauguaugugacuaggugcguguggccauuuauaccuuaguguaucagcuggauugggugugcacauacuugugcuaaagugguauguaucuguacuugugcaugaggugaguguauuucuacauguaaguuggaucugcaaggucucuggaggcagccuuuguguucgaauccuaguucugccauuuauuagcuguauggcuuugggcaagucaccuaagcucaacaaagccccauugucuuaucuguaaaagugggaguacuauuaccuaucucauaggaugaggauugggugaguuauaugaaaagcacuuagaggcuggacgcguuggcucacgccuguaaucucagcacuuugggaggcugaggcaggcagaucacuugaggucaggaguucgagaccagccugaccaauguggugaaacccugucucuacuaaaaauacaaaaauuagccggguaugguggcacacgccuguaaucccagcuacucgggaggcugaggcaggagaaucacuugaacccgggagguggagguugcagugagcugagaucaugccauugcacuccagccuaggcaacaagagugaaacuccaucucaaaaaaaaaaaaaaagaaagaaagaaaaagaaaaaaaguggcugggcaugguggcucacaccuguaaucccagcacuuugggagccgaggugggcggaucaccugaguucgggaguucgagaccagccugaccaacauggagaaaccccaucucuacuaaaaaaaaaaaaaaaccacacacacaaaauuagccaggcgugguggcgcaugccuguaauaccagcuacucaggaagcugaggcaggagugucacuugaacccgggagguggagguugcagugagcugagaucgugccauugcacuccagccugggcaacaagagugaaacuccgucucaaaaaagagaaaaagaaaagaaaagaaaaagaaacagaaggaaaagaaagaaagagaaaagaaaagaaaagcacuucaaacagugccuggcauguaaugaguccucugcaccauauaagccauuacguacuaccauaauuauuagccaugccaguguguaauaguauguguccaucugcaagugugaaugggguuucuaugugcauauuugcccuguuaucuguaucuauacgucugugugacagaaugagcauauccuauguguaucuauguuuguacaugaaaguggguuuguacuucuguguaucccagugugcauauaaaaccacgagcaugugagaaaggaagcaugugucccgggcgugaauggaggggguuggccccguguguauauuuaccagugcacacacaucuggguguaugagugcacaugccuguaucugugguaguguaaugucugugagugugggugugaccugcacugcuggugugucugcacaugugagcaugcuucuaucugggugugugcaugccaguguauuuuuaucugccuauguaaacagguuuguaggggucaauauguaaacguauguaugugaaucucuguugugagagccuauaaaugucaaaagguugguauccagguuuauaugcgaugauccaggugcacguguguguguguguguguguguguguguguguguguauguaaagggcuagugugcaucugagggucucucuguauuuauaaaccucaguggcuauguggguguguaugauugagucugcauugcucuacaugccugcuugccuuuguguguguguagcagugaggcugagccaugugcuuguaugcgugagcaggucuguacuauguguauauggauguguuccagggcagauuugugagaguggcuuuguauaauaauagaguggguuuuaaucucuuaguguaagaaccagugggguggggcacgggagggccuggaucuauauaggaugugagcaggacuugaccuaugucuucuuaugucugcgcauguaacacuguaucuguaaguguguagguucauguaguuugguucauauguauguauguauguaagugccuauguaaauggcgaacgcauuucgccuagaccuguauuccuuuuuuuuuuuucguagaagaaagacuauuaagaaggcuuugaaguuaaaaaauaaaacucuaggccgagcgcgguggcugacgccuguaaucccagcacuuugggaggccgaggcgggcggaucacgaggucaggagaucaagaccauccuggcuaacauggugaaaccccgucucuacuaaaaauacaacaaauuagccgggcgugguggcaggcgccuguagucccagcuacucgggaggcuaaggcaggagaauggcgugaaccugggaggcagagcuugcagugagcugagaucgcgcaacugcacuccagccugggcaacagagcaagacuccgucucaaaaaauaaaaaauaaaauaaaauaaaauaaaaauaaaacucucaauacaauuuuugugugugacacagggucucacucugucgcccaggcuggagugcaguggcccggucucagcucacugcaaccuccgccuccaugccgggcuaauuuuuguuaaauacaauuuuuuaaccuuaaaucagcucaacaaauauauaaucagcaauuuagcuguauaagauuaaagauccauuacuuuaucuuaaauaaaauauguuuuaggccagguguggugacucacaccuguaauccuagcacuuugggaggucaaggugggcggauugcuugagcccaggaguuugagaccagccugagcaacauggcgaaaccccaccucuacaaaaaauauaaaaauuagccagguguaguggugugcaccuauagucccagcuacucaggaggcugaggugggaggaucacuggagcccaggaguucgaggcugcagugagccaugaucauggcacuauaauccagccugggugacagagugagaccaugucucaaaaaaaaaaaaaaaacccagaaccugucucuacaaaaaauagaaaaauuagccgggcaugguggcacaugccuguagucccagcgacuugggaggcugaggugagaggaucccuugagcccggaguucaaggcugcagagaaccaagaucucgccaucgcacuccagccugggcgacagagcgagacccugucucaaaaaaaaaacaaaacaaaguguauauuauauauauauauauauacacacacacacauacacacacgcacacacacauauauauauauaguucuuaaaauuuauuccauaaaguacacauuucccuguaaacucucuacauauacacaagagguaaaaagugaaacaaaaaaauuuuuugagacacagccuugcucuugucgcccaggcuggagugcagcggcaccaucuuaccucacugcaaccucugccucccggguucaagcgauucucgugccucaaccaaaaaaaaauuuaauuaaaaaaaugacggccggucgcaguggcucaugccuguaauccuagcacuuugggaggccgaggcgggugaaucaccugaggccaggaguucgagaucagccuggccaacauggagaaaucccgucucuacuaaaaauacaaaaauuagccaggcaugguggcgggugccuguaaucccagcuacucgggaggcugagguaggagaauuucuugaacccaggaggcagaggaugcagugagccaaggucgcaccauugcaauccagccugagcaacaagagcgagacuccgucucaaaaaaaaaaaaaaaagacaacagaaaccacagugggaaggggauuaauuauuaacaaaaaguuagaaauuucuuguuggggcaccccuacagcccuucaccccugccccgcgccccuuacccgucucugguugugcauagcugauguacaaaaugguauacgguuagccucaaaaagggaguaaaaaugucaccauccuccucuggaagugucuguacauucugagacuguaggccuguauuucuauagaaaggcaguuauacaggccuguauuucuauagaaaggcaguuauacaggccuguauuucuauagaaaggcaguuauacaggccuacagucucagacuguacagacacuuccagaggaggauggugacauuuuuacucccuuuuugaggcuaacuguauaccauuuuguacaucaggucaggagaucgagaccauccuggcuaacauggugaaacccugucucuacuaaaaaacacaacaaaaauuagccgggcgugauggcaggugccuguagucccagcuacuggggaggcugaggcaggagaauggcguggacccaggaggcagaguuuguagugagccgagauugcgccacugcacuccagccugggugacagagcgagacuccaucucaaaaaaaaaaaaagaaagaaaggcaguuauauaguuauaucuguauauuguaugcguguguaucuuugagcuauuugcugguguguggguaucuacaugcaugccuagcugcuucugugcaguuaacggggaauguuugugugucuguauaugagugucucauugugcuuaucggcuggucugaaugugagugcaaauuugaauuuccauguacacauguccccgugugcacauaucugucuguaugugcuaguguuucuauguaaugugacuagauguaaauguguuagggcauucacaaccugggacacagagaaagugaaauauuuuauggcacacuggaguaaacugaagaggguuagggguacuagaguugagugaaaaggaauuucuuacauuuuccucauauuauacaauuaugggaagaaaauuaaaaugcagaauuuuaggggaguuauuaaauauugaauuuguguacaacuuucaaaugaaaucuuuucaguuuuuuaugacacacuugagcucacuucuagaaacaugucuuagucuguuuugugcugcucuaacagaauacuugagacuggguaauuuuuaacaagcagagauuucuuucuuacaguucuggaggcuaggaaguccaagguugaggggcaugcaucuagcaagggccuccuuccugcgucaucccauagugaagggcagaaaggcaagagaacacgcuuuugcaugagagagagaaagagagagaagagaagggaagggaagagaaagaagagaagagaagagaagagaagagaagaaaagggagccaaacucaucuauuuaucaggaacccuucuuaugauagaaacccacucccaugaaaacaggauuaaucuguuuaugaggacagaguccucauuaccucaucacuucuuaaaggucucacuucucaguacugcugcauuggggauuagguuuccaacacaugaacuucggaggacacauucaagccguagcauucuuccuugacucccaaaauccauguccuucucaugucuaaaauagauuaauuccaucccaauagccccaaagucuugacucguuccagcaccaacucaaaauuccaaaguccagagucccauuugaaucagacaggagagacuccaggugcaauucauccugaggcaaauuucucuccagauguuagccuaugaaaauagcaaauuacuuucuuccaaaauacaauggugggacaggcauaggauagacauucccauuccaaaagggagaaauaagcaagaagaaagggguaacuggucccaaguaaguccaaaauccaacagaaaaaaaaaaaacauugucuucuucuuuuuuuuuuuuuuuuuuuuuuuuuugaguuaaggucucccucucugucacccaggcuggaguacagugaugggaucacagugucacagcucacugcagcuucaaccuccugggcucaagcgauccucucaccucagcuccccgaguuuuuguagagaugggauuuggccauguugcccaggcuggucuugaacuccugggcucaagcgauccacccaccucagccucucgaacugcugggauuaccgugcccagccaacauuaagucuuaaagcuggagaaugaucuuugacucugcguccugcaucuugggcacacuagagcugggcugggcccccaaggucuugagcagcccugccccuauggcuuugcugggcucaguccacccagcagcucucauggguugaagucucaugccuccagccuucgcaggcuggaguugcacauucgugguccuguaguucuguggucuugggacagccccacucccacaguuccacuaaguguugccuuagugggagcccucugcaguggcuccaucccuaugacaagucucugcuugguuccccaggcuguccaugaaauucuuugaaaucuagacaaaggaagccaugguuccacaacucgugcauucugugugccuacagaauuagcaccauguggacaccaucaagguuuacagguuauacuuucuggagcagcaagucgagcugcacuugggccugcuugagccacagcaggggcagccaagggguacugcuccagaauugaaggagcagagucccaagguggcacagggcagcaaaugcucaaguccuagggguaccucucuagaaaccuugcccucaagauccuagcuugccucaaaggccucugaauagaaucuggcuuccuucuacccauauuagucucuuuagcagucucuuggucacacccuuaguauucucuccccaacaugcuuuuguauuuuuuacauggucaagcugagaguuuuccaaaucuuucuguucugcuucucuuuuaauuauaaauucugucuuuaaaucguuuuucucucauuuugcuguacauagccaaaaguagucauguggcaucucaaacauuuugcugcuuagauauuuuuucugcuauauaugcuaguuuaugacucuuaaauucugccuuccacuaaguccuaggacaugaacacgauucugccaaaucuuugcacgcauauaacaaagguggcuuuuauuccaguuuccaauaccuuauuucucauuuccaucggagaccucaucaaaauggccuuuaccauccauauuucugaucaugggauuagaaacaaagcuaaggagccuaaaucuccuuagggauuacuuaaguggucaugaucagaaccacuuggcaauuacauuuuuaacacaugaaaucagaacugaucauggccacuuaaguaaucccuaaggagguuuaggcucucccuauagcacuugucuucuucugaggccucacacaaaaucacccuuaacccucuauuuauggcuuuacaggcuuuuucuagccugcuccuccauauucuuucaaccucuacccauuacccaguuccaaagccacuuccacauuuucaggcauuauagcaacaaccccauucuuggcaccaaucuucuuaguccauuucgcgcuacuauaacaauauuugagacuggguaauuuguaaagaacagagauuuuaggcuaggcgcaguggcucacacauguaaucccagcgcuuugguaggccaaggcgggaggauugcuugaggucaggaguucaagacuagccuggccaacauggugaaacugcaucucuacuaaaaauacaaaaauuagcugggcauccugguggcaggccccuguagucccagcuacuugggaggcugaggcacaaaaaucacuugaaaccgggaggcagagguugcagcaagccuagaucaugccacugcacuccagccugggugacagagcaagacucugucucaaaaaaaaaaaggaacagagauuuuauuuuauuucuuaucauucuggaggcugggcuguccaagaucauguggcuacaucuggugagagccuucuugcugcaucaucccaugguggaaggcaaaagggcaagagagcaugugcacgugacaaagagagaagggaaguggguagaacucauccuuuuaucaggaacccguuucugugauaaccaacccacuccugugauaacagcauuaauccauuuaugagggaagaguccucauaaccucauuaccucuuaaaggucccaccugucaacacuguugcauuggggauuaaguuuuuaacacaugaacuuuaggggacacauucaaaccauagcagaccauaacuuuuaaauucacuaaugugaauuuguaguggucaacauccaugcccacuucugaucaagucauaagugguuugauuuauuuuaugguccuuugauucauuuauggucauuuuaaucuugacuuggcaaauccacuggugcugagcauagaucuucuacaucaaguuauuguguuucuugguaaaagcucaaacaaaggaaaugaaguaaauaacaauugguaguuuugacacagauauaaacuucuauuguggccugccaguuuuugaucuuggaaagcauguuguugaagguaagacacauuccauggagauugcucacacacaacccaauguuugaccuaaugcccucaguaauuagcuugaauguaugaaauguagcugcaugauucuacaggucagcagagcugaccucaaaaacacaagcuuuggggucaucagauaacauuuugguuucucagaagcaucaggugcaguuacuaguguugaguauggcuggugcuuucacaccauacccaccuuucuuaagaaauggaacaacugcuuauucgugccuuccuuuuccaccucccuuuuauaauucucuuguucuugucauggccaggcagagacuaagguuuugugcuugaaauagcugcgugaucuuuucuaucuuuugguagucaccaucaacaggaaauugcuagccuaaguaaguugcagcaaauggucaaagaguauuuuuuaguggguuaaaacucguuucucgacaaauauucagaauuuggauaauuuguaguguuugaauuuugugcuucaaagggaggauucuuuuuuaaauguagcaucucuuucuuuucuuucaaucaaauaugaaauuucuuguaacaaaugcaggccaggugcgguggcucaugccuguaauaccagcacuuugggaagcugaggugggaggauugcuugagcccaggaguuugagaccaaccugggcaacgugacgaaacccugucucuaccaaaaauacaaaaauuagccgggcaugguggcgcgugccugugaucccagcuauucaggaggcugaggugggaggauugcuugagccugggagguugaggcugcagugagccaugaucaccucacugcacuccagccugggugacagagugagacccuguuuccaaaauaaauaaauaaauaaaugcucacaaauugaaugcaacagaaaauuuucauuuuguguaucuuaaaauaaugaugaagcuuuuccccuaagugaaugcagacauugcucuacuuacccuaauaagucuucuuuaguauucaaauugcaacaccaaguaaacaucacccagggaaccauacuugacuucacauuuccuaaguugaaguuuugcuucgaauccauaaacucugucaguagucuucacgcuauucuuuagugucuuuaacauuuuuuauguaacuuuauucgugugcaaaaaaagccauuuguugaagccaguaaacauaaaaucugugccugagcucagaaguucgaaaucagccugggcaacaugguaaaaccccgucucuacuaaaaauacaaaaaaaagaaaaauuagcugggcauggcagugugcgccuguagucccagcuacuugggaggcagaggcaggagaaucgcuugaacccaggaggcggagguugcagugagcugagauugcacuacugcacuccagccugggcaacagcgagacucaaaaaaaaaaaaucugaaaaaugagaagcauucacaaagaaauguugccauguuucuuuuaccucauuauuauuauuauuacuauuauuuuuaccaaaucucuacacauuuggguuuaaaacaacacggaaggguguacugaucccaguuccuuacagaaagcugaaaggcaggugggaaaugucuuggauuuaauuacauucaucuggcauaauuuacuguggaaaugagaccuauagacaaacuuacaggugagggcuccucaguaaaugaaucucagaguuuuccaaacaaacugcuguuguaaacagcagcaucuguccacagacuuauggaguuuccacaguauuucaaaguauucauguaucacuuugaauauuucaaacuuaguuuauguuggugcuucuuguacuucucuucaaguuucuaacuaguacuguaaacuaugcaaugucaacacccauagaugcauggguagaaaaugaaaaccuuucugauugaacaucuaaguuagugucaucucaaugcccuuugaccugucaccaguguaucuccuaacagcaauaauugaacauggccccuuuccuauucccuuuaccucauuggucuuaaaaauaguguacacaauuucccugcacaccgcuaaccugugagauucuacugggaggggcaucuuagcuuuacuuguuaaucauacaacccugucacuagccgguugagcuccagcuaaaaauauucuaacccaucucauaaaagaucccaguuucucaauuugcacugccagaugcuuuaaaaauuccaaaucuuucuauugaaggggucagcagaccucugugaguucugaaaacugauuuuucucugcauucuuaagaaagcaacacucuggcggggcgcgguggcucacgccuguaaucccagcacuuugggaggucgaggcgggcggaucacgaggucaggagaucaagaccauccuggcuaacacagugaaaccccgucucuacuaaaauacaaaaaauuagccgggcaugguggcaggugccuguagucccagcuacucgggaggcugaggcaggagaauggcgugaaccugggaggcagagcuugcagugagccgagaucgugccacugcacucccgccugggcgacagagcgagacuccaucucaaaaaaaaaaaaaaaaagaaagcagcacucugaaacaaagucauaaagcaacucaauuaaacuauuguugggcuucauucauuuauugacaaauauuuuuauguaaaaacaaaagauaguaaguaugaaaucccaccaggaaucagauuugguuaauuuuuaguaucaaauaccaaucacaaguaaaucaaucaauaaaccaagaaaugauaaaaaugauauugucguaauauuuuuaaaagagucuugaccuuuuaggaguagauacugaaauacuuaaggaugaaaugauauaacagauaugcuucagaauacugggagugagggaaguggguaggguuauaggcagaaugagacuagcuaugaguugguaauugguaagucugggcaauggauccacugagauucauuacaguauucucuuuacuuuuuaauguuugaaauacucuauaauaaaacuuuuuuauaaaaaaguaacaaucagaaaaauaaaauaauacuguucucuuuagaaacaccuaauacuauacuauauaauaguccacauagcaacaaucauacaaugcuucuauuuuuucucuguuucuuggugauaagacagcccuccuauuuuuguagaagaaagaaacuugaggaaaaauaagaagaaaaucaaauuaaaagaaaaauaggcggggugcaauaguucaugccuguaaucccaagacuuugggaggcugaggcaggaggacuucuugagcccaagaauuugagacuagccugggcaacauagugagacugcaucucuaccaaaaaaaaaccuuaaaaaauuagccaggcaugguggcacaucccuguagucccagcuacucugaaggcugagguaggaggauugcuugagccuaggagguugagguucaugccacugcacuccagccuggguaacagagcgagacccuguauaaauaaauaaauaaauaaauaaauauuuuucauaaaugaaggcuaggcgugauggcucaggcuuguaaucccagcaucuucggggccugaggcagaaggauuguucgagcucaggaguuugaggcugcagugagcuaugauuacaccaccgcacuccagccugggugacugagcgagaccuugucucuuuuuuuuuuuuuuuuuuuuugagacagagucucacucugucacccaagcuggagugcaguggcaugaucucagcucacucacugcaaucuccaccucucagguucaagcgagucuccugccucagccuccggaguagcugggauuacaggcaugcaccacuacgcccagcuaauuuuuguauuuuuacuagagacaggguuucaccauguuagccgggcuggucuccaacuccuggccucaagugaucaucccgccucagccucccacaguguuaggauuacaggcgugagccaccgugcccagccgaccuuuucucuuaaaaaaaaaaaaaaacagaaaagaaaacaaaaacaaacauuguccacauagguauaggccaaacuccaaaaccucacugaugauaaacuagcaaaguaauaaucauacuaucuggaauguuucaacgggaagugaugaaaacaguuaccaccucucuuugcacaugguugcucuggagccauucuugcucuagcccucugcugugguaggagccuaccagcugggcagcucugcucguuuguccacuuacaagugcaagaguuagcuggucucugcacaugagcagguuuggcuccagcgguauaccuguugcaggauguguaugucaguuaaguguaucugugugugagcaaguuuauauguguacacauguuugcccauguguacuugucuuugugugugucuguauauguacaauaugcaauuuuuaucuuuguguuuguuugcguauugcuaaaguguaugagugugccuuuguguguguguguuggagcuguuauaagucuguucaugggugggaguguauaugugaauggguguguguguguacauauaccaggauauacauauuuguguuggugagcacaccuaaucuaugugagagaguuugaaucugucucuuuguguuagagcauguguguguauaugugggcaguuuuuuacuugccugcuuuuuucugggugcauauauaucuauaggucucugagggggauucuauguacuauaccuguguguguauguguguguguauacacacacaugguaggguucaagugcgugucagccugcuggcauauguaaguaacuuugaguguuaauaucgugacaguguuuaucuaugugacaauauuaauauacaacuuuguguauaucuguguugugucugaauaugugggaggauuugaaucaucagcuauauugggucaaugaguauauauaugucugugugaaugaaaguauauguggguaaguuugcuuguguguaccuaucugucaguguuugagaucucguucauccauguguguguuaggggaguuacaaaggugguuuuguggaccauugcaugugugugaguguguaucugagugugucuguguaugugaacaauucucagcccucucauauccagugcccucuuguacauaacagauauuuuguaacaccccuuuacugucuggaaaugaaguucuuaggaauauaaucucucugcauauguaauuuuuuuuugagauggaguuucacucuuguuacccaggcuggagugcaauggcacuaucucggcucacugcaaccuccaccuucuggguucaagugauucuccugccucagccucccgaguagcugggauuacagguucgugccaccacgcccagcuaauuuuguauuuuuaguagagacagaguuucaccauguuggccaggcuggucucaaaccccugaccucaggcgauccacccgccucagucuuccaaagugcugggauuacuggugugagccaccacgccuggcccucugcacauguaauuuaaaaagaaaauccauauuuuauacaauauccauuuuguauuaacuauaauacaaauaagaaauaaaagaaaaaugauuuauaagaaaacgauuuguauuucaauauguaaaugcuugggcaugacacuccccaggagauucaaggaagugauuagaggcucccaaugucuuuuuuuuuuuuuuuuagauggaguuucgcucuuguuguccaggcuggagugcaauggcgcaaucucagcucaccacaaccuccaccucccggguucaagugauucuccugccucagccuccccaguagcugggauuacaggcaugugccaccacgcccuguuaauuuuguauuuuuuuauuuuuaguggagacgggguuucuccauguuggucaggcuggucucgaacuccgugccucaggugauccgcccaccuccgcuucugaaagugcugggauuacaggcgugagccacugugcccggcccccaaugucuuauacuggguaacuauggauuuaggagaaggggaaacaucagaggcaggacgugcaggaaaaugacaggcacaggccuuggaggugagauuuucuaaaauagucaacaacucuaaggaaagcucaucccaaaccaaagugcagccuccucuuuacuuacaugacagccacguuccuggauaauucgggguauguuaaaaucaagagaaaaaaaaugguguuuaucugugaaauagauucuaaguucacuuacuuaaaaguccaaaguccuagaggaugcgggacauguuggcugcgugggacucucccccauauuacuggauggccaacauccuccccgacuccuaaaugucagaaggacacccuacaccccagcacuguggccaucaaaaaugcuccuacacaaauuuccaaaauguccccuagagggcaguaacgccuuuguugaggacgaagcgcuggcgcucggagaggguacacuguguaccugugugaacacggcagaguacaagauguaccucugccuccgugugcgugugugcauaugugugugagugcgugugcguaugugugaguguguguguguauguguguugcaugcgugcgcacgcguuccucaugcaagagcggguugcugucugaggguguccacagcaguagaccguuuauggggggauggggugugcacgugucugggcucgagcaggugugcguguguucuguguuugcacgcgucuugagccucagcugggcccgggcugcagcugccagucugcggaggaaaacccucuccucacuuguuuguaaaaugucccgagcuuucccaggguuguguuuguuugcugcuauuguuugggggggaugugggggguuuuguuuuaucuuuagcuuuuguuuucacugagacucagggcuacgcauuauccaccuucucggucuuagcguggcucuccgugucucccucucuaucuccaucuuuauuucugucucucucucuaucucucuccagcuacccucucuuaucucugccccaccccaccccgucucuauuuuucuuucuuuccuggcguuagcccucucccucucccugcucuccuuuucucucucuugcucucucucucucucucucucucuauuucucucccuucucugucuggcaugcugguuucugugugugccucugucucuuuuuucucacucucauuuucacccuucuuccccuuuuugucucucucuuccucucuguauguaaggaucucucuccccuuucucuguuucucucucugucucuuucucccuccugugucuccgucugucucugucacacacaccucucucuccuucucucucucugugucucucuggccucucucuuacauucagucucugucugucucuaucccuuucccucugccuccccucaagguaaaggagagagaaagagaaagagagagagagaaagagaguaaguguguguguguuuacauucacccagcugcgggcuguuccacagucugagggggcugucaggccuugaagggcugaaagggagcccaccaaccccauuucugcucagccccugcccuagcacuuucuaaguacuaguuuggccuccugucaugggcucugagauuucagggugccauuaaaaagccuggcucgggcgcaguggcucauaccuguaaucccaacaauuugggaggccaaggcgggcgaaucauuugagguuacaaguuggagaccagccuggcuagcaucacaaaacccugucucuacuaaaaauacaaaaauuagccgggugugguggugcgugugcuuguaauuccggcuacucgggaggcugaggcacaagaaucacuugaauccgguagccggagguugcagugagcugagauucugccacugcacuccagccugggcaacagagggagacugucuaaaaaaaaaaaaaaaaggccgggcaccagguggcuguggcaggccaggcuggauugagcuggaaaaccaugcagaggggagacuuuuccugggagggagggaguaggaagacauccacucaaguuccacccccuaaucccagcccagccccaacaaucauccugaguuuccccaguuucugcccaauugccucacugccuucccucugggaccugugcuguuaccuggucacauccccacacucccggagcucuccucuuuccugcagcuuugcugcgcugcucucaccaccagauguaccccccaggcugcuguuguagcuaauccugccuggaugucuccagggcacccucucugacccacagccccagcccauuuaaucccucaaucaauucauuugauauauugucacugagagccuaccaugaugugcuauguaguguucuuucagaggagagucagugagucuuuaacuccugccuuuguggagcuuucauucugacaggacaaggcaggcaauaaacuaaaauuuaaaaguaaauuauauauauaaaauuauauauauauaauuuuuauauauuuaaaaaauuuuauauauauaaaaaaguuuguauauauaauuuuauauauauaaauuuauauauuuuauauauaauuauauauauauuuauauuuauuuauauauauauaaauauauauuuauauauaaauauaaauauauauuuauguauauuuauauauaaauauauauuuauauuuauauauaaauauacauaaauauauauuauacauaaauauauauuuauauauaaauauauaaauauaaauauauauuuauaaauauauaaauauacauguauauuuauuuauauauaaauauauaaauauacauuuauauaaauauauauaaauauacauguauauuuauucauauagaaauauauauaaauauacauguauauuuauucauauagaaauauauauaaauauacauuuauauuuauucauauagaaauauauauaaauauacauuuauauuuauucauauauaaauauacauuuacauauaaauauauauaaauauacauucauauauauuuauauauaaauguauauuuauauauauuuauauauauuuauauuuauuuauaaauaaauauauaaauauauauaaauauauauuuauauuuauauauaaauaacuauauagauuuauauauauuuauuuauaaauaacuauaaauauagauuuauauauauuuauuuauaaauaacuauaaauauagauuuauauauauuuauuuauaaauaacuauaaauauagauuuauauauauuuauuuauaaauaacuauaaauauagauuuauauauauuuauuuauaaauaacuauaaauauagauuuauauauauuuauuuauaaauaacuauaaauauagauuuauauauauuuauuuauaaauauuauaaauaaauauauaaauauauauuuauauuuauuuauuuguauuuauauauaaauauaauuauauauaaauauauauaauuuauauauaaauuuuuauauuauaaaauuauauauauauaaauauauaguguguuagaagagagaaauucuaggaggcaaaauagggagaguggcauggagggggcauuaucugucaccuggauugcugcaggggccucugaguagucucccuacuuuuaauacaccccacaugaccccugcucuucacaacggcaagcgggauucuguuccauccuagaucauaccacaucuggccucugcucagaauccucccgugacucccaucucauucagaggaaaaaguucucgccacggccucccugaucugaccucaccaccuuucugaccucaccugccaccacauuccccugacucacuguguuccacccacaguggcuuccuugcucuuccucaaauaugccauguagagucccaccucagggccuuugcucuggccguucccccugccuggacuucucuuccccgagauauccgcaugacucacucucucaccucccuuaggucugugcucagaugacacuuccuccgugaagccuccccuguccaccucaucuaaaacugcagcaucuuccccaccccuagcacuuccuaucuuccuucccuccuuuauguuuauucuuaggaacuugucaucaucugacauacuauacuucacccgugucucuucuuuguuaucuagaaugucgguuccacaagggccgggaucuuuaucuguguaguucacagcuguauccccaauaccuagaacagugccuggcacacagaugcuugauaaauauuuuuucaguguaugaaugaauaugcacaagcaucccuacauguuuauauucacacauacuugccuccucaccuaaaauaaaaaccaaaguccucaucguggcccacaacccuacacaaucuggccccaaggcaucucugcgacuucaccuuccaccacugucucccuugcucucaccguuccugccucacucgucuuccugcuguuccucaagcacacuaaacacauuccucaucaugaauaaagaaaucuauuaagugagugguaccagcauuuuaagaacacaugaaagagaauaaaaaugaaugggguacauugcauacagguucaguacuguuuugugaaacuuuugguugagcugugugugugcgugcauguauguguagcggguugugauguaaaauguauuuuuuuacuguggguggcaguaaaaaaaagucugaacacaaccuuagagcuuugcaaaaggggagaagagcugcaccaacaucccugccccacagauccaccaguggaggaaacagguaaccaaagacauccaaagaaaugcagcauccucaccugacaaggagcggguaggagcaggaguggcccaggggcagggccuggcaccagccagggcauaauuggggagggcucguagacacacuaacccuacccuuucuguuucuuccucaucuuuccuuuccaucuguuucucauggucuccugucugucucucucucucuccccucuuucucucuccucgcucuuucucauccccuccauuucugugucaaucucaauccauuuauaucgguggccacuuuucuaucucuuuguucuaucucucucucucucucuuucccacuuugucucugcacgccuguuguguuuuucugccugucucucucuugcccucaucucucugucucucucuugcccucaucucucugucucucugugucugugucucccccgcucauucccauuugcaggugcaauguagcaggacaacucauggagcccccccgggcccaucgaguaccggacuggcugacccccuaggguuggcaguagccccugacccucaguauggccaacacuaccggagagccugaggaggugagcggcgcucuguccccaccguccgcaucagcuuaugugaagcugguacugcugggacugauuaugugcgugagccuggcggguaacgccaucuugucccugcuggugcucaaggagcgugcccugcacaaggcuccuuacuacuuccugcuggaccugugccuggccgauggcauacgcucugccgucugcuuccccuuugugcuggcuucugugcgccacggcucuucauggaccuucagugcacucagcugcaagauuguggccuuuauggccgugcucuuuugcuuccaugcggccuucaugcuguucugcaucagcgucacccgcuacauggccaucgcccaccaccgcuucuacgccaagcgcaugacacucuggacaugcgcggcugucaucugcauggccuggacccugucuguggccauggccuucccaccugucuuugacgugggcaccuacaaguuuauucgggaggaggaccagugcaucuuugagcaucgcuacuucaaggccaaugacacgcugggcuucaugcuuauguuggcugugcucauggcagcuacccaugcugucuacggcaagcugcuccucuucgaguaucgucaccgcaagaugaagccagugcagauggugccagccaucagccagaacuggacauuccauggucccggggccaccggccaggcugcugccaacuggaucgccggcuuuggccgugggcccaugccaccaacccugcuggguauccggcagaaugggcaugcagccagccggcggcuacugggcauggacgaggucaagggugaaaagcagcugggccgcauguucuacgcgaucacacugcucuuucugcuccucuggucacccuacaucguggccugcuacuggcgaguguuugugaaagccugugcugugccccaccgcuaccuggccacugcuguuuggaugagcuucgcccaggcugccgucaacccaauugucugcuuccugcucaacaaggaccucaagaagugccugaggacucacgcccccugcuggggcacaggaggugccccggcucccagagaacccuacugugucaugugaagcaggcugguaggcagacaggcagagagaaggucauggccaccgugauggggccaacagcaagggagggguaggggcccauacaggaguccuccuuucugagcuccagccccagccccucgaaccaccuguaaucuaggcaccuuugccaacaccucccaaggauggaggacugggcgagggacugggaaagaggcauauuuaguuuuguggggccugucuccgcugccuccuucuccacuucuacaaucucauucucucucucucucucucugucucucucucucucucucucucucucucagaagugacaauucagaaaaagaaaagaacacugagaaugcagguuuuucuacuaacagcugaggagacaggcuuucuuacuuuaaugucucuccuucugacacuguccagaagggggaauuuguccuguaaaauagacuuccagagcucuuuugcccccucugcucccaugcacccuccccuuccaaguccuuuagcaaggccuggauguuuagggagaaagugguccaaggcugcugacaagagggaccaaagggggugcuggguucccagggagcagggauguuuaauuacuaugucaugugcaauguuguuuuaggccaacccuugccccaagcccagucucuucucccuccccaccauguccagaccucccaaaugguucuugugcaucuguuggagaagucaagggaguagggagaagggccccaaggaugggcccagguuaggugaagaguaagaugugagcugaacuccucgaacugaagagacccacacuuggucacauucucucacgcugccuucaggauccccagcccccaacucuucuuccugaggauggaaauccacuccagccccacuaggacugaugugggugccauacaggcaggagcagcccaccaggaaaguguaaggagggagcugaacuccccagaguagcuggaccacagagacuugggucagagcugauuucaaccccagaauugucucucggguucacccuacucuucugaagaugaaaauuuguuuggggccuugguaaccgauagcgguacaaacuccaaggcacuguggacuugaguccauuccuaucugaccucuuuuugucccccucaagccucaggggccucaagccccuccuuaguagcccuuggcugacugggcccugagccccaagcauccuucuuucccaacaacccuccuuccccauccuucccccacccuuaccuacacccaaaguggagcacacugcagucagauucuccaggagggagauccaagccuccucccagggguggaguccacucugggcuuacuuugaggccuguucuguggauuggugagccaagcuggcacuccuugcccuggucuuacccaggcucucugucccccucucacuuccuguggggccggaaucuguauuuauccaucccccuuucccuucuuuauagaagucccuguccuaaacucccucccuagcccaagagagccccagaacuggggaagccugacccauacagaauggggagggcacucuaggcaggagagacauuaaugagccuggcugcagaguggcccuggaaaggcaggccagaguggcugagaggcugggaguaggggagccuguucucucagcgauagugaugggggugccuuuccgaggggguggggugggaagaccaagggggugggggguagauaggguacauuuaggaggguuuuccuccauuucuuuuuucuaacugccuggauucaccauuggauuuuguaaauggaaaaacugaaaugaacaaugcuauacuggauguuuucucuuucugacugugugugugugugugcgugcgugcgugcaugugcccugucugaccacauguggagagacaugauugagugauagugugugucugugugacuuuguguggggaggcacuccugaagaaaacuugcccggugcacacacguaaaaugccuguauauggggacagauacagcacgugcaugcauacacacacacacacacacaccacaguugagaggagacaaacuagaguaugugcccgugguaggaagucgaguggucaagagauggaucuuggaaacuacauaggucgguagcaagaggguagacucccaucucacaagaugggccucccuuggcccaggcccugagcacgggagggcuggggccgccagggaacuugaaaaccucaucuccucacaaagccuguagccccaucucaaccccgucucagucuccuucccaaacucaaacaagguguuccuaaaauuggaccaccauggagaauggggacugggaauugaggaucaaaugugagggaaacugaugagguuaggaaaugccccccacaaaguaauggcuucuggagggacugcucagucugggaugggagcccuuccuaggggccacuguaugcagcugggacuuuggucagcuuugaccaaauuuagagggagggaugucauggggaaaaaaaacccaagcccaggagucuacccagccagccugcucccuagacaguuaauuuacuaucugguuauucucucaggugcacagaauugaguugaccauacuccucaguucuuggcacacuauaucaucauugguccaugugaggcccuuuuauuuuuuuuucuucaguuuuguccccuucaucacccauuccugaucccauccuccccgcccccuacacaggcacccacucucguguauuuaacguacguccuuccaauccaccguucauguguuuauuuacauauauguguaucugugaaaaauguaugguauugcuguguguuuuaauuuacauaaacaguauuguacuauaa

SEQ ID NO: 192864 - RNA, 1462 nt, Homo sapiens
gcguggcaggagaggcggggccaauuuugcugagcuuucucgcgggcuugcagcugcggcaagugcuggcggcggcugcucgcgcaagucagcuggcgugggaacuacccuuuguagcugagaacggcuuguuuauugcuacaaagacucuauugacauugguagcuucagcggcagcagcuucuuacgguauaaagcuguugcuuccugaagaggcuacaagcauccuucccuaggacugcuguaagcuuugagccucuagcaggagacaugccucggggacgaaagagucggcgccgccguaaugcgagagccgcagaagagaaccgcaacaaucgcaaaauccaggccucagaggccuccgagaccccuauggccgccucugugguagcgagcacccccgaagacgaccugagcggccccgaggaagacccgagcacuccagaggaggccucuaccaccccugaagaagccucgagcacugcccaagcacaaaagccuucagugccccggagcaauuuucagggcaccaagaaaagucuccugaugucuauauuagcgcucaucuucaucaugggcaacagcgccaaggaagcucuggucuggaaagugcuggggaaguuaggaaugcagccuggacgucagcacagcaucuuuggagauccgaagaagaucgucacagaagaguuugugcgcagaggguaccugauuuauaaaccggugccccguagcaguccgguggaguaugaguucuucugggggccccgagcacacguggaaucgagcaaacugaaagucaugcauuuuguggcaaggguucguaaccgaugcucuaaagacuggccuuguaauuaugacugggauucggacgaugaugcagagguugaggcuauccucaauucaggugcuagggguuauuccgccccuuaaguagaucugaggcagacccuuggggguguaaaagagagucacagguaccccaaggaguagaugccaggguccuaaguugaaaaugaugucgauugggggcgggggacacuguauuugauauuugugaucagugaucauuguucaacugcgaaauagaguguuugcuuuugauaauggaaaauuguauucguuuuaaaauuccguuuguugagaauaacaauauguuuaaaaauauaauugaacaaauuuuuuucuuuguuuccugucauugacauuuaguauaacaguuuugcuaacguucuaaaaugaagucguuccaucauaaucuaugaucuuguacagcacuuauagaaauaagcuguucuuuugaaguugaaauacccaguaaaauguugaagaaggauggaggauuucuucauaucugacguuucugaaacccuuugugucugcuguugugugaagauugacauuuaccaugauuuuccuuaguuacugcagaacauagagaaaaauaaaagccuaacgaauagua

SEQ ID NO: 192865 - RNA, 41098 nt, Homo sapiens
cucuaugguauucuucccagcccacccgucccuuugguagcggcagucacgugacagacuccgggguaaggcagaugcccacgugauccuggccugcaguuggguggcugcggugagauaccuggguuccugaagggcgggugguuaggucguaacuacugcccccgccggcugacucuccgagcggccgggcucggaagccacgagccagcugaggcguucuccgcuuagugccuacggcaugggucagcucuuucugccaccuccgccuucgcgguccucaccucuuugcgggugaaguuaccuuuggguuuccagaccuugggggccugaggcccaaacucgggacgaaccccuaacccaccucucuuuuccugucauucuccaacucuuacuuuguaccacggaaucacuuggccuuaaagcuagccagcucggccgugccuugaggccagguucgagagauaaagguaaccguggggaaagcggccccccaguggacaaaggcggaggcaagaauagagcaggccugagggccauaggcgaugagaauaggcaguugaggggugaaaaagaaaacaaacaaacaacaacaacaaacccugaagaguacugaagauuuagaagggacuggaaaggacuuguugcgcaauggaagaaucugacucugagaaaacgacggagaaagaaaaucuggggccgagaauggauccaccacuaggggaaccggaaggaucgcuugggugggugaaggguauuugugaaaccuggaaguggggguguucaaauugaagagaguauugugaauuagaacacuucuccccaccccgcaccaugauaaauugcuuugauuuaccaguaauguugauugggauuaugcuuuggacgacaggauaaacuggaaagcgaauuggugcuaacugaucagaaacaacccuugggaaggggcugauauuccuggugguggugcugggggaguguucuaauuaaagcaguuaugaguugcuuugaauuaucaguaaaggagauuugcugucaccagguuggggauggaaagacuagaaagaagauuugcauuuccaggucagagcuugaggguguuuucugugccaauuuguaccugaauuugagacuuacaucuacuuugugucugugaugagugaaauagggcuuggaaggacagcugaaggacuaaaaagauacuuccagauuuuaaaauuaggaggcugaauguuuuuuauacauagaagauauucaauacucaguccucaaguagaggauaucaauauauucuguuuuuuuagaaauagaagauauuguuugauuaaagcagcuguguugcuuugauuaagaugaugaaaaauugaaucuugaauuuuaauggcucauuuguauuccuaaauaaaucuuccuaggaguucucucuugaacuucuaauuaggagauagagaguauacacacaguuuuauaauuuaggaaaaugggaccucuauucaucugaggucccacacacacagcuguacucagccguuguacuaaacaugcucuuuuguaccuccauguuuauuuauacuucauuaauuucaauuucuaagggaauuggaucauggaaacuguuuuuugguuuauaucugcaggugggugcuaccaaauacagccaugaagaaaaagguaagacguguuagauacgucaaaaccaugaagguaaagguaagaaguugauauucaggaacuuugugacauauauacaccaucuuuucuggacuauugcaggagccuucuguguggucugucugacucucuucuccuuguaugcuaucagauuuaauuuuucuaauaugaaaauccgacugagucaucuacauacuuaagaaccuuuaguaacuucuuuaagcccauggaauaaaauccaaaugauuucauggcccuuuaaaaucuguuccugaccaaacccugugccacacuuaugcacccuaucacagcccuacagaauuuauuguucuccagauuuacaaauuaauuugcacuuuguguaagccauauacacacaccauacaggccucugucugcacauuuauuuuuaaccuaacucaaguguuaccacuauaaggucuuauugaguucuucagauagaauuggacacaccuuccuuugugcucucauaguacugugcccuacguugggguuuaggcagaauugcuaagagugcagcucaagcuaauuucuuaaccuuuuggggcuucaguuuccucauuuguaaaaugguaguaauaauauuaacuguaucguaagauuguugugacguuuaaauuaguaaaugccuguagaacacuuagaucaguaccuaacaugauuagccuugguaagucuuucauaggcaauugaaagagguacacuguauaaauuaauaaccgaaggaaauguaccauauuuagccuuagcuucaucuaauaauucaguucuguaacuacaguuugcuaagagaauguucuugaugagccugucugaaguugcuuucauugagaaugccuaaaaguacagaaauuucuacaugauuaagaacaaaaauuagcuugauuuaaucauucugcauuguauacauauaucaaacauugcauuguaccuccuaaauauaaagaguuauuguuuuucaauuaaaauuuuaaaguacaaaagcaaacuuuuuguagcaacuuuagacuggcucagcaguggcauuuccuuagugagauaaaguuauauagcuacauuuuuagauuaaaucaagucugaguguaguauauuuucaucaauacuucuuauauuaguaauuagaaauuuguauaaaauaucuugggauugaagguagaacauagguucccuucauuugaaaagcaaguuaaggcugggcacgguggcucaugccuguaaucccagcacugugggaggcugaggcaggugcaucacuugaggccaggaguucaagaucagccuggccaacauggcaaaacccugucuguacuaaauauaccaaaaaaaaaaaaaaaauagccggacaugauggugcaugccuguaaucccaggcaugggauggcugagguggggggcucaggugggguggcugaggcaugagaaucacuugaacccgggaggcggagguugcagugagcugagaucaugccacagcccuccagccuggaugauagagugagacuuggucucaaaaaaaauaaaauaaaaaagaaagaacgaaaaggaaagcaagguaauuggaacuauauuucauaaauucuagauuugaaaggacucucaaaagucacuuuacuaaauucccuuuuaguacgagaguauagaacaucauugacgagugcucucugugugacaugcugacauugacaggaaggcugcuuaccuucaugaggcuaccuuuucccuuggacaguucucacugucagauacucucuugcuuucuauauuuguuuugauaacuugcuuguucuuuugauguacauacuuugagcaucuguuguauguuaggcacuggagguaugaggggacuuucucuccccuuccagagcacagagucuucugagagagaaggacagaccccccaaaauaaguaacugcaaugcauuauagucuuugcaaugaaauaacagugccaugggaggacagagguaagacacuuaagucagccuagagcauuagacucagaauaucuucuugcaaaaaugauuacugaaccaagucuugaaggauaacugcaauuuagcugaaggaagaaaagagaauggauaguuuacuggcagagaguacugcgugaaacaauggcacagaugcaggaccucccagacggcugggaacaaucagagggacuaccagcaguucaauuaaguguggcuguaagcuaaaaguuucaggccaggagggacaggagaugagggaugagaaguaaauagacuagaucaaggagggucuuauauguagucuaaggacuucauccugcaggccaugggaagcuuuugaaaagaaaaaggagggacaguaauaaauggaauaagagcauagagguaaguagaagggaugagaucaaaggcagagguggaaagauugaccuugaucagaaggaggaagaacuuucaguuauguugcaauccucuacuagguaauucaguuaacaaaacauuggguuaugauagaacaggguuuaguuuccucuaaacuugguauuuuucuaaccuguuucugaacauauuaauggugcaucuuaauagcauaaauucaguguaauucugucaccuaaaggauguauguccugugacagguaaguaccuggcuccuggaauucuaaguaucucugcauucacccuucguugggaagaguuuaguuaguugugaguaugcgcaccagguuguugguacugucaguucaggaaaauaucaaauccaggagagaaauagaucccuuuagacuugauuugcucuagauugcuaacuuuuuuccuuuccuuuucccuacuuuguccuuaggugcuguugauggguaaaagugggucugguaagaccagcaugaggucuauuaucuuugcaaauuauauugccagagacacacgucgccuuggcgcaacaaguaagauguuuuaucuuauuguaaagucaggugaucuuaacuauuaauaaucugcauaacacacuugguuucaguaccuuggggaugcagagagguuggggaauuuguuauggagcauguuuacccuuuuugcauucguuuucaaagagguguggccuaauaccaguuacuacugcuugcugucuugggggagguucuuuucuuucuagguuguuuaugaaguggauugcccuuguccaacuuuuuguuuauucugcuauuucuuaaacaagcauuguuuguucgucuuguggggagaguguuuuuaacucuuauacaaagggaaauccauagguauuaacaagcauaacaguaaaauaugcuaagauuuuuuaaagcaguaguuacaccuugucuucguugaaagguaaauuacgguggugggaaggaaagaaguuaacuugaucuguacucugcuacuucuuuuccuggauacacauagaugaucucauuagaguuuugguucugacuuagggaauauguuguugccuuuuauaguuugaguguuaguauauacuaauugggcugccauggacagugaauguaggauccugggagagcccuucugucucuggguuguacugccauuucauucugcagcauucaagcauuucuggauucugcuugguccuugauuuuuagggaaaggccacccacuacucuacacauuuccugaaguuucaagaacaacauuuuaaaaacacaguauguuucagacccuaggaaauaaaggagaaggaaaccucauuucuguuauuaucgugcuuggaguguaaguguagacucucauaauuggggcagcuuuguugucuagaaagcuguuucuugaauguauauauauguauuuuuugagauggagucuugcgcucuguugcccauuuuggagugcaguggugcagucuuaucuccuggguucaagugauucuugugccucagccucacgaguagcuggaauuacaggcacccacaacgacgcccagcuaauuuuuguauuuuuaccagagaugagguuucaccauguuggccaggcugaucucuaacuccugaccucaagugaucugcccgccucggcuucucaaagugcugggauuacaggugugagccaccgugccuggccuauuucuuuuuuuuuuuuucuguuagcuuguucucuuucuguucucuuaagccucuacaaauauuugaggauagucagugucucaguuuguccuagcgaucucuugccucacaaaucuuuuuuuuuucuuuuuggagacggagucuugcucugucauccaggcuggagugcaguggcaugaucucagcucacugcagccuccaccuccugguucaagggauucuccuggcucagccucccaaguagcugggacuacagguguguaccaccacauccagcuaauuuuuuuuauuuuuaguagagauggaguuucaccauguuggccaaacuggccucgaacuccugaccucaggugauccgccugccucggccucccaaaguacugggacugcagguaugagccaccaugcccggccaucuugccucacaaaucaugucuuccuuaaguuaaaaauguccagcucuuccaucuauuucucauuugacauauuuugaaacauuuuuggggacuuguucaaacuuguuuacauuuuucuuaugguauugagaguuagaugcagguggagucugaucagggcagagugggccuaucacaucucuuauucaggacauuacauugcuguuagcacagucuaacauguauccuccuuuuuuggaguaacuuucguuaugaggagacuuacuaaaaaacucuuucaaauaguucaaauucccuuucagauauguuguuauuaaaacacauacccuucuggcucuugugcaguuaauauuuugaaccaaagaauaaaugcuuacuucuauuaaaucauuuaguuuuguuuguuuuagcccaugauauguuccuguacccuuuguuuguuaacugugaaauccagaacaaguccaaucccuuuuuccucauccauaaaaaaagggauuggauccuauuuucauuuuagcuacuuauucucuuaucugauauauuaguuaucuuuccuaacucuaauaucugauacauuagcuaucuuuccuaacuccauggaguuuguacauuugaugaauaucucaucuaguuuucaucuaagucauugaccaaaaguuuuggucaggauaguguccuauggccugucaugccucuauaauugacaucuguagcucuggccucuggaaugucuaccuguccaaacuucucucugcuugauuugauagauuaaaacuuuuuuuuucuuucaaguuaaauaucugggccuaauuacccuuaugauuucaguagauuagaggaagcuaaugguuauugaacaacuguuauuugucagacuuuuguuuacuguuuuauuuacuuuaguucucauguuaacuucauuuuuauagagaauaaagaaggagguacaacuuagaaauuaauauuacucagcuaggaaguaucagagcuggaaugucaaucuaugcucuugcuuuauuccuuaugccacauucuaucuagcuuacccucugcuaacgauuccuggcagacuuauuuuuauuucuguuuuaaauucugaacacuuuuguugaagcaucuuuuucuaguccaauugcuguugcuguuuuuauauagcugaucagaguugacuuauuacccugaauccagagaacagucuugcaaccagcauuucagaguuauucaaacugcuugaaauaguuuugacauaaccuagcagccuuauugugaacagaauuuugcaaauuauaugaaccccauacauuaaggcaaaccauuuauucagcaaguacuuuucugaaacuuuuuauguagcaggcacagagaacgggacagagcucuugcccuuaagaauaucucaagcaggaccuuuauuacuaauacuuuguuaguaaucacuguaucuccuuacagguagugaaaguauacuuuaaaauauuauguuggucuuaaggcuuuaggauaucaucauuagcuaguuugucauugcuaaagaaauaccugcguucuauugcuaaacuuauagacaaguucaaaaugcauauauagugcucugcuuuuuauuugauaguccucuuuauguaguugcugauuuucuuuaaaaguaguaagaguacuuuuaaaauauugcauugauuuuaauguuuuaguguuuuucuaguuucucauugcugaaaauaguccaguuuuauuuuguuaaacuuagagccugcuguguuuugaaauuugaaguaagaauacaugauggugauauuauuaacuuauuagggggcugcuaaaauguauuuguuggaacaguaaacuugucaauaaaaaugauuaugaaguauuuuagucucaaacacuguugacggcuccaagauuuccuaccuucucaaaauucucuguucccuuggcuuuuauuuaaugcucuauuacccugguuuucuuccauuaucuuuaauuaucccaucccucuuuaaaaaaaaaucuuuaucauaguauuuucuucuuucugccccguaagugugugucauuccccaaagcucuguucuugguucuuuuuaguuguucuugugauaauaggguaggaagacuaggagagcuagagauccauauauggaagacaugagacuaaagagggaagcaggaagugggugguuagaucauaaaaugucuuguaagccaaguuagauaguaggaacugaggguaaagagaguuuuaaacagaagagcgauauuuuacaggucccagggauuaaggaaaauguuaaaaaaaaaaagaaaagcaacaugagcugauuuauauuuuauuguuuuuaauuuucaguuuuaauuacaaaaguaguacuugugaaaaauucaaacauuacagacguguaaaaagccucuuuucucccucacucucaggccugcuuccuagggacaaccacaauuaguaguuuugagguuauccuucuggcccuuucuuuucuggguguauacaaucgugcauaugcggagagacaugguuuuuuucuguuuaaagaagaauaaaaaucugcauuuuggagagagaucacucugucuguaauauggaggauagauuggagggagggaaggcuagaaacagguugguaaguuaggaaacuauuuuaauagaccaggugagagaugaugggggcuugauuugggcuagggugaugauaguggauauggugagaagcaaauggauuugagaucuauuuaagagauagagucagccggacuuucugguagauuuggggagaaugaugaggaaaaaaguggacugaaggaugaaacugagguuuuggcuuaggcaacugguugaauucacuaagauaagacugaaagaggaauagauuuuguaggaagaaagggggagaugaugaguuacauauacuuggauacguugaguuuuggauacuugugguucauucaaauggagauuuguaauauaugucagaaagguagagaaaucuguucuagagauaccuguuucugagucgucaguguccaaauggcaaauaaaauaauaagaauagacuagcuugccuuggggaagguggccaaggauggaguccugaagagcuccaacauuuaagggacagaaagaagaauaggaauuguaagggaggaucugccagagaaguuguagguaugauaucagagaccaagagaagagaauuuuuugagaagagaguagucaacagugucaugcugcagaaaguaagacaaggacuaaaaaguccacuggauuugguuauggggccauuggucacuugaugagaauaauuucuaugauaugggaguagaaaccugauuucuaucccaugugccccaugucuaaacagucacugacuccugucacuucuuuuguuauugucuuucccuuucucaguagcacuucuuuccauuuuuuuuuaguacuagaccguauacauagucuucaaauuaauagcaguuugagcaccuacucucucguagacucuguuggaaauacaaagacauguaagauaugauuccuuuuccaaggagggggaaguaaaggggagaagggaaguaguuugagcaccuacuaugugccaggcacuuuauguaugauaauucauugaauccucauaguaauccugugaggucagugcuaugccccgcccccccgcuuucuuuuuuaauagaagcggaaacuaauacccagagcuuaagugacuugcccaaggucacauagagagguagagcugauauuugaaugaagauuuguucgauuccaaagccugugcuuuuuaaaauaaugcucugcugcuugugauguaguuuauaagaagauaaaauugcacaaaaguuagauagcagucaauuuaagcaacagcuuugagauagucauaggagagauaucacugugugauugauuaucacaaauuguauagaugauaauuccuagacuuugauaaauuuucaggauaaaaucuuucauuauuacuccuugggguuuuuagugccuggcagagaguagaugcuuaaugaguguuugaaugaauucagagggagagaugaugguaaguagggguagcuaggcagggcuuuuagaggaggugggauuuaggcuggcucuuaaaagaugaauauauuuugaaagaaagauggggagggauuuccaggcagaugaacagaguaggugaagaauagaggggagggaaguguaacucagaggucgcaaacaggcagccuauauccuggauaaggccuguagauguguuuuguuuggcccaugugauguuuucuaaaaaugggaauuaguuaucagcauguaaaaguuuucauaaaaauauggauuucccacuacugcugaaaaacuuaaagaucugguaacccagaguccccauuccugcauggcaaaugaaccagagcugaguaacugcugcucacucuacuaucucauuggguagauguuuacacuccauauguggccaacuuugcucauguacgguuacuggccuggccccuguuagcaaguuugcgaccccugguguaaaguauuuuggggguuggggaggcagugggguuugggaggacugugaauaaaccaaauugggcuggagugaaaggcuuuauuaauguggaucauuggggaauguauagguagauuggaagccaaauugugaaggaccuugaaugccuccccauaggcauggaggagccauugaaaguguuuugaauggggagugacauguucaaaguaguguuaagaagaugagccuggcaguagccugucggaugaaguaaaauugaguaaggcuuuuugguggggaggugaguuauggagcuauuguaguaguguagacaugagaugauaaggggcuuccuuaauguuugugguagguuauaaaauaaggaauggauuugagagagauuacaaaggauuagcaauguauugaauguggauagaggagucaaaagugggaaaaaguuagggucauuaacuggaaaggaaaucaauagcaggaguucauuugguuauuguuuuauguuuguuuuuuguuacuuuuuuuuuuaauuuuuguguguaugugagguuggugggggcaagugggacagggaagacugauuauaugguauauaucuauuacauguugaaauuuuaacaguauuauaguuggagauuguuucugcucuaaguauuaaacuacuaaaaagugaaaugacuuaacaugagagccaguucuauagcccaggguaguuuaggugccuaccuugccacuaaaccacacuacucagcugaaaaucaccuucuuguuguggcuuugagcauuucacuccacuuugguccuucuaaauuucauggguuagugcuuugcuuauuuugaauuucacuucaccuguuauaauuacuagauuugucauauuugucuuccaguugauguagaacauucucauguucgauuucugggaaaccugguauugaaccugugggauugugguggguaaguaccaucugcuuacuuguuugugaagccgaugucaguaaucguggcaucuaguauaucagcauggcgaauacaccuagaguaacuaucauuuguaauagauuggauagaauuacuuuaaaauugacacuugagucaauaaacaucucugacuuuuauggaauugugaaaaugcccucuguaugugacauguuuaaauagcgcuaauccaagcuccaucuagguaucuguaguuugggauagauuauccccuuucguggaggaauaaauuagguuucugucucaggcagccugacaccagugcugagcucuuagcugucacaccauacuacuuuguucuuaguuauaauacgucaauaauuuucuccaggcagucucaauacuguagaucagacacugagcacacauucucuagcuaaguuaccuacuuuuuggaagaguaggaguuagcucuuccucuuaugagcaaaauauucaccacauauuccaucacaaauguacacacacuguggauguaugcuggcuauggugcaucucugugcugaaggaacagugugcacugcacaguggauaggagcauagguuuuggagucagauugggguuuguaccucagcucuguuagcuguguuaucuuggguaaaucauuuaaacucucugagccacaguuucuucaucuguacaguagugaaggcaaugguaccagcucauaggguuguuuugaugauuaaguaagauaauuuauacaaaguugcauagcagagugccucacaaaauacauagauauuguuagcucaguguaucucgcucuuagcauagagccagccauagagugggugcucagugaauauuuguugaaagaauaaugcaauagcuaaauacucuuuaagaaaaugacuccauuccugcuagcagauggaucacuuaacauccuagcacauaucuccauacaaauccuuccucauuaucauugguucuaauuuucuaaucuguguuaagacauuagucccaagucccuugcuuuuaggcacuaagaugugaugaucuucauuuuuagagauaaggcaacugagguccagggagauuaucauucugcugaguucacacagcuaauuaauagcaaagugcaggacuagaaccuagguuccugauuuuuuucuccuacuaccggaugcuacuguuuucugcuggccaagugguaauugagaacuuccuggaaagcagcacuuagccuaacgagcaaagagcaacauucuguuaaaaaguuaccauuggagucauuuuaauguaguuuagaauauuugacuauugaguuauucauucagcaaauuuucauugaguacuuaacacuccauuagaagcugggaaacaaugaaggauaguaacagacauggaacuugcugucuagggaagugaaugguguuaaugaaaaacucacaaacaaguguaauaacuugugguaaauguuagaaguaagaggaauguauugauauaagagccuaugcuuaguggauugaccugucaggaggccauggguaguuucugugaggaaauauggauugaacugaaaucuaaagagacaagcaggaguuaacuagaugaggaggugggggguagcaucugagacagagugaacagcauguguaaaggccacauaguggauaaaccaugugccacuugaggaauugagaaaaagucaguguguuuagaacauaaggagaggggcagagaaauggaucugguacaggagaaucaaugagaccggguaagaaacagaaaaggggcugcaccaaaugauugacacgcucugcaaacuucuuuuguuggcucaaguuguggcucaagaggugagaagguaaggccagacuuauuuguuaugauuugcccuuuaaauugaagccuuaagauuaucuuucacauugaucaagccaacaaaaauaggcuauaaguaggagugauugaauugaggauuugcuuacuauauauauauuuuuucuaucaggcaagacaccuucauggaaaauuauuucacuagccaacgggacaacaucuuccgaaauguggagguucugauuuaugucuuugauguggagagccgcgaacuggaaaaggacaugcacuauuaccaaucaugccuggaggccauucugcagaauucuccagaugccaaaauauuuugcuugguacacaaaauggaucugguacaggaggaucaacgggaccugguaagaaacagaagaagugcugcaccaaaugcucgacaugcuuugcaaacuuauuuuguagagguauagguaaauuuguaccauuuuuucaggaauaaaaagucagcagaaguuuugaaaguaaaguuuugucauuuacuuuaacuaaacacucuuuuaaacacauuuucaauaagggaaagauuuauuaguaaauaauuuucagaauuaggcaaggauucuguccaagugaucucacuaagcagcauuuauuuauuuuuaaaauauauuugcugccccaguuuuauuguccuucaaagcagggagauagugucaagguuaagacccacuaggagugagaugaagagagguugcugcuuucauuagauugacuuaggaaacugguaugcaccaguucaagugcuaaccacaguguguuaggcacuaugccaggucccucauaauuucacugauuuacuagauuucucuuuucugacaugggaguuaguacacacaaauuuaaaccagagaaggcacaguagcggugaugucaccaagauaguggaguaggagauaaccagucuucauuccccuacaaaaaaacaaauauagauagcuauccacaaaccaaaauagcccugagaaggcuccgaggcccauuauagaaagacguaguaaaauggguaaacuccugcuuagcugugagacuccaggauuggcaagucauauagucuagcugcaauauagucugucuaguuugcucaguauaaaauaagaggauuggauuuuaaggucuaugcuaaaagagaagauccuccucuauuucuaaggguauaaaacuaaggaaagcaguuuuaggauaugcuggucauauagaggaauacaguuucucuuugaguuggaguauaagaaucuaaggaaauccuuuaaugaaaggauuuuuugguaauugcugugguaaggaauacuuuuuuauaugacuaguuacaggauugccuccacuguuuucuaguguuuugguauuuauagguuagcuuauaggcuuucaaaaaccauuugaaggguuccauauuugacucagaaaacugcuuuugauuauuuaguagucuuuuuagcucuuucucccucaacuucugucaugaaguauuaauuacuguuuaauaccuaauaauuaauaugguuuuacuucagcagaaaaucauguacgcagcuugggucuugaguuugugagggccuuguuauugcucuugcuguuuuauucucguuuccuuuaaaaaucacuuuauuuccuauccaaaauugcaguagaaaaacuuacagcauuccaauaaaugagcuccuuuaaacauuuagaaguguuuuauucacuuguaauuuugugggguuuuuuuuuaguauuuuaauuuauuuuauuauuucaguaacuuuaugguuauaugugguuuuugauuacauggaugaauuguacuauggucacgucugggcuuuuagugcauucaucacuuaaauaguguacauuauacccaauagguaauuuuucuucccucaccccccacaaccuccccguuucugugucuccaguguccauuauaccacucuguaugcuuuuauguacccauagcuuagcuccuacuuacaagcgagaaugugcaguauuggguuuuccauuccagaguuauaaacaagagauaguuugacuuccuuuuuucaguuuggauccccuuuauuucuuucucaugccuaauuacucuggcuaggacuucuaguacuauguugaauagacguguugaaaguggauauaauugucuuuuuccaguucuuaggggaaugcuuuaaacuuaucuccauucauuuugauguuggcuguggguuucucauaaagggcucuuacuauuuugagguauguuucuucugugccuaguuuguuggagguuuuuuuaucauaaagggaugcuggguuuuauugaaugcuuuuucugcaucuauuaagaugaucauaugguuuuuguuucuaauucuguuuauauagcaaaucacauuuauugacuuguguauauugaaccauacuugcaucccugggaugaagcccacuugaucuuggugaaugaucucuuugaugugcugguagauuagguuugcuaauauuuaguugaagauuuuugcauuuauguucauugaguauauugauuuguagcuuucuuuuuuuauguccuuucguggcuuugguauuaggaugacacuggcuuuguagaaugaguuaaggaggauucccucauucucaaucuuuugggacaguuucaguuggauuggcaucaguucuuugacugucucauagaacuuggcuaugaaucuaucugguccugggguuuuuuuuuuugguugggaaauuuugaguuuuuguuucuuuuuuuuuuuugagacggagucucgcucuuucacccaggcuggagugcaguggcguggucucgucucacugcaagcucugccucccagguucacgccauucuccugccucagccucccgaguagcugggaccacaggugcccgccaccacacccagcuaauuuuuuguauuuuuaguagagacgggguuucaccauguuagccaggauggucucaaucuccugaccucaugauccgccugccucggccucccaaagugcugggauuacaggcuugagccaccgugcccggcuggguuuuuuuuuuuuuuuauuacugauuacgucucacuaauuguuagugcucuguucaggauuucuauuucuuuuccugauugaagcuugugugguuguauauuuccaagaauuuauccauuuccuuuagauuuuguacuuugagugcauagaaguguucauaguagucucagucauccuuuguauuucuguguuuaucaguaugauguuuccauuuucauuucugauagagcuuauuggaaucuucuuuucuugcuuuaucuagcuagugguuuauuaauuuaguuuaucuuuucaaagaaccaacuuuuuguuucauugaccauuguauuuuuuuaauuuauuuucaauuuucuugaguucuacucuaaucuuuguuauuucuuauuucuuuucuucugcuagcuuuggguuuggcuuguucuuguuucuccaguuccuugaggugugauguuagguuguaaauuugugaucuuuuuguccuuuugauguaggcauuuagugcaauaaacuuugaucuuagcacugcuuuugcuauaucccagagauuuugauaacuugugucaguauuuuaauucauuucaaaaaauuuuuccaucuugauuuuauuuuugacccaaagaucauugaagaauagacuauuuaauuuccauauauuuguaugguuuugagaauuccucuuggaauugauuucugguuuuauucugcuuugggcugauuugauacuugauaugauuuugauuuuuuaaaauuuauuaagacuucuuuuguggccugauauauagucuaucuugaaaaaguuccacgugcugacaacaagaauguauauucugcaguuuuuggguagaauguucuguaaaugucuguuaaauccacuuuuucuagaguccaguuuaaguccaguguuuguugacuuuccgccacaaugaucuauccagugcuguccauggcguguuguaguccuccacuauaauuguauugcuuucuaucucuuuuucuuaggucuaguaguuucuguuuuuaugaaucugggagcucuggaguuaggugugcauaaauuuuggguuguuauaucuucuuguugaauugauuucuuuaucauuauauaaugacauuuuuugucuuuuuuacuguuguugauuuaaagucuguuuuaucuaagaauaguuauucccacucacuuuugguuuccauuaacauggaauauucuuccuacccaucugccuuaagucuauaagaaucuuuacaaguuaacugggucucuugaagacagcagauauuugguuuguguuuuuuuccauucuguccaucuauuaucuuuuaaguggcacauuuagaccauuuacauucaauguuaauauugacaugugauguacuguugcagucaucaugcugcuaccuaguugcuugguuuucuucaauguguuacaguuuuauaaguccugugaauuuuuugccuucaaguguuuuuauacuggugcauaugaccuuucauuuagauauuuagaacuccuuuugcauuucuuauaggucuggucugguggagacaaauuccaucagcauuugcuugucugggagagacuucauuucucuuucacauaugcaauuuaguuuugauagauacagaauucuuggcugacaguuauuccguuugaggagacuaaagauaggacucaaucccuuuuggcuuguaagguuucugcugagaagucugcuauuagucugauagguuuuccuuuguaaguuauccaaugcuuuugucucacucuucuuagaauucuuuccuucauguugacuuuagauagccugaugacuugguaaugucuuuuuuuauaaugaaucuccuaggaguucuuugagcuucuuguauuuggaugucuaaauuucuagcaagaccaggaaaguuuuccucaaauauuuccucaaauggguuuuccaagcuuuuugcuuuuucuucucccucaggaacaccugugauucuuagauuuggauguuuuauaccuaaacccauauuuacuggagacuuuguucauuucuuuuaauuccuuuuuuaaaauuuuuaucugauuguguuaauuugaaagccuugucuucaagcucugaaauucuucuucuacuugguccaguuauuucuuuauguugguuucuaacuuucucuuggauaucauuuagcaaccuaauaauuaacauuuugaauucuuuaucugauauuucaaagauuucauuuugauuuggauccaucacuggagaguuagugugaucuuuuuggggguguuguagaacucuguuuuugcauguugccagaaucauuuuucugguuccuucucaucuggguggacaauuucgucuuauuauuuuugaauuuauuucugauuuuacuggguuuuuaaauguuuuucuccccuugaguaugugacuuuaauguguguaguguauggucaccuagcuuuggcucugggugcuuucaguggcaaagacuguguaugagcucuuugguuguagagaaucuuugugcaguggcuuucuuagcugcugguuguaguagcagugugcugggugugugagaaggcucacugucucccaugggccagaauggcagaggucucaugaagcauaucucauuuccccgugguguauauuuuguuauuuuugugaaaaauauacuggggaaaaaaauaacaaagugcauaccacuggggaaugagauaagcuucaugagaccucugccauugaauaguucagccuucaugcuaguacaggcacccacagguaaaaaccagcugcagcugaaguagguggguauaugcaguaccccauuugugggcagaaggcccagccuugacugagcuggcugggggagcucucagugaaauguacugaggucuuuacagggggacagaagggagccaccucagcuccucucccaggccagcaggaaagccaucugcuuccccaucaugcuuuugucccaguguucuggauauucagaucagacaagcaccucuguccaucugcaggaaugcugacauuccauguaaagagggguugugacuuuacuucuugugcaagccugaacccagagggcacuccuccuguggagauguagucacccugaagugcuccagaaagacugucuauaggcacacucaugcugaguuccuggaagagaagccccagcuguaucugcaaguggugggcaagggagagaaguuuccuucucugggucccuucaugagcacuggagcugccugacugcugggguagaacugcaguuuuucaccacugagcauggccuugcaccugugucucugcugaaggaaacuucccacaaguggaaacuucugggacucaaggccugcagucugguuucuuuugucccacagggugcucccuugauguggugcacucccuguucccauagguguggcagucccucagggccagacuacugcaaauccugcugcgcaucuggucuagccgccuuguggggcuuccacacucuaagcuggugcugggggaauaugugcaaggcauccagugaugugaagacacaaggauugaaggucccugagcaaaacaaagucucacaaugggugcacauccagcauggcacccacugcuauagcucagguccagggggaacuugugaagggaccuugugcgagcaagguaaugcccuugaggagucccuaaaucgcagcccacucugguacuugugcucgugagugcaaagaagucgucuuugagcuuggauaccagcagucugcugcaagggccagagaggccaagagcacucccaccuccucuguccgcagauuauuaagucucugaggguuugaucucugccagcuucuuguuacuuucuuuuuucuuuuuuggugugucacagauucuuccacugaacucucugauaagcuccagcacucuccgcuuaacauuccauuugggcuaugauuauucaccuguaauuuugguucuucccucugaggagaauuggucacugaugcuucuuaucagccaaguggagaagcucucugaugccaaaggcugugggacaggucugcaggaugugcagugucuuaggcucugcucugagcuucagagggggacaauguugaguggaucuggaccaagcuguccugcccucuggucucccagcagguguaagcacaagcuaugauaaggguagcaggagagugacauagacucugaaagauuucccuggcuaaaaauagccuuagugugauggcuuucucaaaucccagcuauaguaguaauguacuaggcacaugaguaggcucaagaccucccgauuagcugggaugguguggguaaaugauguuagcugagaucacgcagaaguuuucuccuucucaagugguguguuauugugucagcagauguuguaaugggcugcaccaguugcccucuagccaggagguggcguuuguaggagacagccaguugugaugguggccaugggauuugugccuggcuuaugauacucaggggaagaacuugugucucaggcgaugggcaaggccauggaacucccaaaagucccugucuguuguguuaugcuaccagggcagguggaggggcaaaccggguuugggcugggucaaacagauuugcacucuggcuccccauguguaagcacaagcaguggucccaguggggcuuggagggcaguucccuggccacuaggguaauguuccagggagaagcacaacugacucugcugcacaaaagaauccacauugggagaaggaguagcaggugucagugagacccacccaacucccacagcuuugacaagguagguaucacauccacagucuucugcuagcagcagcuagcuggaucccaggcagucuuuguuaagaaugcaaaaccgccccaggccauaagccuuccugcugccugagacagaaacuaugccuuucaggccucaccucucccuguuuguucacgaagcuggggcacuuggcugcugcuccuguggcaagagcguacuucccacuugccccucaguucuggccaagggaguuuguccucacucgagagauuagacugcagaucucaguugggagcuucucccauccugugaccacugccugaguuagcugugagguuccucuuaucaggaaugguuuccuucuguccccacugggguuucaggguacaugcaaaguacuucucaauaccgcucuuuuucauauacuucccacugcucaccaaaucaacugcagugcuggguaggguuaaggugcuccccuguggccuggcuugcucagcuucucagugggaauguguaucaaggagacauugucucccccuuucaugcucuggagacucacaguggucugccuggcucaugguguagguugcugcccaccacuucuuucaaagugucugaagcuucuuucaguuuuucuguugaguuccuguguuccuucuuggauaaaaauuuacacugugaaucucuacacaccacucugcuguuuccaagcaggugaggucugcuaacaaagccuucagucuaccaucuuggaaaaaaaaaaucacuuuugauuaaucaucuuauuauuuucuaaaugcguauauaaagauuuccaaagauagauuaauauucuucaagauacuuuaagcuuaguuaagaaaaguauauucuuuauuuuauuaaaaauguacuuagaaguuuuaagguaaaaugguuaguguacuucccuaaauauccauuucagcuaagacuggugcaaaaauaauugugauuuugccgggcgcgguggcucacgccuguaaucccagcaacuuugggaggccguggcgggcggaucacaaggucaggagaucgagaccauccuggcuaauacggugaaaccccgucucuacuaaaaaauacaaaaaauuagcugggcgcaguggcgggcgccuguagucccagcuacucgggaggcugaggcaggagaauggcgugaacccaggaggcggagcuugcagugagcccagauagcgccacugcagucuggccugggcaaaagagcaagacuccaucucaaaaaaaaaaaaaucauugugauuuugaaccaugaauuuuaaaucauuaugacuaggcucaaacacaucuuuuggaaugaaaauaggaaccauuacagucaacacauuuuugucaacaagaaacaaauuuguuuauuccuguagcacaaaaauccgugcuuugggauucaacaaacucuuggaaagaauuuucugcauccugcuggcuguggaaguguuuucccugcaaaagguugucgagaugcuugaagugguaguugguuggcaagagguaaggugaauaugguggaugaggcaaaacuucauagcccaauuucuucuacuuuugaaguguugguugugcaaugugcggucggguguugucauggagaauugggcccuuucugugaccagugcuggcugcaggcguugcaguuuuuggugcgucucguugauuugcugagcauauuuaucauauguaaugguucccccgggauucagaaagcuguaguggaucagaccagcagcagaccaacaaacagugacuaugacuuuuuuugugcaaguuuggcuuugggaaguacuuuagaguucuucuuaguccauccucugagccaguugucaccaguugucauauaaaauccacuuuuuggugcacaucccaauccaauugagagaucauuuguuguugcauaggauaagagaagacaacacuucaaaaugauuuuuuuuuuuuuuuuuugcucagcucgugagcaaaccuuuugagcuuuuucaccuuuccaauuugcuucaaaugcugaacaacuguagaauggucgacguugauuucuuuggcaacuucucauguaguuguaagaggaucagcuuugaugauugcucucaauugaucauugucagcuucugauggcuagccacuaugcucuucaucuugaagucuugugucuccuuugcaaaacaucuugaaacaccacugcaccauacguucguuagcaguuccugagccaaaugcguuguugauguugugaguugucuccacugcuuuacgacccauuuugaacucgaauaagaaaaucgcucaaauuugcuuuuugucuaacaucauuuccauauucuaaaauaaauauaaaauaaacagcaaguaauaagucauuagcaaaaaaacauaaagcgagaaauggacauuaaaaugaugucuaacauaaccacauuuacuuaagaauguauuccaaaaucaaauggcaaauugcaacaauacaaaaaccgcaccuaguuauuuucuucuauguguguaucuuaggguucuccagggaagcagaacuaacuaaucauguguguguguaugugcgcgugcauagaaagacaggaagagacacacacacgcagagagagggguauuuauuuuaaggccuccaacugauuaaauaagacucacuuauauuauagaggguaaucuuuacccagagucuccugguuuaaauguuaaucucaucugaaaacuaccuucacagugauaucuggacugcuguuugacuaaaugucaggauacuguggccuagucaaguuaacacauaaaacuaaauauuacagucauaccccuugucaacuuggcacucauacacaucuacugaaaccauaccuaaucuucaaauaaaaacaauaacaaggucauacuuccauuuaacaugauacaguaauccugcguacaaccaaaaaugcaauaaucauuuucccagaagaggauguaaaguuauugacuguuuacucuucuuuuacauuauaauguaaaguuaacaauacuuaaauauuaugauauaucauaugauauguucaugauaagggauuaaaagggaaaaaacagacauuuacuuuauauacauauauacauauucauaacaaaaucaagaugaaguacucaugacaauugcaauucucauuuguauaacuggucacgugauuuuuaacuggucuuuauaacugccuuauucaguuccagauuaccuuugcccacagcacucaccucagcuuguuguauauucucugguggggugacccaaagaccauuaguggaccuuccugaauugggcauugucguuuuccauugaguuuaaucacagagcaugguauuacuaagagacauccuaagagcucuccuauauuccagaaauacucuucuuccuuauaucuauuuuggaggagcaauccaguuuccccauaguagucaggaucagucaguccagucagcauaguaacuuccuucuuugccuguugauucagaggcuugagggacccaagguggcugguuggcagucuuaacuuccaguucaguggaaucacuauguuuccugguagacacauuucugccuuuggaacugagaccucuaggccagcagagcauaaggucacaggggcaagaaacaaaaauuuugcuagugggucacuggagugagugguggcacuccaguuuccaccccaugaauccucacuauaaaauuaaaagcaccauuuauuggacgcugacucagagcacauacagccuccuagagaaccuugccuagcucugcaaaguauugcaacuaucuaacauaguuggcacuguaaaugggucuucaaaaggccauucuaaccagguaugaugacucaugcuuguaguucuaccuccuugugggaggguaaggcaagaggguugccuagccucguugaaauccagccuaggaacauagugagaugcaucucuaauuaaaacaaaacaaaaggccauucugccauucugucaagccagcugcuuuaggaugguggggaacaugguaagaccagugaauuucaugaggaugagcccauugccucacuuuauuugcugugaagugaguuccuugaucagaagcaaugcuguguacaauacugugaugguggaugaggcauucuguaaauccauguaugguaguuuuggcagaagaaauggaugcagggaaggcaaauccauauccagaauguguaauucaguaaucaugucccuuccaugauggaagcagaugaguguaaucaaccugccaccagguacuuagcugaucacccugggggauagugccauaucagggacucaguguuggucucuguugcuaacagauugaacacucagucauggcuguagucagaucagccucggugaguggaaguccaugaugcugagcccauauauaacaacccugccaccauggccacuuuauucaugagcucauugggcaguuaccugcaugguuggagaaaggggcugaacaggucauccuaucuacuugguuauuaaaauccucuucugcugaagucauucuuugguggcauucauaugagacacaaauauccucacauuuuucacccauucagaaagaucuguguauauaccucuuccacagaccguuuugucaccaauuuuccagucauguuccuuccaagucccugaccauccagcaaaccaguggccauagcucaugaauugauaacuaauuguacaucuaaccauuucuucuuccuaguaaagugaacaaccagguggucaaaguucugcccauugggaggauuucccuuuaccacuuucuuucagggcugucccauaacuuucuuucuguaaagaaaguuaccacuuucuuacagggcugcuguaguauugcaguuguccacuuccagauggcaccugcguaucaugcagaacuaucuguaaaccaguccugaguuuucuuucucugucagcugauugugggaaacuccccauaaggccauaguugcaggcuaaaaaagagaggguaguauaggccggacaugguggcucaugccuguaaucccagcucuuugggaggcugaggugggcaaaucacuugaggucagaaauucaagaccagccuggccaacauggcaaaaccccaucucuacuaaaaauacaauaauuagucaggcgugguggugugugccaugcgccuguaguccgagcuacucaggaggcugaggcacaagaauugcuugaacccgggagguggaaguugcagugagccgagacugcgccacugcacuccagcuugggugacagagugagccaaaaaaaaaaaaaaaaaguaguauagcaggaauggggacuguggccauguuccuuacuuguucauccaaggccuacuugagccugaucucauauauaccgcuuuaauuuggugauggaguccuacugcauaugcacaacuuuauggcuugguaggucaaauaauacccaguucaugauggguagcucaggucucaugguuacuuaguggcccaugauuaaguguucagucuauacuaagaccuaauagcaaaccaagaacuguuucccaaaagggguauaguuaucugugaacagcagcugggcuuugcuucaauaugcugaaggcaugugcugcaguucacauaugggagcuugccagugacuccaaauggcaucccugucugccauugacacuucaagcaccauuggauaugcuggaucauaugacccaaguggaaagcagcuugaguugcagccugaaccuucuguucugggaccuacucaaaacugucagguuuuugggucacuugguaaaugggccagaguaacacagccaaaugaagacuguguugccuccaaaauucagaggcuugcuagauguugugcuucuuucuggguuguaggaggggccagaugcaacaacuuauccuucaccuuagaagggguaucucuccauaccacugcaccccucaaaacuucacugagguagaagaccccugaguuuuugucagauuucccauccucugacaugcagcuaucuuaccaguaagucuaauguaguuguugcuucucgcucauuagguccaaucagcauaaugucaucaauguaauggaucugccuaauaucuuguaaaaggguggucaagauucuugugaagguggucaagauucuugugaagcaaauuaugacauaggacuagagagcugauauaccccugcagcaggacagugaaguguauugcuggccuugccugcugaaagcaaacaacuuacaguguacuuauggugggccuuaauaaagacagguauggagaaaagagcguuuguuagaaaacuagcugcauacagguaccaggggauauguuaauuugcucaagcaaugaaaccacauuuggcacagcagcuacaauuguagucaccaucuaguuaaguuuaugacaguccacuguccaggagccaucuuucuucuacacaggcugaauaggagauuugaaggaggauguggugguaaucaccaacucugcaucuuucaagucugaugguggcacuaaccucugcaauccuuccaggaauaugcaauauugcuuuugguuaccauuuuccuagguagaggucauucuaauggguuccaccuggcuuuuccaccacaacagccugcacuccacaggucaagagaccaaugagggauucugccaguuguugagcaugucuguuucaauuuuguacucuggaacagggaaaauaacccacaagaagguugcaaggacccacugggccuacaugagacagaccugagcuaaaacuccauugauuacuuaaccuuuauaaggcccuacuuugacugguggaccacaguuacauuuuaggucucacuggaauuagggucauuucagagcuaaugcucaguaguagauuauuuccuuuucuguaacgcacagucacccugcuaaaaggccacauagguccauuuggaggaggcugggaggaagauuaacaguauaaauacuuggcaguguccuuccucaaggggacccaggcuccccuucauucaaggggucugguuuuguaaacugguacaagucuggguauugauugagaagccgugagucuccaauuuaauaauucaaauuaaauuuuuuaucacuugaccuagaauucuuccacauauacagaucaaguaaaaaauuaguagacuucccauccauuucacuucuaggaacaucaugauaacuagccaacaccauaggucucuacgagucagacuauucugauuaaugcuuugacucugcuucaguuaugguacuaugaccaccuugucuuuggugauuaagugcccccacuugguuccugccauucuaggauccaacuacucccgucgcauuuagguuucccaauucaguggcagcaguucccacugaaaguucuagccuacagagaagaaugaucacauaauugaggaaagaagcuggggcugcccuuacaaauuuauuuuucauagucaugaugaaagaaaggugugucuucuggaaccucgcagguuuggugaguaggccuuaaaugaaucuguuaauacuugaacauuacaaugucccuaaagccucuuuuucuauggaucucuucuucuagaguauaccaaggcaguucuggcauuucaacuucaugucguuuaggccaccuuuugguccauguuucauccaaccauccaaacaaacuguuaaaagcucuuucuuaccccaugggcugcaacauuaaguguggaaccucugcuuaaugagcuccuaucgguaaauuuagccugauccaacuuuauauuuuuuccacuauuauccuauaccuuuaauaucuauucccauacauauuuccuugguuuuugucuguaaauuggagaaauuauguaguucuuuggaguauagcauaauuccucaugggucauacuucacacgucaccuuuaggagucugcugagacuugaacuaguuauagguguagaagcaaagagggguagugggagugaaucaggagugucuugcauggcagauaccucagaggagaccauugcaguuuucucaggccaaauagaguuaauaucagauauggauggaguggcugcuucuacuggcaaagaagacugagaauuuaagguuucaauuuugccagcuucaucaggaucuucccaaauaaccuccauuccaaauuuuagaauccuacuucuucuuggccaaugcccucacuuuauuagcagaugcccugugagguugugaauucaguucgcauuguaauucauccacuuaaaggaugagauucugaauuugguuucaucagucucagcucugcagcuauaggggguaagaguuuuuuuucagggcagucauagaaacuuuguggucguuuauaaaguauuuauacugauaauucagaucucugagcucauccuuucucuacuuuguucagcacaauuaggaucagccagccaaucucauauuuguuauuuugacaaaaauguucgaaauuauguauguggucacgugguaccuugccucuuaaaaguauuuuauuaggaauauccaguggugguauuuuguguaucucugcugccacaucacacuauagauuaucaguacugucuuuucuacuggaaagugagucauuagggccuuuaaaucuaaucagauuagagaaccaaccccagaaccaauuuagaaaacucauccuuaagauuauucucgcucccucucccucucccucucccucucccucuccccacggucucccucucccucuuuccacggucucccucucccucucuuuccacggucucccccugaugccgagccgaagcuggacuguacugcugccaucucggcucacugcaaccucccugccugauucuccugccucagccugccgagugccugccauugcaggcgggcgccgccacaccugacugguuuucguauuuuuuugguggagacaggguuucgcuguguuggcggggcuggucuccagcuccuaaccccgagugauccgccagccucggccuccggaggugccgggauugcagagggagucucguucacucaaugcucaauggugcccaggcuggagugcaguggcgugaucucggcuugcuacaaccuccaccuccuagcugccugccuuggccucccaaagagccgagauugcagccucugccugcccgccaccccgucugggaagugaggagcgucucugccuggccaccuauccucugggaugugaggagccccucugccuggcugcccagucuggaaagugaggagcgucucugcccggccgccaucccaucuaggaagugaggagugccucuucccggccgccaucccaucuaggaagcgaggagagucucugccuggccgcccaucaucugagauguggggagcgccucugccccgccaccccgucugggaugugaggagcgccucugcugggccgugaccccgucggggaggugaggagcgucucugcccagccgcccagucugagaagugaggagacccuccgccuggcaaccgccccgccugagaagugaggagccccuccgcccagccagccaccccgucugggaagugaggagcgucuccgcccggcagccaccccauccgggagggaggugggggucagcccccaccaggccagccgccccaucugggagggaggugggggggucagccccccgccuggccagcugccccguccgggaggugaggggugccucugcccagccgcccccacugggaagugaggagccccucugcccggccagccgccccauccgggagggaggugggggggucagccccccgcccggccagcugccccguccgggagggaggugggggagucagcccccccgcccggccggccgccccauccgggagggaggugggggggucagccucccgcccggccagccgccccgucugggagggaggugggggugucagccccccgcccggccagccgccucguccgggaggugaguggugccucugcccggccaccccuacugggaagugaggagucccucugcccggccagccgccccguccgggagggaaguggggggggucagccccccgccuggccagccgccccguccgggaggugaggggcgccucugcccggccgccccuacugggaagugaggagccccucugcccggccagccgccccguccgggagggaggugggggggucaguccccagcccggccagccgccccauccgggagggaggugggggggucagcccccgcccggucagccgccccguccgggagggaggugggggggucagccccccgcccggccagcugccccguccgggaggugaggggcgccucuguccggccgccccuacugggaagugaggagccccucugcccggccaccaccccaucugggagguguacccaacagcucauugagaacgggccaugaugacaauggcgguuuuguggaauagaaaggggugaaagguggggaaaagauugagaaaucggaugguugcugugucuguguggaaagaaguagacaugggagacuuuucauuuuguucuguacuaagaaaaauucuucugccuugggauccuguugaucugugaccuuacccccaaaccugugcucucugaaacaugugcuguguccacucaggguuaaauggauuaagggcggugcaagaugugcuuuguuaaacagaugcuugaaggcagcaugcucguuaagagucaucaccacucccuaaucucaaguacccagggacacaaacacugcggaaggcugcaggguccucugccuaggaaaaccagagaccuuuguucacuuguuucuuuguucacuuguuuaucugcugaccuucccuccacuauuguccuaugacccugccaaaucccccucugcgagaaacacccaagaaugaucaauuaaaaaaaaaaaaaaaaaaaaaaaaaaaaaagguuauucucuagaaucacucucaguacugaagucuguguuaggguucuccagaauaacagaauuaauagaauaugugaauauacauauacauacauacauacguauguguguguguguguguguguguguguguguguguguuuagagagagagagauugagaaagauugagauugauuuuaaggaacuuucucaaguaauuguagagacuagcaaguccaaaauuugcagggcaggcugacagacuggagacccauggaagaguuaauguggaguuaauuuugugguucgggucagaaagcaaucuggaggcaaaauucuuuuuucuuggggaaaugacaggcuuuuucucuuaaggccuucuacugauuagaugaggcccacccacauuauacagaauaauacucagagucuacuguuucaaauguuaaucuuaacuaaaaaaaugccuuugcaacaacauacagauugguguuuaaccaaaugucuggguaucauggccuagcuaacuugacacauaaaauuaaccauaacaguguguauguacauauuuaacaacaauccacugacuccugggaaaauaucuguguauauauauuuauauagauauuuuuccauaucuauauaugugucugagaaagauauauacaaggguuaaaauauuuucauuuauauauucuugguauguguauaacuaucuuaaaaugacccagauuuggugcuuuggaguguuugauguauuuuauuaagacuccucuguaugauaagcuuuauuuauaaacauagugcucguagugaguauucagcauaagcaggauaggccugaagaauucuaacuauugugcuuuuagaccugaccagaaacaguuucugccauccuaguuugugaaauagacauacuuaaaauuccucuuagaaaggaacaaaagcuccugguuaaaauaugauaaaauaacuacaucuuagcuugaaagaugggaacuauuauaugcugaucaguauguugggcuuuuuaauuuagauuuuuaaagagcgagaagaagauuugaggcguuugucucgcccauuggaauguucuuguuuccgaacaucuaucugggaugaaacccucuauaagguguguaugucucccugaguucccucauuuuaagagcaugaaaaaaaaccuagaaggauauuaacaaaccuaaaagauuuuaaacuauuucauagccaucuagauuuguuguacuaaaaagaaaaauaaucugcaacaaauuguuugaagaauaucaaacuuaacauuaagagacuuggguuuugaucuuauauuggguugacauagcuaccaagucacacugaauuagccaguuuggucaugauuaauuugauacuggucuuuguaauagcagagguuucacuuacuggccaucauccauuuugaccuguuguggucucaaugcugauuggaguuguaucuaguauucagguacuucuacaugauauaagcuagucugccuaaguuuggauggcaauaaaaugaaaauauuuagggaagagauuggagaaggagucuuagaaucagacauguuaugccuagcauaugguauaauagcuucaacuuucaugccaaauuggagacaagcauucuuucaaccagaaguacuguucccauugcuggaauggauaccacacugcuuacacuaauuauggagguuacaacaauagcuuuguuauggaugaagcugaaauuaccuuauuggcacauaggcuccuuauucugauuccucccuuucuccuacugaucuaguuauuugaaggacuagguccuuuuggauccuucuguaguuagcccuucccuucagacugcuucugguauccauugacaagucugacucuggguaggaaagcacccuucucugucacugguagcuacagccucaguaucaacagcaucugacaaguaucuacaaccagaagcacagaaaccugauguggcaaggagaaaaaccauuggacuuuuaaauagccauugcuuuuuuuuuuuuuaacuaauucauuuuccccaauauuauguugacccagccucacucuaauaacagaucauuuugagauaccugucuaggaaauacuguucuagauuaauaugggccgaauuucucucaaagccuuauucccauagaacagguaaccgugaauaaggauggacaugacgcacugauaagaaccaacugcggugugaaggauggcaauacauaacacgaccaaagacaauuggcuaaucacaacacugcugugagugacaaugucucugcugugguuagcuuuggugccuucuccaagguaaauucagcagugacauuaacaccgaccugggaacuuggaaccugaacccucaugccuaaguaauaaaacuaauuggaacagagacauggcacuucugucucuuacaucaauguugcauagagcuaacuuaaauuuuuauauuaaguuuuauucaacaagcacucuuuacauaccugcuugaugcuguuggauacacaaaugacuaagaccagguuccugcccucuuguaggggagagaagaacaaaguacaccuuaccagacaaauuggagugagagugaaggaaguauuauaaugaaaauacaaauaaaagagccuacaagaauagagggagagugugguuaauuucaacugcuuacauuagucauacuccuggaugaagucaguuuuaggcaaaaacacaguagaccauuuugaauucaauuggaucaauaauuuauauggauaacaacaaaccuuugggaaugauaaugccacuaguuucucuuuuaaugguauauuauucuauugaggggaggggccauuugucuauguggcucugcuacuuucauaaaauugauucuuagguauauguuaaauauagcauaauuagguucugaucuuuagagaaaucuacacuguuggacuuaaauauuugugacuagauuaggagcuuuuuaacaaaguagaucauauuuuucaacuuuuuuccuaaggcaacaugauggcauuaaauauuuguuugcuuucaauuaucaauggaaagaaguuucuccagcauuuuacaaaaguguuugaacuuaaaaaaaauucaacucaaggguaaaaaucagaugcuagcuucauuuucucauuucauuuguguuauaucauauuuaaugucaguauuuguuugggacuggauuaucaucauauuuugcuguccacauauuauaguguacuuacuaauuucaaaggucugggacugacuagcuguuaauaauaguacacuguguuucuguucuguuaggcuugguccagcauaguuuaucagcugauucccaauguucagcagcuggaaaugaaccuaaggaauuuugcugaaauuaucgaagcugaugaaguacuucuuuuugagagagcuacuuuucugguaagaacuuucugcuuugcagauguacuucacacuguacguucuuuguuuucagcaacagagaacagcaugucacuacuuucaggaagaaccuuuuucccucuugucaacuuuagcauguacagacuuauuuauaaaauaguauugucagcaagugaccugaaagaagcccuuugguguguagcucuuuggaaguuagugaaacuuagauuuuuccagguauguauuauuagagaguucagauuguuggcugggcaugggggcucacgccuguaaucccagcacuuugggaggccgaggcggguggaucaccugaggucgggaguuagagaccagccugaccaacauggagaaaccccgucucuaccaaaaaauacaaaauuagccagguguggugacgcaugccuauaaucccagcuacuugggaggcugaggcaggagaaucgcuugaacucgggaggcggagguuggggugagcugagaucaugccauugcacuccagccugggcaacaagagcgaaacuccaucucaaaaaaaaagagaguucagauuauuuaugcuaguaacuguucauuuauguuaaaggauuccuauuuccuguggacuuuuauuaugaaaugugggauauuuuccuuuugagaaaacucacauccuauccuuuucucuaaaagacucauugaaaacuuuuaauguagaagagauguuauggucaucucagugacauaggaguucacaugaagaaguggagagggaaagaggcauguugguauuuuuauuuuucuuguaaauugaacuuagcaacuauauuagagccuauuguuuguauaacccugaaagggggaugcaaaaaccaguauuguauuuguaaauacauuuuaaaaauagcaauaauagaaacuaaggugucacaacacacugcauaaguaauugcuaauuagccuugguaaauguaacucuaagagcaguucccaguaaauaauuuguuucugagcccugccaaugcuuggugauuuuagaaacaauucuuaaucucuaggggcuuguuuuccuucuacaaauaucuauaucauagauuuauugugcagaugaaaaugggacacaggaacauugagcacccagcaagccuuggcauuuaguugacaaacuauuaaauauugauuccuuuugcuacuauagcaacagggcagagaauccaaaguacaauuuuucccucuuccuuuguggaaauauuauuuguaaccccagagguauuugggagccaucuuucuagcugguauagauggggcaaggaguccuaauuagaguaucuuucugucucagcccacuggcagaggucacuugcuuggaauugugcuacccugagccuguuuuuccugcuagugugaguaacaaugagcaagaaagcuauucugucuugauguacguggcaggaccgaaaccugcuucagcaguauuccccuacuaugucugccacacaugguuguagagguuaaccuaauauaagcucccuguuccuuacuaauaguaacagguaguuuuuguuucucuugagaccaaguuuagaugugacugaacauuuucacugagcggggugaagucaagcaagggggauuuguucuuccacugguauagaaauuauguuuugaaauuuucacauugucucauggaauuucccugugaguuuucuucuggugagugacucaguuuugcuuccuacuagacacucugcaucuguauauucagccuauagguaauacuugugugguuuuauuaaaaucugaaaaaguuagaaaaaguauuuucagcugguguggguguccauccugaauaaguucauuuguaaauauuccucagggauuggaaucaaacaguuaagcuuuuaaaauacaauuccaaaagcuauuugguuagcuuggccuuuauuaaaauuaaacacaugaaguauaccucaagaacagcuaggaauuuuuauuuguuuuucuuuuugauugauacuuuuuaaaaaucgaagaccaucaugcgaaauauugaaauaaaaugaauauuuagugauuaaaguuagaaaaaauagcagugaaccaaaauaggcaauacguaaaugauuuaauuauaaccaaaugguacuagaugggccaucugaauggacguugaaaccacacagaauguugauaauauauaggacagaggaaaagagacaauaagccaggugccaagucuacccuaaaaaccagugaccaagggacugacaaaugucugcuuugaggaguagcagaggaugauguaacuauuuugcauggauucaaaggacaauauucuuuuucauagguaauuucucacuaucaguguaaagagcagcgugaugcccauagauuugagaaaauaagcaacauuauuaagcaguucaagcugagcugcagguaagagaucuaguaggaaugaucuguuuaucucuugaaaaaauuauugucauuuuuuagaaguucaaauaacuauaguuaacuguacuucuauauucagaauaguuccuucaaucaaagacaaagcuaaauucuaaggggccuccaguugacugaaaugcaggucguuguccuuuaaugcaaacucagcugguacagaaguguaugaaaaauauccaaacagaauauccuuuugagaugauugauacuauuugcgaagaaauaaauagaauauccaagggaguuuugaaaaagaaggaggaaggagaauuugccuuacugaauaccaaaauuuacucuaaaacuacuacuuuaaguauuuacuauuugacuuuaaaauagugagguacugauucagaaaugguacagaauggagagucuagaaauguuuaaucacauugugucagcuauuguuaaauaaaguuugaaucauagcauugugaaucuaggaaaaaggaauggccgaacaucauaauuuagcaaagauuuaauaaucaaaauccuuacccugauaacaguuugauuccagaacagcaggaauaaguuuacucucuuuaugccuuagcacacuuugagacuuucuggaauguuuaugcuaacauuuugaagaagaaauagccaaugacaagcaaauauaguugccuuguuuguuuucaaagaaaaaaagaucauuucuugaauuuaaauguaacugaaaaguuauauuaaucucaaugauaaggaaauuucaacuuaagaugcuuauuaaauauugaagaagucuucugaaacaugauuuuaaacauggaucuaggucuaagccaauuuucauuucacagucaguuucaagugcuuuagccagaugugguggcaugcaccucuguagucccagcuacuugggaggcuuaggcaggaggaucacuugagccaggauuucaaggcugcaaugagccaugauggcaccacugcacuccagccugggugacagagcgaaacucuugacucauaaaaaaauaaauugaaauuuaaaaaauuuuaaaagucaaguccuagcccacuuuugucccaguuacuuuucaaaacauguuaaauucaguauaagaguuuccuuggaaaaaguagaguuagugauuaacaaucuuaaugaaguggugaauugagguauagugcuauaccucaaucaucaaaagauguuuaacauaaauaagagcuuguuguaguguuauuauuucauucuuuaaccucucuucuucauuuuccuauagcaagcuggcugccucuuuccagaguauggaagucaggaacucuaacuucgcugcuuucauugacaucuuuacauccaacacuuaugugaugguugugaugucugauccguccauucguaaguuuaaacuuagcugaccuagguucaaagccacauacucuuuaaacaauugucccagagguaguacuuuauuagauacuuaaaagcuauuuuauaguggggaugguuacauaacaaugugagggcacuuaaucccaaugaacuguaugcuuaaaaauaauuuaaaugauaaacuuuguguuauguauacuuuaccacaauaagaaaaaguauuuuaguacuagugguaaauaguuuuuauuuaauagacuuauauuuuaaagcuuaaaaauaauuuagcuucuaggguauuacguuuuucuucaugggaacuucaaaaagcaagucacuaaauccaagaauuuuaaagaaaaaacccaaauacaugauuuaugcugcaucugguauagauuuuuaaaagacuagucaaucuaagcucuaaacuauuaaaugacaaaccauuucauaugucauugcauauuccuauguaccacauucucauauuucuguuaugggcaugaagggguguuugaugcuuccaugccauaauaaccaugacuaucacaaccauugaaauaaagguucuugcaguauuuucaggauggucccagaaauuuaaauuaaucucucauccauuggcuuuugcuacuuuagguuaauauuaaaauauaacauacauuuuugggguuuaugcuguuagcuccaaaccaaaagauuuuggaaauuuauuuuggaaauuuuguguuuagaauaugaauaaaucugcuuauucagaaaaauuaaaccuugauaacuugggaccuccuauuccuguauguucucugacauacauugagggauuuggcucucuuuuguuuauuuguuuuacuagucagacauuccuuuggcugcccauacuuaauucuguuggguguuuccgcccccgcccucagcuucugcagcuacucugaucaacauccgcaaugccaggaaacacuuugaaaagcuggaaagaguggauggaccaaagcagugucuucucaugcgcuaaacauugaugaauauuguuucacacaaaaauuaaaaguuuccuaauuaauguuguauucauauauguaggcucugaaauguugugaugcuuauugcuucuguauuucuucucuacucccuagucuuaauguuuaaccuugaaugcuauuaacuuaaauagccauugaggaguuagaagaugaauuguucaugaagucgguguuacauaaaaguaggugauauguaaguuuucugauaacaagguucuaauaguguuuaaauguacugguaaccugguuccaauaguuguguuugcccaagccuuucucggcaucaucuuguauuccuuaucagauaguaaguaaccuguaaguuuggaguauuacuguuuucucagcaugcauuaaaaauauuccuuaacuucaauuguaaauaaacuuuugguguuaggga

SEQ ID NO: 192866 - RNA, 3418 nt, Homo sapiens
ucucggggugggauaauccuccuaaacacgauccuagggccaaaaggcaaaaagaaaagauuuauccauuuuuuaauuuuuuauuuuuuuuagucauuuuuaaugcauuuuucucugugcacaagagaaauaacugaugaagucaaaagacacacuuuccuuuauacauagcaguuaaaaguaaugcaaacaucacaugacacuuucagugaaaguuacauuuccaauuacaaaucaaaaugcauauuagggucucuuuaugggagaagcugagaaggaagucuuagguaaaaagcacuuuccuggcauuacuacacugauccuucaggcugcacaaagauuaaggucauauacagucaaucugcaaauguugacacaauguuacacuguaaauuuucuguacaauuaaauguauacuuagagauaccaggauaaacauuucuacuauauuuuaacugaacuugccuagccaacauuuucacugagaaguuuaucaaagaugcuguaagauucuacaaaauugugagacauaacuagcuccagaaacauuucuuguauucuuucucauuuugguuacacauauuacacucagauucuacuguaauauuuuuagauguacagugccaauugugcuuacuguacuguauacaaauauagcaaaaaagaucaaugguauaaaucuuacagcauuuugcuagcaaaaauacaugccaaagucacaauaagcaauaucguaccacaaauuagagagcuucaaauaauuugcuucuguuuuuaauaucuucauucuacauuaaauuacuaucauaggcuaauguuuaaaaaugcaaauaaauuggacaucuguaggacaacacuuguucacccaacugugaagguugauaccuguuuccaaaaaucacaauaaaugcagaauaaagagaaguguuugcaugcaacacuuuugagugaaacagcauugauucccaccacucaaaacggcuaaggaaggaaacuaaaggaaauaaggaaggaaggaaacaaagagggagggaguggggagacaagaggaagggaagguaggaaaaauaagcaaaggagaaagggagugagggaaguaggagggagggacuccaucuuaaaaugcaucauauuagacuuacaacuagacagauuuaaaagaaucaaaaugaaaguaaagaacgauuuuguguguguguuuaaagauuuaagagccauuaucaaaaauaagauacauuuuuuuuccagguacagaaaugugauuacgauggcugggagcccagcagccuuucaauggcugcauugaugucgccuccuguugcuauuagggccugcaaguuugcuucacgguuuaagaaccccauugcguugagcuguuccaguuguugcugaaaucugacuucuggauucggcagcuguggagcauuugcuccagccagggccugcaccauuugcugaaugaacugcugguuggguccagauucugauguaggacucgugguuucacuaggugcagcgcuggacacaguaggccccguggggccaccagagccgguggagccagggggggcugcagggccaguggguccuaugggcccaauggggccuauggggguaaaagggacuauagggccuauggggccuaugggggugacugggccuacagggccuauagcgguucccagcacccccacccccacaccuggagugaagcucggaaucaggccaggugcuucaguggcuaaugucuguagccccugcuggaucugcauuaaagccugcauugcucuuggguuugacauggcugauagugugucuggauucugcaucugcugcaggaaggcugggagcuguggccgcaucugcuccugcagcugaggauuugcaguaaacagcgggcuauucagcaucaucugugcagccaaaucuggauucuggcucagcgacugcaucaugcuucucauguagggcgccgacagcauauucugaaucagcuggggguuuucaguuaucuguugcagcaggcucugcaugccugggguacuaaagaugcuggcgacauaauuagcggcagcaacgguguucccaguagcauugcuggaacuauugccagacccacuaccagugcuuguggucgugcugguaguugcagaacucuggguagcuggcgguggugcccauggauuggguaguggaucgcgauuuucugugcgggaaggcugcguaccuuccccagaggaggaacuacuccccacggaggcaaauggauuacccccaaacugcucuugugcggcauucagcaucggcucuugaaugucaguguacaugcgccguaaagcauuauagccaccugggaugcuuucuagauugcuaagagccaggucuugauuucucaucaucucuugcaucauggcuggauuccuggcaauuucgagugucugccucauuaugucuggguuguugagcaggugacugauuucuggguuucucugaaucaauugcugcaucuguggauuagccauaaugagcugccucaucagaucgggauucgaaagcaugcucugaacaaagggauuuuccauuauuuggaucaucaucucagggcuggccauaagcugcugcugcaucuggcucuggagcucagagaaguuggucgagcucaagcccaggcugcuaaggccugcaaguccucccaggcuccccaacccaaacggguugcuauuuguggaaauagguguggaguuacuccugggagucgacgccgagguaguguuaguucccgcggcauugcuaggcugcguggacuggcccugaggucgguucuggcuuuugaugacaaggugaacagucagcccaucauggaugccaugcuggaucaagguaucuugaucuuuuaagauuuuuccggcaaaaaucagcacuagcugaucgguuugggauuugaagcguuucgaaaucgcuuccuuaaacugcugaaccgagcuguucucgggcaccgcgaacuccucuuucucuuugggagucuucaccgugacuuugaugauuuuaggcucagccggggcagcagccgagccuugggccgcagcagggccgcgggaggggcgcggggggccgcugcucucgccauucucagccauggcggccgcggugacgcaggcgggcagggaaggcgcgggcgggcgaaagagagagcgcgagggaaggaggaaggaaggaggcaccgccgcagcgggcugggccgggucaggcggggagcgcggagcacgguaccucugugaugaagacugcgguucccugguccuccgguggagaaaggccugggcguaggccgcuggcugaggucuccgcgcuccggucucugggccuccuccgccgccgccuugugauccgaccgcgcgcacucccagcaacucuggca

SEQ ID NO: 192867 - RNA, 3053 nt, Homo sapiens
ggccaauguucaaaugcgcagcucuuagucgcgggccgacugguguuuauccgucacucgccgagguuccuugggucauggugccagccugacugagaagaggacgcucccgggagacgaaugaggaaccaccuccuccuacuguucaaguacaggggccugguccgcaaagggaagaaaagcaaaagacgaaaauggcuaaauucgugauccgcccagccacugccgccgacugcagugacauacugcggcugaucaagguagcggagagccagagcuccucccggggcgugggguggagguggcuccguuucccagaguggggugauucacgucuugaggucucggccggugugagagcccagccuguuccccuuucugcgcccauccccggcucggccgccaccccgcccgcccgccccauuccguuccccugagcuggccgggccggagccucauuuuguuuucuacuuuuuucucuccuaugugcauccccccaggagcuggcuaaauaugaauacauggaagaacaaguaaucuuaacugaaaaagguaauucaacaguggcgggacgggggacaagcguucggugccugucaccuucgccaaggccauuaccgccccugcucccccuucuugcagaucugcuagaagaugguuuuggagagcaccccuuuuaccacugccugguugcagaagugccgaaagagcacuggacuccggaagguaaccccucgcccuuuccagaagccagagagaccaaguguuauguaagaaguagugucggcuguguagaaccacugacuacacaggccgaaguuacugagaacuuggacagaaaaaauagccagcaaguguucaaacuacugaggaaaaaaaaaaauuagauaugcugcacuuaagaauacuagggcagguuaaaagagcuguuuaaguaaguaucagagugcuguggagacucggaaguguuuaagcugcuuaaguaaguauaagugcuguggagacccggaagaguuagauauaaugucauuuguuguaauucaguuucauaaaaugguucuuguuugacccuaacguaacaguuuuuguaauuguguuaaaucacauuuuuuucuuuaauuugucccaaucuucagguuacagucucuagcuucgccauguacauggcccuuccguguacauggaugggcggggagguaacuaaaagauccuuuacacaauaaaguagaugaucaugauaaaugagguaagguccuauuaucacacacuucaaacacgguagaucagaaacccacuaugauacucgcuuccugucuguuugcuaaggaauauaaaauggcuagaaaguuuaauuugaaaccuuugccuccauuuggaauaguagacaccaguuaagagggugucagaugccuuuuuuuuuuuuuuuuuuuuggcuggucccuguugauuggucagaagacagcucagcuaaaaggggaaguugucugggugguugcuuuuuuucugacgucuguuccucaggcuggaagaaaugagcagaaaacaagggaugaguacuuuuuagaguaugugcauguuacguaauaccuguuucugggcaaugcugcuucuucugacucaacaaauggggagagcaaauugaaaaugcguaaauuggaaggcaaguucugaaauuaaacguuguacuuuggccugauguucugaccuuuaaggaagcaagaguuuguaaacuuccaaauauuuacuauucugaacugccguguaaaccugacguauucccaagucaacauaccaguauaccaauaggaugugaauaauguguguguugaguuuaaaaccauagcaguuuugcucuggcaaguaaugaaagcguucucgcuuccugagugugagcuccagcagacugcagaguggccaguccacaguuguagccugacuucagugaguucugaugugugcuuuuugcaaauacauguucucagaacagugagaucauccagcaguggccuggacugcacucacauaaaaaucaugagacagccauggcuacuuguuucuguaauacaugcauguguguuuuuuaaaaccuaugauaggccucugauucugcagcugcaacuuuuauggaauguuuuccuucuccacaucucaugugaugcucuuauuacaggacacagcauuguugguuuugccauguacuauuuuaccuaugacccguggauuggcaaguuauuguaucuugaggacuucuucgugaugagugauuauagagguacgauugaguucggagcagagggucugaagagaguucagaguuauaaaugcuuacaaugacuuuuuaaauuguacucuuucuuuuuaggcuuuggcauaggaucagaaauucugaagaaucuaagccagguaugucuuaguuuuugguuuccaaauuuguaaguuuacuggauuauuuuaaugauggaauaaaaauugggucuugagagcaggcugaaaugucacugaguguguguuuuacucucucauaauagguugcaaugaggugucgcugcagcagcaugcacuucuugguagcagaauggaaugaaccauccaucaacuucuauaaaagaagaggugcuucugaucuguccagugaagaggguuggagacuguucaagaucgacaaggaguacuugcuaaaaauggcaacagaggagugaggagugcugcuguagaugacaaccuccauucuauuuuagaauaaauucccaacuucucuugcuuucuaugcuguuuguagugaaauaauagaaugagcacccauuccaaagcuuuauuaccaguggcguuguugcauguuugaaaugaggucuguuuaaaguggcaaucucagaugcaguuuggagagucagaucuuucuccuugaauaucuuucgauaaacaacaagguggugugaucuuaauauauuugaaaaaaacuucauucucgugagucauuuaaauguguacaauguacacacugguacuuagaguuucuguuugauucuuuuuuaauaaacuacucuuugauuuaa

SEQ ID NO: 192868 - RNA, 32809 nt, Homo sapiens
cgcccuuuccugccagaccuggaggggcggggcggugccggcaagauggcugcgcccgagaagaugacguuucccgagaaaccaagguaagcgccguacggggagaugagcaggcgagcgggccgaucgugggcauggaggaugugguggcaggaagaaaagagaagcugggccaagcuaagugagccaccgcggcagcuccauuccuuccuggugcgcgcucuggugcccuccccggacuugcacgggcggcuguggcucaggcaagcgaggagaggaucagguuggcggauggagaagaacugucugggagugggaggaugaggcgaugauagauggcuguucuguaauuaaaauacaggaagcaagguuucucuccucagcacccgaacuauuuccuuucauugggcacagaggagcggggagcucgggcagcgcugcauuguagccgcugaucgucguguauaugucuuaaucuuccagccacaaaaaguacagggccgcccugaagaaggagaaacgaaagaaacgucggcaggaacuugcucgacugagagacucaggugauggacucuuuauucuguuuucuguguugugaaauugcucuguccacuccagcccuaacuugaagccccagugucagaaggaagucaaauauugugucggaggaaaaauagcugugacuucugcccccaaguaguuauuuagaaacacaugucagaaacaauguuaacauacuaaaggcaggaagaggaagucuuggugaaugaucgcccacugauucuguguaacuuauaaaguaucuaauauuacaguugcaagcuucaugaauuacagcagcuagcacaguccuugcacacguaguaaguauucggugaauguuuuucuucguaaaaccagcaggaguugaagguauuaauuagacguuuugcaaguuuuucucaaacuugacuaauaugagacccuugguuuacccaaauuauuauguuauucaaauauauaucaacauaauacuaguuaugaagcucauuuauuuauuuuugagacagggucuuguucuguugcccaggagggaugugcacaaccacggcucacagcagccuccaccucccaggcucaagcaguccucccaccucagccucccuaguagcugggacuacaggcauucaccaccacaccuggcuaauuuuuucuuuucuuuucuuuuuuuuuuuuuuuuuuuuugagacggagucucgcucuguugcccaggcuggagugcaguggcacgaucuuggcucacugcagccuccgcccccuggguucaagcaguucuccugcugcagccucccgaguagcugggauuacaggcgugcgcaaccacacccggcuaauuuuuguauuuuuaguagagauggggugaaaccccaucauguuggccaggcugguuucgaacuucugaccucaggugauccacccaccucagccucccaaagugcugggauuaaaggcgugagcuaccgccccuggcccaccuggcuaauuuuuaaaauuuucguagagacgggauuucacuguguugccugggcuggucucgaacuccuggccucaagcaauccuuccaccucggccucccaaagugcugggauuauaggcaugagccaccacaccugaccugaagccauuguuugacuauaaaacaauauaugggcugggcgcgugguggcucaugccugaaaucccagcacuuuggaaagccgaggcagauggaucaccugaggucagggguucgagaccugccuggccaacaugaugaaacccugccucuacuaaaaauacaagauuagcugggcuugguggcaggugccuguaaucccagcuacucaggaggcugaggcaagaggaucaguugaaccugggaggcagagguugcagugagccgagauccugccacugcacuucaguuugggcaacagagugagauucugucucaaaaaacaaacaaacaaauaaaaauacauuuauaaauuauaaaacuaaaugaaauuacacauucgguaaaauuuaaaucuacaucagguaaugcuagggaugaugugaaacuaaugcuccucacaauauguauauggcacugaugggaguuuggaaugccucuacuaauguugccuuauaguuauuuaccacuuuuucuaugaaauuacuguagaaccuuuauuuguacagauggucauuugaccuucacauggcaaaaccuaacauuuauguauuaaaucuaccugcuuaaugcaauaaaauuaggacuuaguuauaaaauuauguaguaguuauaaauccagaugggagcacugaaaucacacaguaguacuggcuuauaaugauugucauccgcauuauccagaauaugcucaugaaauuauccuagacaauucuuaaaauccagagaccauggccucaaguaacuaggauucuuggaccuugagaaacauagccauagagguuuuauuuaccauugguguuccugaguaauuauuuuagugucaguacugggauauuuagaauggaaggagcaguguguuuaacugcaaccuguguuagcauuucugucuuauuaguugaaaacucauccacuagaggcagaacaaagcaucagggauaaaaggaaaaguagaauagguuggaguuauugaggcccuuauuguacuucgucucuccccccuugaaauuuucagcuacuuuacuuuguucauuuaaucuguuuuauucuaaauauuauauauucuaaauuuguuuuaacuucuuucucuuuuucuuuuccugcacuaaauccuauaacagcugguauuuguauuguuuugauuuuuuuuuuccuuuuuacuuagcaaaauguguucagaaugagccucuguggagagucaggcgagucaugucccaugguaguuuagcccauuuuaauggacuaaauccaggucacuggucugucaagauuauguaacuaauggcauauccaagacuaagcaccugucucugcacuucugcuccuacuuuugcccacuccaacucacaauucuuugccuagugguacuucaugaauacuguagacuauggaacacuccugguuuuuuuuuuugagacagagucucacucucucgcccaggcuggagugcaauggcacgaucuaggcucacuguaaccucugccucccagguucaagugauucuucugccucagccuccugaguagcugggauuacagguacccacuaucaugcccggcuaauucuuguacuuuuguagagaugggguuucaccauguuggccaggcuggucucaaacuccugaucucaggugaucugcccaccuuggccucccaaagugcugggauuacaggcgugagccacugcgcccggccaggaacacugcuguuuauuguagcacacguuagauggguaaacauuacccagaaggcuagaauguugaguguaacuaugagagugccuuggcaaaugauuggagugccuuggcaaaugauuucuggaauagugagcucuuaauuacagauagcuucuuuggcauccauucuacuucagauaacuggaaacaagcuaccucgucagaaauuaagauauuaaaagcaaguugcaaaacuauagcaugauucuguguguacaguuacauguacagguugaguaucccuuaucugaaaugcuugcguuguauuuaccaguucagcaucccaaauccaaagauccaaaauucgaaaugcuccaaugagcauuuccuuugagcauuguugucacucaaaauauuucucauuuuuggauuuggggugcucaaccuguauaauaccauuggauauacauuugauccuugaacaaugugggaguuaggggacucugaccgccccccgccccuccccacaguggaaaauuugcauauaacuuuucacucccccaaaacuuacuauuaagugccugcuguugacucuaagccuuaccaauaacauaaacaguugauuaacacauacuuuguauguuauauguauuauauaccauauucuuauaauaaaguaagcuagagaaaagaauguuacuaagaaaaucccgaggaggagaaaauauauuugcccuucauuaaauggaagugguucaucauaaaggucuucauucuccuugucuuaauguugaguaggccgaggaggaagaggaugauuuggucuugcucucuuggguggcagagguggaagagguggaggagguagaagggaaggcaagaggguagacggcacuugguguaacuuugcagaaauacauuauaauuucugucugacauuuuugcuuuuucauuucucuaaaaauguuucuauacaguaccaauucuuccaccacuugcuuuaguuuaaaugcauuaguuuucaguauagaaggguccauaaaagaagucaaaagcagucuugaauaauuggcccuucugccagauugucuagugucaauuuguuuucuggcacugcuucaccucaguuuucuuccucaucaccuugcacugguuuggaaggacucauccccaucaaauuggcuuuuguuaacuacucuggugugucuguuagcucuugaauuucuucaagauaucuugagacccuucaccccgaccccccugcacuuuucccccccccccauauuuacaaucucuuucacgauuuccuugauuggcucugucuuaaguccaaugaugccaugcacaauaucuggacacauuuuuuucuccagcaggacuuuguuuugggcuugaugauuuucauggcuuuuucuauaacaacaauagcaucuucaaugguauaaucuuuacacacuuucuugauacucucuguauuaggguucucucccauagcauugacaauccuuuccguagaguaccacguguaaugagcuuuagagguucuuacgacccccuggucuagaggcugaauuagaaacauuguguuugggggcaaguagaccacuuugacaccuucaguguugaacucaugggguucuggguggccaggggcauuguccaauauuaaaauaauuuuaaaauccaguuccuuauuggcaagguacuuccugacuucagggacaaagcaucaguggaaccaauucagaaaaaaggauuuccauuguccaggccuucuaguuguacaaccaaaagacaggcagcuggugcugaucuuuucccuucaaggauuggggguggggguuagcagcuuuauagauaagggcaguucugaucauaaaccccacuacguuuucaugaaacaguagaguuagccugucucuuuuuguuuucaauccugcugcuugcuucucuuccuacuaaauguccuuugugguguuuuucuagaauaggauacuuucaucugcauuaaaaaccuguucaggccaggcgcaguggcucacgccuggaguccuagcacuuugggaggccaaggcggguggaucacgaggucgggacuucgagggcagccuggccaacauggugaaacccugucucugcuaaaaauacaaaaaguagcugggcguccuauucacgcagauauccuuucuccucagugauuuucuuuuuuguuuuuuguuuuuuuuuuugagauggagucuugcucugucgcccaggcuggagugcaguggcaugaacucggcucacugcaaccuccgccucccggguugaagcaauucuccugccucagccuccagaguaguugggauuacagacacgcaccaccgcgcccggccaucaugacuuuucucugcuucuugagagcacuuccagcaucgcuagucgcacuuugugugagucucaugauguuauucaagguuuaccauuuuguaguaaacacagugaaaaauacgccagagaucacuucuuacugccauacacaauuuacugaagagaugaacugcucaugcagagaugaguagugucacaagguguuuuaagugaauacucauaguauuugagcucacugcaauagcagcaggagguggcuaugaaauuauugcaguagugcaguguguacuacaguuaauuuuuuucuuccuucuguaccucauuggaugcguuuuuuuccuuguuuuguacuacaguuaauuucaugcaguuaugauuuaauacugcauauuuauguuuguuuacauuuuucucaacugugaaugugccauauauggucuauaaauauaaguuuugauaaauuuuaacuuuaaaaaaaguugucaaugauuauguuguagcacaacuuuuauaguaauauucaaggaaaaauguuugagaccgaacuucucugucuuagaauggaaugaagucagagaucauuuuguuucaaaucguuuuuuuuuuuuuuuuuuuuuuuuuuugagacagagucucgcucugucgcccaggcuagggugcaguggugcaauuucggcucacugcaaccucugcuucccaguuucaagcaauucuccugccucagcuuccugaguagcugggauuacaggcgugcaccaccacaccuggcuaauuuuuuuauuuuuaguagagaugggguuucgccauguuggccaggcuggucucgaucuccugaccucaaguaauccguccaccucggccuccgaaagugcuaggauuacaggcaugagccaccgcucccuggccuguuucaaaugcuuuaagcaaggaaacaauaaaacacuuaacuuauauuguaacaguaucuguauaugugcugcucaagccagcacaauauugcuuaacaguaucugcauuaacuuuuuuuuuuuuuuuuuuugagacgguguuuugcucuuguuucccaggcuggagugcaguggcgcgaucuugacucacugcaaccuccaccucccggguucaagcaauucuccucccucagccucccgaguagcugggauuacggggggcugccaccacgcccggcuaauuuuuguauuuuuaguagagaugggguucaccauguuggccaggcuggucucgaacuccugaccucaggugauccgcccgccuuggccucccaaagugcugggauuccaggcaugagccaccacgcccagcucugcauuaacguuuuauaauagauuuauauuuaugguagcaaaugauaaaauagacuaguauguacauauauuuuaugcauucaugacauaccuuuuucuuaauuuuuuucaguguuucuaggccaugccacuuaccuauuuuuuuuuucaaauuguugcaaauauccccuaaauguuccaguguguuuacugaaaaaaaaucuguauuuaaauagaccaaggugguucaaaccuguguuguucaagggucagcuguauuguauguauauguauugcauauguccgauuguacacguggggaaaaugcuguacccagaacuguuagcaaucacuucuguggaguauaugagcuugguuucgaggugauggggaguugagugagucagucaacagguguuugugagugucagcugugucuaugcccugucuaaucuauggcauaccucugcaaguagucaggccauauccucugugccagguucucuggcgcuuuaaguacauuagaucauuuaauuaucugaacaauuagauacuauuuuauaugauugagaacuuauucuacauuuguugcccauuuuaauuccagcugcugaaauaauaaaguuuacuuacuuaagaaaaguaaauuauuguaauuaucuaagacuggaugagccuucaguuagaacuguacucaacacaugugacaaacagacucuuuuuucuuuaagccugacaucuguaacauuucuuuaagauuauuucagucuuccauuucucuuccacuuucacugauuuuuuucccaaauuuugaaugggagaggauguaaaugucuauucuauuaaaaguuguuuuuucauguuuuuauuugggaaauguucuaaucuacagaaaguugaaaaaaagagcacaauaaauauccaugaacccuucagcaagauuugccaguuguuaaaguuuggccuuucuuucuuuuucucuauuuaaagagauacauacauagaacauuuuuucugaaccuuuuggauggcaguugcagauagcagcaccucaccccuaaauucuucagcuugcaacuccuaagaauaaggacauucucccgcagaaccacaauaccaaacuugcaccugaguacaugagcaaguaauucaaugguaucauauacaggccauauuuaaacuuccccaaaccaggauugauuguuuugaaaaacucaagccaguuaucuuguggaaugcccuguauucuggauuguucugucuucucaugauuaacuucagguaacaacacucuuuagaacaaaggauuacagagcagauguuguaaacuucuuauugcauacaucaugagaccuuucacaucagguuguugcacucccggugaugcuaacugugguuaagguguuacccacccagggccggacaugcuggcucaugccuguaaucccagcacuuugggaggccgaggcaggcggaucacgaggucaggagauugagaccauccuggccaauguggugaaaccccgucuccacuaaaaauacaaaaauuagcugggcaugguggcgcgcgccuguagucccagcuacuugggaagcugaggcaggagaaucgcuugaacccaggaggcggagguugcagugagccaagaucgcgccauugcacuccagccuggcgacagagcaagacucccgucucaaaaaaaaaaaaaaaaaguguccagaucgcuccauuggaaagcauugcauuuuuucuuuucuaauuaguccucaugucuggggugauauguugagauagugugaauauacucuuccuagcaagcuuucauucgauguuuuuaaugucuuugucuaaauuuuuacaguggggguugcaaaagugaugauuuuucuacuuaaguuuuucuccauuuuuuaguuaccauucuucugugaagauggauguucccuuccacacccccaccaccuuuuuuuuuuuuuuuuuugagauggaguuucacucuugucgcccaggcuguagugcaauggcacgaucuuggcucacugaaaccuccaccuccuggguucaagugauucuccugccucagcuucccgaguagcugggauuacaggugccugccaccaugccaagcuaauuuccuuuuuaaguauaauuguggaaccauugauuaauuuuuaaauguaaugugcuaucugccaccccuauuguccuuuuugaugcuuguguuguaccaaagaagguugaucagagaccuuuuuguuagaaaguuuaagaaaaagauuuuuaccauaauuuuauacauuaaagauuacauguauuuuuuuccugaauuuuugaccaaggauuugcagcacucaguuuaauaaaacauuuaaauucccuaggacucucacagaaggaggaagaggaggacacuuuuauugaagaacaacaacuagaagaagagaagcuauuggaaagagagaggucagugcuaauugaaacacuuaaagugaaugaaguuauuuuauuggaauauuaucaaccuuuacuaaccaguaccagucuucuguauaaaaucuuguaccaaauaggucuuauaaaauauccuguauaaaguauuuaaaucuguaguugaugggcuaaaacuagauguuauuuuuuuuaaaaauggaaguacuuuucuucuguuuuugcuaauuuauaauuuuuuuucuuucuuuuuuuuuuuuuuuuuuuuagacggagucucgcucuguugccaggcuggagugcaguggcaugaucucagcucacugcaaucuccgccucccggguucaagcgauucuccugccucagccuuccgaguagcugggacaacaggugugcaccaccacacccagcuaauuuuuguauuuuuaguagagacaggguuucaccaugucggccaggguggucuugaucucuugugaucaagugauccgccugccucagccucccaaagugcugggauuauaggcaugagccacugcgccugaccuguaauuguuuuugaaaacagaaaaaaaacaaaaaaaauuaacaaauguaaaaagggaaaagacuuuaauaauugcaacacacccaaagauagccacuguuaagaaagagaaaaagaaaguguaaauguacuuuacgugugucuuucuauaauggcaugauauuuauacauauuuuucuauaaauugcuuucuugcuaaauauauagugcauuuauuucaguacugaugcagggaucuaauucagccauuucaguggcaauacaguacccacuguacagauguagcauaauuuauuugcuauucauaguuuauucauuuauaauuuauaguucucuacugauggacuuucagguuauauugguuuuucacucauauguaaaaaguugcaguaagcauccaugcuuauauauccuugguaauuguccaguuauuuccuuaagaacaugacuaaaaaugagauuguuggaaucaaaucauaaguccauguaaaauguagauggccagguagaaagggcuuccugguuugcaguuugcagcccuucuggcagugaauguaggggcccaucuccccauaccuucacucauacuaggcauuaucaguuuauaaaacuauaaugaaacuguuucaaaugcacauuucugaauuagguagaguaucuuuuuauauguuuuauuaccuauuuguagauugcucaagucucacaccuuucucuuuugggauacauguuuuuuuaaaauuuguuuuuguuuuguuuuguuugagacggacucucguucugucaccaggcuggagugcaguggugugaucuccgcucaccgcaaccuccaccucccagguucacacgauucuccugccucagccucccgaguagccgggauuacaggcacgcaccgccacacccaguuaauuuuuuuuuguacuuuuaguagagaugggguuucaccauguuggccaggauggucucgaucucuugaccucaugaucugcccgccucggccucacaaagugcugagauuacaggugugagccaccgcgcucagccgaaauuucuuaaugucucuaagcuucuauuuccuugucuguaauauggagauaaagucaaucacaguauccaccucacagaauugugaagauuaaaggaggugauggauguauaguguuuaacacagugucagcagaugagaggugcugugauagcucuaguucuuauuauuauagauuucuguuaugaugaagacaauagauacgguaugaaauaagagaguaauuuuuuuccuguuuauuugaaaugcuucuuuuaaaucacauacauguaucuuugugcuccuuagaucuuuauuucuuuaugaguugcauacuauuauugaaaagcaagaaaauuauguaaaaauacuguaugacuuuauguccuauuucaaagcagauguauauucaaguuauuaaauuuuaaaauuuuuaacauuuuacuuucuuguggucuuaauuuauauaucauuugguucauuuauauacaauuauauguuuuucaaaagauuuguaaaucagaguugugcccacugaaacaucuauaugguacccucacacauggcauaggaacacugauagaugcaaugugccagccucugccauggcuaaaagauguguuccuggaaucuguauuuggaaauguaauauauuuuauuuaaaauugugguuagguccccagacuagacauaaaacuuuacugaacuccuaauacugcugaaguaauauagaacaguuucucauauuuaauuucccuuuuauaaauucaguggaagaaugaauuugagguucuacacaccuaauuggcagguagacuuuggcaaucuaacccccucuuuauauuagaaauuugugauauuggaugucugagacacuugccacuuuaagguaauaccacucauuauaauuggucauauaaaaaauagacuagacacucacuaauuuauuuuuauuuuuucauuuuuugagacgaagucucgcucugucacccaggcuggagugcaguggcaugaucucggcucauugcaaacuccgccucccagauucaagcgauucuccugccucagccucccaaguagcugggauuauaggcggcugccaccacgccuggcuaauuuuuguauuuuuaguagagaugggguucaccauguuggccagccuggucucaaauuccugaccucaggugauccgcccgccucagccucccaaagugcuggauuacaggugcgagccauugcgcccggcccucacuaauuuauuuuuauaacuccauuucuuaaaaccuguagcuuuauuuuaaaaacaugauuacaauguacuuuuauuuuccuucuuuuggcuguuuagguguuuggaggcaaaccacaggagucucuuaacuguguguaguaguaguccaaagguuuauggcaaaggauacuggguuuucagcgugcugccaucauggaauugcuacuuuuaagaauaggggcugggugcaguggcucacacauguaaucccagcacuuugggaggccgaggcagguggaucacuugaggucaggaguucgagaccagccuggccaacaugaugaaacgcugucuguacuaaaaauacaaaaauuagccuugcgugguggugggcaccuguaaucccagcuacucgggaggcugaggcaggagaaucacuugaacccgggaggcagagguugcagugagccaagaucaugccacugcacuccagccugggcaacagaguaauacucugucucaaaauaaauaaauaaauaaaaauaaaugcauagaauaggaagggaaaugcuuucugaauaugaaaagguagaugcugcuuugaaacuugcuacccauuuuauugucaccuaaacaucacugugaucagucuagagggaaagucauaguguccuuuuuucuguaaaguaugucacagccauauauaccuaugaaauguaagagagauuuuaaguuauuacccauuaggaagauaguugcugacacguggugcuuuuccaaaagcucugcucuucucguucucuuacacccacuugacugcuuuaauagaaaauagcuuucgugauauuugaaucagucccaaaaugugucauuuugcucucguguguguguguauuuguggauuaaugcccauuucuuuuaucugauuacaucauuauacugauaggcaaagauuacaugaggagugguugcuaagagagcagaaggcacaagaagaauucagaauaaagaaggaaaaggaagaggcggcuaaaaaacggcaagaagaacaagagguaugguaggaaucacguaacuagugaacaaacugauuacuucaccauaauaacucucaugaagaguugccuaucuugggagguuggagugagcugagaucacgccauugcacuccagccugggcagcaagagcggaacuccaucucaaaaagaaaaaaaaaaaagaguugccuaucuugaacuuaaaaaaaaaaaacaaaaaacugaucuuauucaguuugccaguguuuuaaguuuuucaucuaugugcgcuguaugugaaauguuuuuaaaaagugacugaaacaaaguuacuuuuucuuccccuuuaaagagaaaguuaaaggaacaaugggaagaacagcagaggaaagagagagaagaggaggagcagaaacgacaggagaagaaagaaaaagaggugauuccugucaugggaugugcugugugaugaguuugaagaauaaucaguaggcaugucagaguuuggguuuuuuuuuucucuuuuucuugucauuucauuguuuguuuggaaagaaucauauuucaguuuagacauaacaccagaguucccuucugaugcucuucuucggguccgugcaguggcagauuccuuaaaguuuucuucagcuuuacccuauuuacccuuuauacugggcauuggcaaauguuguaaagggccagaugguaaauauuuuaggcuuuaugguuuggucucuguggcaaacauccaacucugccaguguacccugaaagcagccaucgauaauauguagaugaauggguauggcuguguuccaggaaagcuuuauuuacaaaacaggcagcuagcccuugcuuuauagcaaguuauguucuucugagguucugcuguauaugaguugacuucuuuagagaauaauacuuuguuuuguuuccacauuuauuuaggucauaagagaacugcuuaugacaugucagcaagaauuagaggauuuaaagaaaucaggaacucaaauauugaggaacuaggaaacaguuuuuguuauuuguauuaaaucuugacuuccucuuccacuuaggcuaugaagauaauuguagcuaacacacaguugcuuauuuaaaaaaaaaaaaaaaucugugaggcauauguguguauguaucuucucuaucuuccaggauucuuuuuuaaggauugauuugguauguuuugcugcuauuccuugacaguauauuuauuucagagguaucacagcucaucuucccuugacugauucaucaggauuugucuuuuuuguaauacagcuaaauuuaaauagcauaaaauuggauaaucaccuuauaauugggaaaaaugcaugugucuucauuguagucaauauggggcagaagcagccuccacgaucuuuguuuuuuguaucuuaggccaucaguuaauuucagugcagauuuuaaacaccuuuauuugagcacuucuuuccagaugaggcaaguucaugcuagguuuuuagggggcagaaaaauuguuuggaacuugucauuuuuuuauagagaggaauuaauucccauuuuaacaguagaguguuccucaacugaggucuuucaggaauucaguaacagcuaaggccucuuuugaaugcuuuuguuucagaggaaaucugugagacuucaaggagaaaugagggaaaugaaauagauucuaagcuuauaaaaaagaaucagcaguauguguuccugcuguaugcuagacacuucgcuagcggacagagacagagcagugaaagacacagucuuugcucucauugagcuaguuuuuuauaugggagugugagaugauaagcaaaacagaucauucaaaaugugaucauauuaagugcuauaaagaaauaaagcaggccaggcgugguggcucacgccuguaaucccagcacuuugggaggcugaggcgagaggaucacgaggucaggaguucgaggccagccuggucaacauggugaaaccccgucuguacuaaaaauacaaaaaauuagccaggcguggugaugggcgccuguagucccagcuacucaggagucugaggcagaagaaucacuugaaccgggaggcagagguuucagugagccaagcuugagccacugcacuccaaccugggcaauagaacuagacuucgucucaaaaaaaaaaaaaaaaaaagaaagaaauaaagcagagugaugugauagaguaaugagaauagaguugugcuucuauagauugccugcucaaggaaauuucugaggaggugauguuugagcugacaccugaguggagagaucucagcaagaagaagccugaagcuugaaggcugaaaaaaggccagggaaccugaaaucuagaguccaaaggagagaagggcaguggaggagguugcugagggagagggggcaguggaggagguugcugagggagagggggcaguggaggagguugcugagggagagggggcaguggaggagguugcugagggagaaggggcaguggaggguaagcagagucagaucauguagggcuuccuggauuugaaggaggaguuuggauuuuauguuuccuauaaugggaagccauugaagggguuuaagcagggaaugacucugucucauuuauaucuguaccuuuuaacagaucauucauuuaaaaaaaaaauuuuuuugagauggagucucaugcugucgcccaggcuggagugcaguggcgugaucucugcuuacugcaaccucugccuccuggguucaagcaauucauaugccucagccccccgaguagcugggauuacaggugccugcuaccacgcccagcuaauuuuuguauuuuuaguagagacaggguuucaccauguuggccaggcuggucucgagcuccugaccuccagggauccacccgccucggccucccaaagugcucgugugaaccacugcaccagacuuuuuuaacagaucauuuuuacuuuacugaaaccucugccucccggguucaagcgauucuucugccucagccuccugaguagcugggacuacaggcgcccaucaccacacccggcuaauuuuuuguguuuuuaguacagacaggguuucaccauguugaccagaggacaaggagagagagaggaauucaagucauauuuuuagguuuuuaguuugaauagacagauagacuggcaacacuauucacugagggagcauucagguggaugugggccagggaguguagaggacaagaguucuguuuugagcaccacaaauaagcaacuagacauacgagucuuauguaaugcuuuaaggggcuagggaagauaagacugucuguuaaacauagguacaacuuguucaaaugccaauuagguagaaauuuacuggcauauugcagaaccuccuuugccuuauuaaaaaguuagaauuuucuccuaaaugcuaauuaccacuggucaugucauauuuuagcuucugcuaaauguuuaugauuucaucuagcauuguuuuuuggguuuuuucguuuguuuguuuguucguuuuuuuuuagacagagucuugcucugucgccuaggcuggagugcaguggcgucaucucggcucacugcaaccucugccuccuggguucaagcgauucuccugucucagccucccaaguagcugggauuacaggcacgugccaccacaccuggcuaauuuuuguauuuuuaguagugacgggguuucaccgucuuggccaggcuggucuagaacuccugaccucaagugauccacccgccucagccucccaaagugcuaggauuauaggugugagccaccaugcccggccuagcauuguguuuuauauucacuaauacccccuuuuacgaacuaggacaugguauauauacucaaauauacuaaguauuacuauuauugaaacuauuauaagacuauuuuaaauauuuugcaaugugaucugguaaauuuucuauuugaauagaacgucucagcuaugggccgggcacgguagcucaugccuguaaucccagcacuuugggaggcugaggcggguggauugcuugagcucaggaguucgagacuagccugggcaacauggugaaacuccgucucuacagaaaauacaaaaguuauccaggcgugguggugugcgccuguaguccuagcuacucggaaggcugaggugggaggaucacuugagccugggaggcggagguugcagugagcugaggucacgccacugcacuccagccugggugacagagugagacccugucucaaaaaaaaaagagaaaagucucagcuauauauccuuugaaagcuuuucaaaagaucugugauucaaaagaaaacuagaacuugugugcguguguguguuuuaauuguuccacuugagauucuuaaccagagaaaccagaugugacuuaccugacuucuggguuuuuauuaguccuguguuugcaccauuuuaggaagcuuugcagaagaugcuggaucaggcugaaaaugagguauuuuuaaaaccuuacauugauaauuugagaccaauuaauguuuccuuagaaauaauaguuccaguaauguuaguuucgugguagguuaguuagaucauguuuggauaucuggacucauguuuaugaugcuuugauuuauacaacaacaacaaacuuuauugaugaacaaauacaaaugguauucaugaccccuguggacuggaccuguuuagaguccuuacaguauguuuaagcaacaucacauaccguuagccuccaguggacgguuuaccuugaaucagaguaacuucuauuucugucuguggugguucccuaauaaguucuuggacccuuuuuuuucucuuuuuuucuuuuuuuuuuuuuugagacggaguuuugcucuuguugcccaggcuggaguacagugguaugaucucggcucacugcaaccuccgccucccggguucaagcaacucuccugccccagccucccaaguagcugggauuauaggugugcaccaccacgcccagcuaauuuuauauuuuuaguagagaugggguuucuccauguuggucaggcuggucuugaacuccugaucucaggugauccacccaccucggccucccaaagugcugggauuacaggcgugagccacugcacccggccuucuuggacccuuuuuagaauggauggaaaccuuggcgacugccccugguggcaguagugauaccagauaaaggaaagugaccaggagccaagagagacauggagcucaugucucaguaccguuguuuguaaagucuugauugccuguuccaacuuaaauguuugcauuauuaaaugaaacaauguuuaucuuugaggaaaauauuuuaauauacuuugaaacauuucgucuuucauggguuuuuacuccaccaguaaagucaugguuauuuucaacaguuggaaaaugguaccacauggcaaaacccagaaccacccguggauuucagaguaauggagaaggaucgagcuaauugucccuucuacaguaaaacaggagcuugcagauuuggagauagguaacuaauuuuguuuuaucaugucagaaugaagugauucaaaaugcugacguuuuugaguuccccuuuugggagaggcgcauguuuccauuucaaauguccgucaucagacaucugcugccuucuugcugcugcucucguuuucccagcugaucauccucugcuuugaccaucccuguucccucuauccuuguucccugggugggcuuagccuaguucucugagggugcuuccuuugcauucugcaucuuuaggaagccacuuugcuuguugguuucuuccugagcuugcauuaguccaugguggacaacuggguuggggaaauaauauauuugaagagcuuagagcagcuuggcuuuauuuuuugaagggcacacacuguccccaaaacaggcuuuuaaaacuuggcaugugccaggaguuccaggcugcaguaagcuaugaccacaccacugcacuccagccugggugacaaaacaagacccugucucaaaaaagaaaaaaaaaaacaaaacuuggcauguguaaagggauaucugugaaagacaggauccaaaugaggagaggaaaaguguuuuaauuucuguugucagugagugugcccagacucagguacagaccguuggguucaaaacgggcuucaguggcugccaguuugggaaaguugcuuaagcucugugugccuucguucucucaucuaugaaaugggauuaaacauagucucaucuuucugagggggcugugaggccgaaaugagcacacacacccguagaacagggccccaggagugcuugcuggcauuuucauuauugugacucuugauguuauucugugagacacucuucuuguucccugccccuuuugggucaauguuuuugaaagaagacguucauguggaaaccuaguguugaucucuucagucauuuagcaagucuucgaacaccuauuauaugccagguaauggugauuuuuauaauuuggccuguuuauuaaugaacaacuuaaaguagguaaauaauuccuaauggugaaugaguccaucugaggcaaaaucugauaauuaucaccauauauucugcagaagagaagaucuaaucauaaccuuaacauccuauuaauccugaaaagggauaugaauaguaaaauucagauguauuuaaucagaaaccauaugucaucugucagcuuuacuuuauucauaaaaguauccaugcugugagguuuuuuuccuucuucuucuucuuugaaaauauauccuucucuaugguucucuccuuuuucuuuuugaauuuaagcguucacaccauuuuucauuuuuuaagaacagugguucccaacccuggaugcacauuagagucaucuagaaagcuuuaaaaaauuauguccuaccucaaguugaguaaaucagaauaucagggccaggcgcgguggcucacaccuauaaucccagcacuuugggaggccaaggcaggcagaucacuugagcucaggaguuugagaccagccugggcaacaugguaaaaccugguaucuauaaaaaaaaaaaaguaaaauaaauaaauaauauauuuauauauauuuauauaaaaauauuauauaaauaaauaauaagaauaccagggacuuggguggccuuaguuucaaaauguccucaggugucucuagugugcccuaggauugagagccacuaaugucaaguguguauguccuuuuguauuuuagaggugggauugcagaugucuggaaugucugugaaaagagucaugggaucugcuaacuaguagaaagccuccucuugaaaaacugggaacuaagaaaaggaaagagacuuuauucccuuugauaccuuuagaaccauuucucagauauccacuuuaucuaaacaagaaaugguaaugauugguguaaaaaacuucccaccaaagaaaaaugcacugugaauuaccuuucagagacaacugagacuccauguaaguucacauuugcauggguacuugaaccaaauugcauuuaagguuuuccagcugcaggaucccucauguaggaucuaucucuaacauuuccuccaaauuuaagacccgugguagccugauucuugauucucaccccccccccuuuuuuuuuugagacggagucucgcccugucaccaggcuggagugcaguggcaugaucacagcucaccgcaagcucugccucccagguucaagcgauucuccugccuuagccucucgaguaguugggacuacaggcgcaugccaccacaccuggcuaauuuuuuuuguauuuuuaguauagacgagguuucgccauguuggccaggauggucucgaucucuugacauugugauccacgugccucggccucccaaagugcugggauuacaggcaugagccacugcucccggccuaauucuccuuuuguugggcauaagugagaggaggggagaugucuuaaacgauuucgagaacuugguugacaggcccuaccuugugggaagagggaauggcccgucaugcucucagaucccaucucuccucaagucauuucaaggaaauauggacaguggucaaauuaguuugcgagcauuucuuuuuuuuauuuuauuuuauuuuauuauuauucuuuuuugagacggagucucgcucugucgcccaggcuggagugcaguggcacgaucuccgcucacugcaaacuccgccuccuggguucgcgccauucuccugccucagccucccgaguagcugggaccacaggggcccgccaccacgccuggcuaauuuuuuguguuuuuaauauagaugggguuucaccauguuagccaggauggucucgaucuccugaccuugugauccgcccgccucggccucccaaagugcuaggauuacaggcgugagccaccgcgccuggcugcgaacauuucuuacaauuuucauaggcauaugaaauuuuaccaucacaacuaucaaaguauaacagcaguguggagauuuucaucauucaagugauaaguugugacaugaaauucugcgaaauuugcaguuacaaaauccagcaccaucccuuuagacaaguagacugcucuguucccuuuuuauggagagccuuggugacuugcuccagaucguacagcuguucuguucugucguuaaguuuugucagagcaucagaggaacacuuccauaaccucagcauuucuuuggcugguuguuuuuguaauuaguacagaguucaauucuagagccaugcuggaauugguauuuuuuggagucacagcuuugaggggaaucuauuuguuuuucuccuaaaagguaauaauuacuaauggaagguaaaacuuaguggucuauuuauaccucacuuacuuccaaaagugauuuaaagaagguucgugaucuagcacauuaaguuagagaaaguaaaggaaauugaaagcaaggaaaggaagagaaagugaguuauuuucuccagguuuuuauuucuccauauuugaauucaucucaagcagauaguaagcugucauucuuaccaaaaaggaagaaugagugguaucucuagaaagacagaaauuuuccuggcaccagauucuaaagguuucucccuuggaauauuuuacaaagacauuaaauaggaagguggacaauaacuuuaauagaugcuuuauaacaguugcauauguaauuuucaugaggauguuucuuacagugaccuucgauaaaugauugcagcuucacuuuaacaugcaaugcggggauucuauguaggacaaagguaaugcguaccaggagcacuucccugagaagaagaaaaagaggaguagucaguuagcuauacccgagggggcauuuggauacccacaccauuuauuggccauccuuggccuaagguaauauccaacaacuguggguuuuugcagcaaacugacuuaaguaucagaauaauggguaaauauuaugcccuaaaccagugguucccaaauauggcugaucuucaggaccagguagggagcuacuuugaaaauaugggucccccaccccuugaggucugaucagauggucuaggguaggaaguaagaaaucucaguucuuuccagguaauucugagaaccacacaggcuuggaaccacagcuuuagacugccuucguaaaugucacuucucuuagcugaguuuucaauaaaagcuauagggcuggccuuuuguauacacuuagauuauaaggacugucuuuaggccagaugggauuuuuccccagacagggacuuugguucuauuccaaaacugacaaaugcuuauuugacauccugggaacuagggccaaguucauucagaucuaggaaucccuugagcagaauuuuaaccucauuaaauuaguuccuuguuuaauucucugcaugcuucauacuuauaacauuuugauucacuguuaguguugccagucagguugagucuuugcucuuuguucuaucaguaguugggaagagggaucuaauuacaaggucucuaauugaauaauccaggaggucauuuggaaaauagaaaauuucacguuaaugaacguugaugaagcauuucugagcugagcaugguguaugcugggcauucuguaagcauuaucucaguaggugcuuagauagacauuacagacauggaaagugaguauuauuaaacauuuagucauuucagggccauuguuguuuuuucccaacacguccuauucuucaacuuucuuucuuccuaaauucuguggacuccccucgccaaaaaaaaaaaaaaaaaaguuuuugucuuaccaauuuuuaacuagcaaccuaaccaggaaaauuuuguuuauuuggaaccuugaacuacauuuuuccuccacauuguauguuaggagaaggaaggaaguaagaaaguaaacucauaugaaggauuuuugaaauauuacucagguacagccuggucagcuuagccuugguccaguuuaaacuaugaaaauaaaauuguucuucauaaugguuggccaccuucauuaaauaagaauuaaaugaugcagguaugguagcucacaccuguaaucccagagcuuugggaggcugaggcaggaggaucacuugaagccaggagugcgagaccagccugggcaacauagcgagaccccgucccuacaaaaauaaaauuauccgggugugguggcauacgccuauggcaugcgccagcuacucaagaugcugaggcagaaggaucacuugagcccggggaauucaagguugcagugaaguaugaucauaccauugcacuccagccuauguaacagaacaagacccugucucaaaaacaaauuguauuuauuacaccccaucgugaacaggcaccagauuguagauuaaugcagaugucuuggaucccucucuuccaagccauaugacugacuugggcaagugugcuuuucuaggucucagcuuccgucuuugcaaaguggugaaaauacuagcccccacuguccuaaagggauaaaaggaccagaggggaaaaauguaaaaaugccaugaaagcuacaagaugcuguacacagaucagauugaauugcuucauuaacuggaaauucuuggauuacuauauugucuaaacauugaguccacugacgauuguacagaaccaggauugcauuguuaguucccaccuuccucucagcagucccgcaugugacaucuucaugccugucaccacauccugucacaccaaucagcgggccuucuuuuccccuaugguucaacauguauaggcuuccugaacuucauucaaaggcagcugaaugguauaugaacuuugaaauguuuccaacuugacauuaaaacagcaagugccaaguuucaacacuuaaaaaaauccucuuaagcgcugaaacuuggcaucugagugggguuuauuaucuuucaguuaagucaaaacaacuaaauuacaugaguuucuaucucaaaauuuaaagcaaguguuuuuuuguuuguuuuuuguuugagacggaguuucgcucuuguugcccaagcuggagugcaauggcacaaucucagcucacuguaaccuccgccacccggguucaagugauucuccuaccucagccuccugaguagcugggauuauaggcacuacaggcgcacgccaacacgcccggcuaauuuuuuguauuuuuaguagaauugggguuucaccauguuagccaggcuggucucgaacucuggaccucaggugauucacccgccucggccucccaaaguguugggauuacaggcgugagccaccaugccuggucuaaagcaguuguuuugugaguaauuuucaacuauuggccuagugaauuuaagcuuuucuuucauacgcagauguucacguaaacauaauuucccaacauccaguccuacccuucuuauuaagagcauguuuacgacguuuggaauggagcagugcaggagggaugacuaugacccugacgcaagccuggaguacagcgaggaagaaaccuaccaacaguuccuagacuucuaugaggauguguugcccgaguucaagaacguggggaaagugauucaguucaaggugggcaugcguguggaggaggggacugguuugcuucacccugcaguacuuaauggcacaagagagcugggacacaggcucagcuggggucaggcacgcuagcacucuauaaaugugacuucccucuuucucucuuuccacccccuaccuuguugccaaugucacgucaauaccacaugaaaucauaaacauauauuagcaugguauuuccugaaugcuaggggucuagauuggaaaggaucuuucauuuauuuaguagcuuugugcuccaguucuuuuccagcacaugaauucucuguaucagguccccugcauauagccauccaguccuucacuuagaagcugcaugugacaaacggugcauucccuuccuuccucuguagguggcuuccgugugcagugugacacaacuucacucacuaaguuuguuggugcauuguguugacagugccgacuuagcuuccacccaagguguauguucuuucuucuggagccacacaggaacauaaaucuagauuccaccaccuaacccccuucuuuuuuuuacacuguuuuuauucauuggauucuuucaauacugaauauaguauuauacaaaccauggucugugaugcagcauacuuggugaaaaaggcauucagaugacacauaauuauuuuaaaauauuccuuaaugcaaggguaaggccagauguaaucucugcugcccccaggacccauuaguugaauucuaauagggugaagcuuccugccuugucugugauuucaucagaucugagcuggaaugccuuuguuauguuaaggcagggaaauugucccauaauuugggaaaagacaggaauagaaccgugauuuuuuuuccugcaaguugcaaaugaugaugaaaaguuggaacacccccccaaaaaugaagauauuccugacauuuaaggcuauacuucuaucaaccgacuucaagauuuuuaaaaauucuuuuuauuuuuuuuuuccuccuuaaccuuuuguuucuggggcauaugccuuccugucuucacauuacuugucagcacaagcaauaacugcuaaaguggaacugccuggucacagccacacaauaccauguuagaagcacuggccgaggaggccaugugguuugacuagccuugucacuucuuccugccuuuuccuuauccugaaagugaggggacuggauuacgucagugguuuuccucguaggguuucuugauuauacugcuucugugaagugguaaugggagggcugcuuucagaacugcagaguaguuaauggaaauugcacccuuacuugcaacaggcugcacccacaaaccacaaccaccacaacguauuuuuucuuuuguuuagaguucucucauccuggcuugcacagcugacauggauucccgaggccuuuuauucuuccuucuaagggugguguuacaaacugucacugaguauggauccugcucguuuugggauacccuaagaaaaauacucuggaacaaauuuguaaaauuauagauucauuuugaacauaaacgcuaaacacuaguaugaauauuugaggaccuuuuuacauacuauuauauaaaaacaaaucagauuugucauuguugaaggcaaaugaucaaauauuuaaccuaacuaguaauaggaacaguacauaugaaaaugggaugauauucacaccuaucaggcaaaaaaauuauaaauucuauuaauaccaagaguagaugaggauguguacauuaguaaaaccacuucagagagcaguuugucaauaccuagugaagguacguguaaccuauaaauuggcacacuccuggcuaugcacaguagagagcucuuuauacccacagagaccuguuuaagaaugcugacugcgguacuguuuguggaugaaaaauuggaagcaucuugaaaaaccaucauucuagaguagauaaguuuuauuauuugguauauccaguauacaguaguuaaguuuaugugacuacaucuugaaaaaagaauauggaauaaauacuauugauauaaaauuuuaaaacauacaaagcaacacuauauguuguuuaucaauacguauuaccuguuucuuugcauauguauauauauguguauacccauuauaaauaauggacauuuauauguaugauacauauguguggguuuuggcaugcauaugauguauguauauaugccuguaucuguguauuuguauuugugucuguguaggucuauguauguauauguguguuuguguuuggaaugugaaggcuacacuccuagccuguggagaguguucaccuaugugauggaggagggagaagaaugggauagaagggcuucaacugagucuuuaauguuuuacauauguaaauauucucauucagaaguggaaaacguuaguguuaaaucuggguagugcauauauaggcugauugauaucuucuguauuuuuauggaugugugaaacauuucauauuugugggagaaaacagaccuggaccaacagggaucaggcacgcugccaugugccaaguacgccuuaaauagaugcaagagucagcuaguaucucuauuuugcaaucuuugauugguaacuacuuuggggaauguuagccuggacaaacaacauuugaugaauggcugguuucuuuuccugaauuuuuuaugauagcauucuucauugcucccuaggucagcugcaauuuggaaccucaccugaggggcaauguauauguucaguaccagucguaaguauucugcuuguggaugucuuccugauuugucacaguuuguuguucuguuucuguugaugucugggauuuuuccacuggauauauaacuuucauguauuuuauuucuuauguuuuuauuuuuauuuuguuuuuuucuuuugagacggaguuucgcucuuguugcccaggcuagagugcaauggcguguucucagcucacugccaccuccaccucccagguucaagugauuguccugccucagccuccugaguagcugggauuacaggugccugccaccaugcccagcuaauuuuuuguauuuuuaguagagaugggguuuuacuaugaugaccaggcuggucucgaacuccugaccucaggugauccacccaccucggccucccaaaguacugggauuacaggcgugagccacuguguuuggcccagcuuucauauauuuuaaaauauuuaaauaaaauuaaaguuuaaauaaaucuaaauauuuaaaacuuaaauauuaagaguugaaacagaaauauagaauggaugugaaaauaauauaagccgggcaugguggcucacaccugucaucccaacacuuuuggaggcugaagugggaggauugcuugaggccaggaguucaagaccagccuggucaacauggcaaaaccccaucucuacuaaaaauacaaaaaauuagccaggcgugguggcaggcaccuguaaucccagcuacuugggaggcugagacaggagaaucgcuucaagagagaccucaucucuacaaaaaaauuuaaaaauuggccgaaugugguggcaugugcugguagucccagcuauuugugaggcugaggcaggaggaucacuugagcccaggaggucgaggcugcagugagguaugacuguaccacgacacucuagccugggggacagagugagaguaagacuccaucucaaaaagaaaaaaauaauaaauuuauauuucauucuuuauauauuuacauaguuuugaauguuuuacaauaugguuauauuauuacucauaauuuuaauaauuaaaauacaaacuaauaagggauaacuagaauagagaacauaaaagcauuuauagugaaagagccggagauugaagcccaaaaucaucuuagugugcauuugaccagcuaagagagcaauuaauguaucauuucuucuuaucuugcuguuugccuaggccauaccauggcuaauggguuaaauuaaccaguguaauaagaagaacagcaauccuaucugagaaagaauaggcccuaauaauggaaaacacuucugcauuuuuaaugguccaaucuuuuggauuaagacgguuucauucaagccaauuuccaugcauugaaaccucuccgaggguuaguaaaaaggguuccugaauaaauugggagcuuugggagcuugaccauuuuaaugacucuucccuagguacaaaaucagugaacuuggugguccuacaauaaauuaauaacgggguuaauuaauaguagagcuaaucuacauauuaggaaguuacuguaaagcauaucauuugauuuuugguuuaaagggaagaagaaugccaagcagcccuuucucuguuuaacggacgaugguaugcaggacgacagcugcagugugaauucugccccgugacccgguggaaaauggcgauuugugguaaaagacaaagugaugauuuuuuuccucaauuguuccacugcuauauaaagggauauucuuugggggaaacccaguauuuucaaguggugaggcauagcuuuuugccucacacaguagaugagcagagaacuuuauauaaagaacaccacaguuuagaucuguaaccgaccucaaugagucacuugauagaugaagugacugaggucacaacguauuggugacagagguggggcuagaauuccagucuuccaaucuucaguccugggcucugugucugacaaaucaggaagccugaggaguuuacgucuguggaagccccauuucccuuguugcaguuucagagguauuuuauauucauuggcucacuucacuugagcuguuuguuuguuucuuucuuuccaucuuuaucccuaaugaaucuucugucaugaccaccuacguuaccuugcccauagcauuuccugccuuacuuggaauaauacauccuucugugcacuagagacuaauuguaggcuugggaucaguuaaacaugaaugcagucagacugacaucggacaguggcaacccaaucaggaaaugauccagucuugugcagaauagccagcaguuuugaaggccuaguuauguucugauuucucucaguggacuguucccuaggugaaaagagaugagcucuaaaugccucuggggagcacuuaucuuaccguuuacuuguguuucuuugcuguauacaugccugccuaacgcaaagucagaaucuuuggcaagcuugucuuccuuggauucugucauucugaaaccauuuaugaagggaaaagaaagauuuuaggauuccuggcuaagggaaaccagaagaaccauuacacuuuaaaggcucgggggauggaagagguggaauuguucgcuccauaaaggcaguuacuuuugucaguuccugggaauccagugugaguucagugaggagcuucugagugugaccuugacuccuccaaagcaggggacuauuucauuaaaaaaaaaaaaacacuuuauuuuccuuauugacuaaagacacugagcaucuuuucauuauuggccauuuguaugucuucuuuggagagaugucuguuuggauccuuugccuauuuucuaacuaggcucuuugucuuuuuauuauugaguuguaagaguucuugguauauucuccauacaaguaccuggucacaaauaugauuugcagauauuuucucccauuuuguagguucuuuucacuucauguucuuuugaaauacaaguuguaaauuuugaugaaauccaacuuaacuauuuuuuuguuuguuuuggugucacaucuaggaugacauugcuuagcccagggucacaaagauuuacuuguauguuuucuucaaggucauaguuucauuucuuaacauuuaggucuuggauacaguuuaauuuuuguauauaguaugugguacggagguauuucacuucuaacuguugugcauaucuggggaauuuacugcuuuuaaaaaacguuugagaaccccaaagaucucaaaauuguucgaauagauuuuaucugugauaagaaucuucuguauuaaaagcacuuagugaauuugaagcauuaguguaauguuuauaaucuuaaaguuuaaagaaaauauagacuccucuauguuuaauaggccuucucuuuuuuuuuugagagugagucucacucugucgcccaggcuggagugcaguggcauaauuuuggcucacugcaaccuccaccuccuggguuuaagugauucucaugccuccgccuccugaguagcugggauuacaagcgccugccaccacgcccagcuaauuuuuguauuuuuaguagagaugggguuucgccauguuggccaggcuggucucaaacuccugaccucaggucugugcccgccucagccucccaaaguguuaggauuacaggugugagccaccgcaccuggccacgccuucucuuuugaccagugguucuggccuguuuccuccaugccaucaaaccgugcuaccacagggacccaaagagcuggcuauuugauguuaaucagggaucaaaaucgucaaucagugggaaggugaaaccuggagaagauaacguggucaccauuugcucaguugcagucugcaccauaauccaacaggggcacaggcuauucugcuuaaugaaaacuucugauuuguuaccuuucagagugucauuuauuagagcacguuugaaaucgugggaaccaaauuaugacaucaauuuauguaagccccuuuuacauaauacacaguagaaaauaguucuagcauauccaaauaucagaaauguaccuucggaaaaggauaaaguagcaucuucagaauaugcagugauaagugcuguuucaucacugugccauugcagguuuauuugaaauacaacaauguccaagaggaaagcacugcaacuuucuucauguguucagaaaucccaacaaugaauucugggaagcuaauagagacaucuacuugucuccagaucggacuggcuccuccuuugggaagaacuccgaaaggagggagaggaugggccaccacgacgacuacuacagcaggcugcggggaaggagaaacccuaguccagaccacuccuacaaaagaaauggggaauccgagaggaaaaguagucgucacagggggaagaaaucucacaaacgcacaucaaagagucgggagaggcacaauucacgaagcagaggaagaaauagggaccgcagcagggaccgcagccggggccggggcagccggagccggagccggagccggagccgcaggagccgccgcagccggagccaaaguuccucuaggucccgaagucguggcaggaggaggucggguaauagagacagaacuguucagagucccaaauccaaauaaacuaguuuuguucuuaa

SEQ ID NO: 192869 - RNA, 32809 nt, Homo sapiens
uuaagaacaaaacuaguuuauuuggauuugggacucugaacaguucugucucuauuacccgaccuccuccugccacgacuucgggaccuagaggaacuuuggcuccggcugcggcggcuccugcggcuccggcuccggcuccggcuccggcugccccggccccggcugcggucccugcugcggucccuauuucuuccucugcuucgugaauugugccucucccgacucuuugaugugcguuugugagauuucuucccccugugacgacuacuuuuccucucggauuccccauuucuuuuguaggaguggucuggacuaggguuucuccuuccccgcagccugcuguaguagucgucgugguggcccauccucucccuccuuucggaguucuucccaaaggaggagccaguccgaucuggagacaaguagaugucucuauuagcuucccagaauucauuguugggauuucugaacacaugaagaaaguugcagugcuuuccucuuggacauuguuguauuucaaauaaaccugcaauggcacagugaugaaacagcacuuaucacugcauauucugaagaugcuacuuuauccuuuuccgaagguacauuucugauauuuggauaugcuagaacuauuuucuacuguguauuauguaaaaggggcuuacauaaauugaugucauaauuugguucccacgauuucaaacgugcucuaauaaaugacacucugaaagguaacaaaucagaaguuuucauuaagcagaauagccugugccccuguuggauuauggugcagacugcaacugagcaaauggugaccacguuaucuucuccagguuucaccuucccacugauugacgauuuugaucccugauuaacaucaaauagccagcucuuugggucccugugguagcacgguuugauggcauggaggaaacaggccagaaccacuggucaaaagagaaggcguggccaggugcgguggcucacaccuguaauccuaacacuuugggaggcugaggcgggcacagaccugaggucaggaguuugagaccagccuggccaacauggcgaaaccccaucucuacuaaaaauacaaaaauuagcugggcgugguggcaggcgcuuguaaucccagcuacucaggaggcggaggcaugagaaucacuuaaacccaggagguggagguugcagugagccaaaauuaugccacugcacuccagccugggcgacagagugagacucacucucaaaaaaaaaagagaaggccuauuaaacauagaggagucuauauuuucuuuaaacuuuaagauuauaaacauuacacuaaugcuucaaauucacuaagugcuuuuaauacagaagauucuuaucacagauaaaaucuauucgaacaauuuugagaucuuugggguucucaaacguuuuuuaaaagcaguaaauuccccagauaugcacaacaguuagaagugaaauaccuccguaccacauacuauauacaaaaauuaaacuguauccaagaccuaaauguuaagaaaugaaacuaugaccuugaagaaaacauacaaguaaaucuuugugacccugggcuaagcaaugucauccuagaugugacaccaaaacaaacaaaaaaauaguuaaguuggauuucaucaaaauuuacaacuuguauuucaaaagaacaugaagugaaaagaaccuacaaaaugggagaaaauaucugcaaaucauauuugugaccagguacuuguauggagaauauaccaagaacucuuacaacucaauaauaaaaagacaaagagccuaguuagaaaauaggcaaaggauccaaacagacaucucuccaaagaagacauacaaauggccaauaaugaaaagaugcucagugucuuuagucaauaaggaaaauaaaguguuuuuuuuuuuuuaaugaaauaguccccugcuuuggaggagucaaggucacacucagaagcuccucacugaacucacacuggauucccaggaacugacaaaaguaacugccuuuauggagcgaacaauuccaccucuuccaucccccgagccuuuaaaguguaaugguucuucugguuucccuuagccaggaauccuaaaaucuuucuuuucccuucauaaaugguuucagaaugacagaauccaaggaagacaagcuugccaaagauucugacuuugcguuaggcaggcauguauacagcaaagaaacacaaguaaacgguaagauaagugcuccccagaggcauuuagagcucaucucuuuucaccuagggaacaguccacugagagaaaucagaacauaacuaggccuucaaaacugcuggcuauucugcacaagacuggaucauuuccugauuggguugccacuguccgaugucagucugacugcauucauguuuaacugaucccaagccuacaauuagucucuagugcacagaaggauguauuauuccaaguaaggcaggaaaugcuaugggcaagguaacguagguggucaugacagaagauucauuagggauaaagauggaaagaaagaaacaaacaaacagcucaagugaagugagccaaugaauauaaaauaccucugaaacugcaacaagggaaauggggcuuccacagacguaaacuccucaggcuuccugauuugucagacacagagcccaggacugaagauuggaagacuggaauucuagccccaccucugucaccaauacguugugaccucagucacuucaucuaucaagugacucauugaggucgguuacagaucuaaacugugguguucuuuauauaaaguucucugcucaucuacugugugaggcaaaaagcuaugccucaccacuugaaaauacuggguuucccccaaagaauaucccuuuauauagcaguggaacaauugaggaaaaaaaucaucacuuugucuuuuaccacaaaucgccauuuuccaccgggucacggggcagaauucacacugcagcugucguccugcauaccaucguccguuaaacagagaaagggcugcuuggcauucuucuucccuuuaaaccaaaaaucaaaugauaugcuuuacaguaacuuccuaauauguagauuagcucuacuauuaauuaaccccguuauuaauuuauuguaggaccaccaaguucacugauuuuguaccuagggaagagucauuaaaauggucaagcucccaaagcucccaauuuauucaggaacccuuuuuacuaacccucggagagguuucaaugcauggaaauuggcuugaaugaaaccgucuuaauccaaaagauuggaccauuaaaaaugcagaaguguuuuccauuauuagggccuauucuuucucagauaggauugcuguucuucuuauuacacugguuaauuuaacccauuagccaugguauggccuaggcaaacagcaagauaagaagaaaugauacauuaauugcucucuuagcuggucaaaugcacacuaagaugauuuugggcuucaaucuccggcucuuucacuauaaaugcuuuuauguucucuauucuaguuaucccuuauuaguuuguauuuuaauuauuaaaauuaugaguaauaauauaaccauauuguaaaacauucaaaacuauguaaauauauaaagaaugaaauauaaauuuauuauuuuuuucuuuuugagauggagucuuacucucacucugucccccaggcuagagugucgugguacagucauaccucacugcagccucgaccuccugggcucaagugauccuccugccucagccucacaaauagcugggacuaccagcacaugccaccacauucggccaauuuuuaaauuuuuuuguagagaugaggucucucuugaagcgauucuccugucucagccucccaaguagcugggauuacaggugccugccaccacgccuggcuaauuuuuuguauuuuuaguagagaugggguuuugccauguugaccaggcuggucuugaacuccuggccucaagcaauccucccacuucagccuccaaaaguguugggaugacaggugugagccaccaugcccggcuuauauuauuuucacauccauucuauauuucuguuucaacucuuaauauuuaaguuuuaaauauuuagauuuauuuaaacuuuaauuuuauuuaaauauuuuaaaauauaugaaagcugggccaaacacaguggcucacgccuguaaucccaguacuuugggaggccgagguggguggaucaccugaggucaggaguucgagaccagccuggucaucauaguaaaaccccaucucuacuaaaaauacaaaaaauuagcugggcaugguggcaggcaccuguaaucccagcuacucaggaggcugaggcaggacaaucacuugaaccugggagguggagguggcagugagcugagaacacgccauugcacucuagccugggcaacaagagcgaaacuccgucucaaaagaaaaaaacaaaauaaaaauaaaaacauaagaaauaaaauacaugaaaguuauauauccaguggaaaaaucccagacaucaacagaaacagaacaacaaacugugacaaaucaggaagacauccacaagcagaauacuuacgacugguacugaacauauacauugccccucaggugagguuccaaauugcagcugaccuagggagcaaugaagaaugcuaucauaaaaaauucaggaaaagaaaccagccauucaucaaauguuguuuguccaggcuaacauuccccaaaguaguuaccaaucaaagauugcaaaauagagauacuagcugacucuugcaucuauuuaaggcguacuuggcacauggcagcgugccugaucccuguugguccaggucuguuuucucccacaaauaugaaauguuucacacauccauaaaaauacagaagauaucaaucagccuauauaugcacuacccagauuuaacacuaacguuuuccacuucugaaugagaauauuuacauauguaaaacauuaaagacucaguugaagcccuucuaucccauucuucucccuccuccaucacauaggugaacacucuccacaggcuaggaguguagccuucacauuccaaacacaaacacacauauacauacauagaccuacacagacacaaauacaaauacacagauacaggcauauauacauacaucauaugcaugccaaaacccacacauauguaucauacauauaaauguccauuauuuauaauggguauacacauauauauacauaugcaaagaaacagguaauacguauugauaaacaacauauaguguugcuuuguauguuuuaaaauuuuauaucaauaguauuuauuccauauucuuuuuucaagauguagucacauaaacuuaacuacuguauacuggauauaccaaauaauaaaacuuaucuacucuagaaugaugguuuuucaagaugcuuccaauuuuucauccacaaacaguaccgcagucagcauucuuaaacaggucucuguggguauaaagagcucucuacugugcauagccaggagugugccaauuuauagguuacacguaccuucacuagguauugacaaacugcucucugaagugguuuuacuaauguacacauccucaucuacucuugguauuaauagaauuuauaauuuuuuugccugauaggugugaauaucaucccauuuucauauguacuguuccuauuacuaguuagguuaaauauuugaucauuugccuucaacaaugacaaaucugauuuguuuuuauauaauaguauguaaaaagguccucaaauauucauacuaguguuuagcguuuauguucaaaaugaaucuauaauuuuacaaauuuguuccagaguauuuuucuuaggguaucccaaaacgagcaggauccauacucagugacaguuuguaacaccacccuuagaaggaagaauaaaaggccucgggaauccaugucagcugugcaagccaggaugagagaacucuaaacaaaagaaaaaauacguuguggugguugugguuugugggugcagccuguugcaaguaagggugcaauuuccauuaacuacucugcaguucugaaagcagcccucccauuaccacuucacagaagcaguauaaucaagaaacccuacgaggaaaaccacugacguaauccaguccccucacuuucaggauaaggaaaaggcaggaagaagugacaaggcuagucaaaccacauggccuccucggccagugcuucuaacaugguauuguguggcugugaccaggcaguuccacuuuagcaguuauugcuugugcugacaaguaaugugaagacaggaaggcauaugccccagaaacaaaagguuaaggaggaaaaaaaaaauaaaaagaauuuuuaaaaaucuugaagucgguugauagaaguauagccuuaaaugucaggaauaucuucauuuuuggggggguguuccaacuuuucaucaucauuugcaacuugcaggaaaaaaaaucacgguucuauuccugucuuuucccaaauuaugggacaauuucccugccuuaacauaacaaaggcauuccagcucagaucugaugaaaucacagacaaggcaggaagcuucacccuauuagaauucaacuaauggguccugggggcagcagagauuacaucuggccuuacccuugcauuaaggaauauuuuaaaauaauuaugugucaucugaaugccuuuuucaccaaguaugcugcaucacagaccaugguuuguauaauacuauauucaguauugaaagaauccaaugaauaaaaacaguguaaaaaaaagaaggggguuaggugguggaaucuagauuuauguuccuguguggcuccagaagaaagaacauacaccuuggguggaagcuaagucggcacugucaacacaaugcaccaacaaacuuagugagugaaguugugucacacugcacacggaagccaccuacagaggaaggaagggaaugcaccguuugucacaugcagcuucuaagugaaggacuggauggcuauaugcaggggaccugauacagagaauucaugugcuggaaaagaacuggagcacaaagcuacuaaauaaaugaaagauccuuuccaaucuagaccccuagcauucaggaaauaccaugcuaauauauguuuaugauuucaugugguauugacgugacauuggcaacaagguaggggguggaaagagagaaagagggaagucacauuuauagagugcuagcgugccugaccccagcugagccugugucccagcucucuugugccauuaaguacugcagggugaagcaaaccaguccccuccuccacacgcaugcccaccuugaacugaaucacuuuccccacguucuugaacucgggcaacacauccucauagaagucuaggaacuguugguagguuucuuccucgcuguacuccaggcuugcgucagggucauagucaucccuccugcacugcuccauuccaaacgucguaaacaugcucuuaauaagaaggguaggacuggauguugggaaauuauguuuacgugaacaucugcguaugaaagaaaagcuuaaauucacuaggccaauaguugaaaauuacucacaaaacaacugcuuuagaccaggcaugguggcucacgccuguaaucccaacacuuugggaggccgaggcgggugaaucaccugagguccagaguucgagaccagccuggcuaacauggugaaaccccaauucuacuaaaaauacaaaaaauuagccgggcguguuggcgugcgccuguagugccuauaaucccagcuacucaggaggcugagguaggagaaucacuugaacccggguggcggagguuacagugagcugagauugugccauugcacuccagcuugggcaacaagagcgaaacuccgucucaaacaaaaaacaaacaaaaaaacacuugcuuuaaauuuugagauagaaacucauguaauuuaguuguuuugacuuaacugaaagauaauaaaccccacucagaugccaaguuucagcgcuuaagaggauuuuuuuaaguguugaaacuuggcacuugcuguuuuaaugucaaguuggaaacauuucaaaguucauauaccauucagcugccuuugaaugaaguucaggaagccuauacauguugaaccauaggggaaaagaaggcccgcugauuggugugacaggauguggugacaggcaugaagaugucacaugcgggacugcugagaggaaggugggaacuaacaaugcaauccugguucuguacaaucgucaguggacucaauguuuagacaauauaguaauccaagaauuuccaguuaaugaagcaauucaaucugaucuguguacagcaucuuguagcuuucauggcauuuuuacauuuuuccccucugguccuuuuaucccuuuaggacagugggggcuaguauuuucaccacuuugcaaagacggaagcugagaccuagaaaagcacacuugcccaagucagucauauggcuuggaagagagggauccaagacaucugcauuaaucuacaaucuggugccuguucacgaugggguguaauaaauacaauuuguuuuugagacagggucuuguucuguuacauaggcuggagugcaaugguaugaucauacuucacugcaaccuugaauuccccgggcucaagugauccuucugccucagcaucuugaguagcuggcgcaugccauaggcguaugccaccacacccggauaauuuuauuuuuguagggacggggucucgcuauguugcccaggcuggucucgcacuccuggcuucaagugauccuccugccucagccucccaaagcucugggauuacaggugugagcuaccauaccugcaucauuuaauucuuauuuaaugaagguggccaaccauuaugaagaacaauuuuauuuucauaguuuaaacuggaccaaggcuaagcugaccaggcuguaccugaguaauauuucaaaaauccuucauaugaguuuacuuucuuacuuccuuccuucuccuaacauacaauguggaggaaaaauguaguucaagguuccaaauaaacaaaauuuuccugguuagguugcuaguuaaaaauugguaagacaaaaacuuuuuuuuuuuuuuuuuuggcgaggggaguccacagaauuuaggaagaaagaaaguugaagaauaggacguguugggaaaaaacaacaauggcccugaaaugacuaaauguuuaauaauacucacuuuccaugucuguaaugucuaucuaagcaccuacugagauaaugcuuacagaaugcccagcauacaccaugcucagcucagaaaugcuucaucaacguucauuaacgugaaauuuucuauuuuccaaaugaccuccuggauuauucaauuagagaccuuguaauuagaucccucuucccaacuacugauagaacaaagagcaaagacucaaccugacuggcaacacuaacagugaaucaaaauguuauaaguaugaagcaugcagagaauuaaacaaggaacuaauuuaaugagguuaaaauucugcucaagggauuccuagaucugaaugaacuuggcccuaguucccaggaugucaaauaagcauuugucaguuuuggaauagaaccaaagucccugucuggggaaaaaucccaucuggccuaaagacaguccuuauaaucuaaguguauacaaaaggccagcccuauagcuuuuauugaaaacucagcuaagagaagugacauuuacgaaggcagucuaaagcugugguuccaagccugugugguucucagaauuaccuggaaagaacugagauuucuuacuuccuacccuagaccaucugaucagaccucaaggggugggggacccauauuuucaaaguagcucccuaccugguccugaagaucagccauauuugggaaccacugguuuagggcauaauauuuacccauuauucugauacuuaagucaguuugcugcaaaaacccacaguuguuggauauuaccuuaggccaaggauggccaauaaaugguguggguauccaaaugcccccucggguauagcuaacugacuacuccucuuuuucuucuucucagggaagugcuccugguacgcauuaccuuuguccuacauagaauccccgcauugcauguuaaagugaagcugcaaucauuuaucgaaggucacuguaagaaacauccucaugaaaauuacauaugcaacuguuauaaagcaucuauuaaaguuauuguccaccuuccuauuuaaugucuuuguaaaauauuccaagggagaaaccuuuagaaucuggugccaggaaaauuucugucuuucuagagauaccacucauucuuccuuuuugguaagaaugacagcuuacuaucugcuugagaugaauucaaauauggagaaauaaaaaccuggagaaaauaacucacuuucucuuccuuuccuugcuuucaauuuccuuuacuuucucuaacuuaaugugcuagaucacgaaccuucuuuaaaucacuuuuggaaguaagugagguauaaauagaccacuaaguuuuaccuuccauuaguaauuauuaccuuuuaggagaaaaacaaauagauuccccucaaagcugugacuccaaaaaauaccaauuccagcauggcucuagaauugaacucuguacuaauuacaaaaacaaccagccaaagaaaugcugagguuauggaaguguuccucugaugcucugacaaaacuuaacgacagaacagaacagcuguacgaucuggagcaagucaccaaggcucuccauaaaaagggaacagagcagucuacuugucuaaagggauggugcuggauuuuguaacugcaaauuucgcagaauuucaugucacaacuuaucacuugaaugaugaaaaucuccacacugcuguuauacuuugauaguugugaugguaaaauuucauaugccuaugaaaauuguaagaaauguucgcagccaggcgcgguggcucacgccuguaauccuagcacuuugggaggccgaggcgggcggaucacaaggucaggagaucgagaccauccuggcuaacauggugaaaccccaucuauauuaaaaacacaaaaaauuagccaggcgugguggcgggccccuguggucccagcuacucgggaggcugaggcaggagaauggcgcgaacccaggaggcggaguuugcagugagcggagaucgugccacugcacuccagccugggcgacagagcgagacuccgucucaaaaaagaauaauaauaaaauaaaauaaaauaaaaaaaagaaaugcucgcaaacuaauuugaccacuguccauauuuccuugaaaugacuugaggagagaugggaucugagagcaugacgggccauucccucuucccacaagguagggccugucaaccaaguucucgaaaucguuuaagacaucuccccuccucucacuuaugcccaacaaaaggagaauuaggccgggagcaguggcucaugccuguaaucccagcacuuugggaggccgaggcacguggaucacaaugucaagagaucgagaccauccuggccaacauggcgaaaccucgucuauacuaaaaauacaaaaaaaauuagccaggugugguggcaugcgccuguagucccaacuacucgagaggcuaaggcaggagaaucgcuugaaccugggaggcagagcuugcggugagcugugaucaugccacugcacuccagccuggugacagggcgagacuccgucucaaaaaaaaaaggggggggggugagaaucaagaaucaggcuaccacgggucuuaaauuuggaggaaauguuagagauagauccuacaugagggauccugcagcuggaaaaccuuaaaugcaauuugguucaaguacccaugcaaaugugaacuuacauggagucucaguugucucugaaagguaauucacagugcauuuuucuuuggugggaaguuuuuuacaccaaucauuaccauuucuuguuuagauaaaguggauaucugagaaaugguucuaaagguaucaaagggaauaaagucucuuuccuuuucuuaguucccaguuuuucaagaggaggcuuucuacuaguuagcagaucccaugacucuuuucacagacauuccagacaucugcaaucccaccucuaaaauacaaaaggacauacacacuugacauuaguggcucucaauccuagggcacacuagagacaccugaggacauuuugaaacuaaggccacccaagucccugguauucuuauuauuuauuuauauaauauuuuuauauaaauauauauaaauauauuauuuauuuauuuuacuuuuuuuuuuuuauagauaccagguuuuaccauguugcccaggcuggucucaaacuccugagcucaagugaucugccugccuuggccucccaaagugcugggauuauaggugugagccaccgcgccuggcccugauauucugauuuacucaacuugagguaggacauaauuuuuuaaagcuuucuagaugacucuaaugugcauccaggguugggaaccacuguucuuaaaaaaugaaaaauggugugaacgcuuaaauucaaaaagaaaaaggagagaaccauagagaaggauauauuuucaaagaagaagaagaaggaaaaaaaccucacagcauggauacuuuuaugaauaaaguaaagcugacagaugacauaugguuucugauuaaauacaucugaauuuuacuauucauaucccuuuucaggauuaauaggauguuaagguuaugauuagaucuucucuucugcagaauauauggugauaauuaucagauuuugccucagauggacucauucaccauuaggaauuauuuaccuacuuuaaguuguucauuaauaaacaggccaaauuauaaaaaucaccauuaccuggcauauaauagguguucgaagacuugcuaaaugacugaagagaucaacacuagguuuccacaugaacgucuucuuucaaaaacauugacccaaaaggggcagggaacaagaagagugucucacagaauaacaucaagagucacaauaaugaaaaugccagcaagcacuccuggggcccuguucuacgggugugugugcucauuucggccucacagcccccucagaaagaugagacuauguuuaaucccauuucauagaugagagaacgaaggcacacagagcuuaagcaacuuucccaaacuggcagccacugaagcccguuuugaacccaacggucuguaccugagucugggcacacucacugacaacagaaauuaaaacacuuuuccucuccucauuuggauccugucuuucacagauaucccuuuacacaugccaaguuuuguuuuuuuuuuucuuuuuugagacagggucuuguuuugucacccaggcuggagugcagugguguggucauagcuuacugcagccuggaacuccuggcacaugccaaguuuuaaaagccuguuuuggggacagugugugcccuucaaaaaauaaagccaagcugcucuaagcucuucaaauauauuauuuccccaacccaguuguccaccauggacuaaugcaagcucaggaagaaaccaacaagcaaaguggcuuccuaaagaugcagaaugcaaaggaagcacccucagagaacuaggcuaagcccacccagggaacaaggauagagggaacagggauggucaaagcagaggaugaucagcugggaaaacgagagcagcagcaagaaggcagcagaugucugaugacggacauuugaaauggaaacaugcgccucucccaaaaggggaacucaaaaacgucagcauuuugaaucacuucauucugacaugauaaaacaaaauuaguuaccuaucuccaaaucugcaagcuccuguuuuacuguagaagggacaauuagcucgauccuucuccauuacucugaaauccacgggugguucuggguuuugccaugugguaccauuuuccaacuguugaaaauaaccaugacuuuacugguggaguaaaaacccaugaaagacgaaauguuucaaaguauauuaaaauauuuuccucaaagauaaacauuguuucauuuaauaaugcaaacauuuaaguuggaacaggcaaucaagacuuuacaaacaacgguacugagacaugagcuccaugucucucuuggcuccuggucacuuuccuuuaucugguaucacuacugccaccaggggcagucgccaagguuuccauccauucuaaaaaggguccaagaaggccgggugcaguggcucacgccuguaaucccagcacuuugggaggccgagguggguggaucaccugagaucaggaguucaagaccagccugaccaacauggagaaaccccaucucuacuaaaaauauaaaauuagcugggcgugguggugcacaccuauaaucccagcuacuugggaggcuggggcaggagaguugcuugaacccgggaggcggagguugcagugagccgagaucauaccacuguacuccagccugggcaacaagagcaaaacuccgucucaaaaaaaaaaaaaagaaaaaaagagaaaaaaaaggguccaagaacuuauuagggaaccaccacagacagaaauagaaguuacucugauucaagguaaaccguccacuggaggcuaacgguaugugauguugcuuaaacauacuguaaggacucuaaacagguccaguccacaggggucaugaauaccauuuguauuuguucaucaauaaaguuuguuguuguuguauaaaucaaagcaucauaaacaugaguccagauauccaaacaugaucuaacuaaccuaccacgaaacuaacauuacuggaacuauuauuucuaaggaaacauuaauuggucucaaauuaucaauguaagguuuuaaaaauaccucauuuucagccugauccagcaucuucugcaaagcuuccuaaaauggugcaaacacaggacuaauaaaaacccagaagucagguaagucacaucugguuucucugguuaagaaucucaaguggaacaauuaaaacacacacacgcacacaaguucuaguuuucuuuugaaucacagaucuuuugaaaagcuuucaaaggauauauagcugagacuuuucucuuuuuuuuuugagacagggucucacucugucacccaggcuggagugcaguggcgugaccucagcucacugcaaccuccgccucccaggcucaagugauccucccaccucagccuuccgaguagcuaggacuacaggcgcacaccaccacgccuggauaacuuuuguauuuucuguagagacggaguuucaccauguugcccaggcuagucucgaacuccugagcucaagcaauccacccgccucagccucccaaagugcugggauuacaggcaugagcuaccgugcccggcccauagcugagacguucuauucaaauagaaaauuuaccagaucacauugcaaaauauuuaaaauagucuuauaauaguuucaauaauaguaauacuuaguauauuugaguauauauaccauguccuaguucguaaaaggggguauuagugaauauaaaacacaaugcuaggccgggcaugguggcucacaccuauaauccuagcacuuugggaggcugaggcggguggaucacuugaggucaggaguucuagaccagccuggccaagacggugaaaccccgucacuacuaaaaauacaaaaauuagccaggugugguggcacgugccuguaaucccagcuacuugggaggcugagacaggagaaucgcuugaacccaggaggcagagguugcagugagccgagaugacgccacugcacuccagccuaggcgacagagcaagacucugucuaaaaaaaaacgaacaaacaaacaaacgaaaaaacccaaaaaacaaugcuagaugaaaucauaaacauuuagcagaagcuaaaauaugacaugaccagugguaauuagcauuuaggagaaaauucuaacuuuuuaauaaggcaaaggagguucugcaauaugccaguaaauuucuaccuaauuggcauuugaacaaguuguaccuauguuuaacagacagucuuaucuucccuagccccuuaaagcauuacauaagacucguaugucuaguugcuuauuuguggugcucaaaacagaacucuuguccucuacacucccuggcccacauccaccugaaugcucccucagugaauaguguugccagucuaucugucuauucaaacuaaaaaccuaaaaauaugacuugaauuccucucucucuccuuguccucuggucaacauggugaaacccugucuguacuaaaaacacaaaaaauuagccggguguggugaugggcgccuguagucccagcuacucaggaggcugaggcagaagaaucgcuugaacccgggaggcagagguuucaguaaaguaaaaaugaucuguuaaaaaagucuggugcagugguucacacgagcacuuugggaggccgaggcggguggaucccuggaggucaggagcucgagaccagccuggccaacauggugaaacccugucucuacuaaaaauacaaaaauuagcugggcgugguagcaggcaccuguaaucccagcuacucggggggcugaggcauaugaauugcuugaacccaggaggcagagguugcaguaagcagagaucacgccacugcacuccagccugggcgacagcaugagacuccaucucaaaaaaauuuuuuuuuuaaaugaaugaucuguuaaaagguacagauauaaaugagacagagucauucccugcuuaaaccccuucaauggcuucccauuauaggaaacauaaaauccaaacuccuccuucaaauccaggaagcccuacaugaucugacucugcuuacccuccacugccccuucucccucagcaaccuccuccacugcccccucucccucagcaaccuccuccacugcccccucucccucagcaaccuccuccacugcccccucucccucagcaaccuccuccacugcccuucucuccuuuggacucuagauuucagguucccuggccuuuuuucagccuucaagcuucaggcuucuucuugcugagaucucuccacucaggugucagcucaaacaucaccuccucagaaauuuccuugagcaggcaaucuauagaagcacaacucuauucucauuacucuaucacaucacucugcuuuauuucuuucuuuuuuuuuuuuuuuuuuugagacgaagucuaguucuauugcccagguuggagugcaguggcucaagcuuggcucacugaaaccucugccucccgguucaagugauucuucugccucagacuccugaguagcugggacuacaggcgcccaucaccacgccuggcuaauuuuuuguauuuuuaguacagacgggguuucaccauguugaccaggcuggccucgaacuccugaccucgugauccucucgccucagccucccaaagugcugggauuacaggcgugagccaccacgccuggccugcuuuauuucuuuauagcacuuaauaugaucacauuuugaaugaucuguuuugcuuaucaucucacacucccauauaaaaaacuagcucaaugagagcaaagacugugucuuucacugcucugucucuguccgcuagcgaagugucuagcauacagcaggaacacauacugcugauucuuuuuuauaagcuuagaaucuauuucauuucccucauuucuccuugaagucucacagauuuccucugaaacaaaagcauucaaaagaggccuuagcuguuacugaauuccugaaagaccucaguugaggaacacucuacuguuaaaaugggaauuaauuccucucuauaaaaaaaugacaaguuccaaacaauuuuucugcccccuaaaaaccuagcaugaacuugccucaucuggaaagaagugcucaaauaaagguguuuaaaaucugcacugaaauuaacugauggccuaagauacaaaaaacaaagaucguggaggcugcuucugccccauauugacuacaaugaagacacaugcauuuuucccaauuauaaggugauuauccaauuuuaugcuauuuaaauuuagcuguauuacaaaaaagacaaauccugaugaaucagucaagggaagaugagcugugauaccucugaaauaaauauacugucaaggaauagcagcaaaacauaccaaaucaauccuuaaaaaagaauccuggaagauagagaagauacauacacacauaugccucacagauuuuuuuuuuuuuuuaaauaagcaacuguguguuagcuacaauuaucuucauagccuaaguggaagaggaagucaagauuuaauacaaauaacaaaaacuguuuccuaguuccucaauauuugaguuccugauuucuuuaaauccucuaauucuugcugacaugucauaagcaguucucuuaugaccuaaauaaauguggaaacaaaacaaaguauuauucucuaaagaagucaacucauauacagcagaaccucagaagaacauaacuugcuauaaagcaagggcuagcugccuguuuuguaaauaaagcuuuccuggaacacagccauacccauucaucuacauauuaucgauggcugcuuucaggguacacuggcagaguuggauguuugccacagagaccaaaccauaaagccuaaaauauuuaccaucuggcccuuuacaacauuugccaaugcccaguauaaaggguaaauaggguaaagcugaagaaaacuuuaaggaaucugccacugcacggacccgaagaagagcaucagaagggaacucugguguuaugucuaaacugaaauaugauucuuuccaaacaaacaaugaaaugacaagaaaaagagaaaaaaaaaacccaaacucugacaugccuacugauuauucuucaaacucaucacacagcacaucccaugacaggaaucaccucuuuuucuuucuucuccugucguuucugcuccuccucuucucucucuuuccucugcuguucuucccauuguuccuuuaacuuucucuuuaaaggggaagaaaaaguaacuuuguuucagucacuuuuuaaaaacauuucacauacagcgcacauagaugaaaaacuuaaaacacuggcaaacugaauaagaucaguuuuuuguuuuuuuuuuuuaaguucaagauaggcaacucuuuuuuuuuuuucuuuuugagauggaguuccgcucuugcugcccaggcuggagugcaauggcgugaucucagcucacuccaaccucccaagauaggcaacucuucaugagaguuauuauggugaaguaaucaguuuguucacuaguuacgugauuccuaccauaccucuuguucuucuugccguuuuuuagccgccucuuccuuuuccuucuuuauucugaauucuucuugugccuucugcucucuuagcaaccacuccucauguaaucuuugccuaucaguauaaugauguaaucagauaaaagaaaugggcauuaauccacaaauacacacacacacgagagcaaaaugacacauuuugggacugauucaaauaucacgaaagcuauuuucuauuaaagcagucaaguggguguaagagaacgagaagagcagagcuuuuggaaaagcaccacgugucagcaacuaucuuccuaauggguaauaacuuaaaaucucucuuacauuucauagguauauauggcugugacauacuuuacagaaaaaaggacacuaugacuuucccucuagacugaucacagugauguuuaggugacaauaaaauggguagcaaguuucaaagcagcaucuaccuuuucauauucagaaagcauuucccuuccuauucuaugcauuuauuuuuauuuauuuauuuauuuugagacagaguauuacucuguugcccaggcuggagugcaguggcaugaucuuggcucacugcaaccucugccucccggguucaagugauucuccugccucagccucccgaguagcugggauuacaggugcccaccaccacgcaaggcuaauuuuuguauuuuuaguacagacagcguuucaucauguuggccaggcuggucucgaacuccugaccucaagugauccaccugccucggccucccaaagugcugggauuacaugugugagccacugcacccagccccuauucuuaaaaguagcaauuccaugauggcagcacgcugaaaacccaguauccuuugccauaaaccuuuggacuacuacuacacacaguuaagagacuccugugguuugccuccaaacaccuaaacagccaaaagaaggaaaauaaaaguacauuguaaucauguuuuuaaaauaaagcuacagguuuuaagaaauggaguuauaaaaauaaauuagugagggccgggcgcaauggcucgcaccuguaauccagcacuuugggaggcugaggcgggcggaucaccugaggucaggaauuugagaccaggcuggccaacauggugaaccccaucucuacuaaaaauacaaaaauuagccaggcgugguggcagccgccuauaaucccagcuacuugggaggcugaggcaggagaaucgcuugaaucugggaggcggaguuugcaaugagccgagaucaugccacugcacuccagccugggugacagagcgagacuucgucucaaaaaaugaaaaaauaaaaauaaauuagugagugucuagucuauuuuuuauaugaccaauuauaaugagugguauuaccuuaaaguggcaagugucucagacauccaauaucacaaauuucuaauauaaagaggggguuagauugccaaagucuaccugccaauuagguguguagaaccucaaauucauucuuccacugaauuuauaaaagggaaauuaaauaugagaaacuguucuauauuacuucagcaguauuaggaguucaguaaaguuuuaugucuagucuggggaccuaaccacaauuuuaaauaaaauauauuacauuuccaaauacagauuccaggaacacaucuuuuagccauggcagaggcuggcacauugcaucuaucaguguuccuaugccaugugugaggguaccauauagauguuucagugggcacaacucugauuuacaaaucuuuugaaaaacauauaauuguauauaaaugaaccaaaugauauauaaauuaagaccacaagaaaguaaaauguuaaaaauuuuaaaauuuaauaacuugaauauacaucugcuuugaaauaggacauaaagucauacaguauuuuuacauaauuuucuugcuuuucaauaauaguaugcaacucauaaagaaauaaagaucuaaggagcacaaagauacauguaugugauuuaaaagaagcauuucaaauaaacaggaaaaaaauuacucucuuauuucauaccguaucuauugucuucaucauaacagaaaucuauaauaauaagaacuagagcuaucacagcaccucucaucugcugacacuguguuaaacacuauacauccaucaccuccuuuaaucuucacaauucugugagguggauacugugauugacuuuaucuccauauuacagacaaggaaauagaagcuuagagacauuaagaaauuucggcugagcgcgguggcucacaccuguaaucucagcacuuugugaggccgaggcgggcagaucaugaggucaagagaucgagaccauccuggccaacauggugaaaccccaucucuacuaaaaguacaaaaaaaaauuaacuggguguggcggugcgugccuguaaucccggcuacucgggaggcugaggcaggagaaucgugugaaccugggagguggagguugcggugagcggagaucacaccacugcacuccagccuggugacagaacgagaguccgucucaaacaaaacaaaacaaaaacaaauuuuaaaaaaacauguaucccaaaagagaaaggugugagacuugagcaaucuacaaauagguaauaaaacauauaaaaagauacucuaccuaauucagaaaugugcauuugaaacaguuucauuauaguuuuauaaacugauaaugccuaguaugagugaagguauggggagaugggccccuacauucacugccagaagggcugcaaacugcaaaccaggaagcccuuucuaccuggccaucuacauuuuacauggacuuaugauuugauuccaacaaucucauuuuuagucauguucuuaaggaaauaacuggacaauuaccaaggauauauaagcauggaugcuuacugcaacuuuuuacauaugagugaaaaaccaauauaaccugaaaguccaucaguagagaacuauaaauuauaaaugaauaaacuaugaauagcaaauaaauuaugcuacaucuguacaguggguacuguauugccacugaaauggcugaauuagaucccugcaucaguacugaaauaaaugcacuauauauuuagcaagaaagcaauuuauagaaaaauauguauaaauaucaugccauuauagaaagacacacguaaaguacauuuacacuuucuuuuucucuuucuuaacaguggcuaucuuuggguguguugcaauuauuaaagucuuuucccuuuuuacauuuguuaauuuuuuuuguuuuuuuucuguuuucaaaaacaauuacaggucaggcgcaguggcucaugccuauaaucccagcacuuugggaggcugaggcaggcggaucacuugaucacaagagaucaagaccacccuggccgacauggugaaacccugucucuacuaaaaauacaaaaauuagcugggugugguggugcacaccuguugucccagcuacucggaaggcugaggcaggagaaucgcuugaacccgggaggcggagauugcagugagcugagaucaugccacugcacuccagccuggcaacagagcgagacuccgucuaaaaaaaaaaaaaaaaaaaagaaagaaaaaaaauuauaaauuagcaaaaacagaagaaaaguacuuccauuuuuaaaaaaaauaacaucuaguuuuagcccaucaacuacagauuuaaauacuuuauacaggauauuuuauaagaccuauuugguacaagauuuuauacagaagacugguacugguuaguaaagguugauaauauuccaauaaaauaacuucauucacuuuaaguguuucaauuagcacugaccucucucuuuccaauagcuucucuucuucuaguuguuguucuucaauaaaaguguccuccucuuccuccuucugugagaguccuagggaauuuaaauguuuuauuaaacugagugcugcaaauccuuggucaaaaauucaggaaaaaaauacauguaaucuuuaauguauaaaauuaugguaaaaaucuuuuucuuaaacuuucuaacaaaaaggucucugaucaaccuucuuugguacaacacaagcaucaaaaaggacaauagggguggcagauagcacauuacauuuaaaaauuaaucaaugguuccacaauuauacuuaaaaaggaaauuagcuuggcaugguggcaggcaccuguaaucccagcuacucgggaagcugaggcaggagaaucacuugaacccaggagguggagguuucagugagccaagaucgugccauugcacuacagccugggcgacaagagugaaacuccaucucaaaaaaaaaaaaaaaaaaggugguggggguguggaagggaacauccaucuucacagaagaaugguaacuaaaaaauggagaaaaacuuaaguagaaaaaucaucacuuuugcaacccccacuguaaaaauuuagacaaagacauuaaaaacaucgaaugaaagcuugcuaggaagaguauauucacacuaucucaacauaucaccccagacaugaggacuaauuagaaaagaaaaaaugcaaugcuuuccaauggagcgaucuggacacuuuuuuuuuuuuuuuuugagacgggagucuugcucugucgccaggcuggagugcaauggcgcgaucuuggcucacugcaaccuccgccuccuggguucaagcgauucuccugccucagcuucccaaguagcugggacuacaggcgcgcgccaccaugcccagcuaauuuuuguauuuuuaguggagacgggguuucaccacauuggccaggauggucucaaucuccugaccucgugauccgccugccucggccucccaaagugcugggauuacaggcaugagccagcauguccggcccuggguggguaacaccuuaaccacaguuagcaucaccgggagugcaacaaccugaugugaaaggucucaugauguaugcaauaagaaguuuacaacaucugcucuguaauccuuuguucuaaagaguguuguuaccugaaguuaaucaugagaagacagaacaauccagaauacagggcauuccacaagauaacuggcuugaguuuuucaaaacaaucaauccugguuuggggaaguuuaaauauggccuguauaugauaccauugaauuacuugcucauguacucaggugcaaguuugguauugugguucugcgggagaauguccuuauucuuaggaguugcaagcugaagaauuuaggggugaggugcugcuaucugcaacugccauccaaaagguucagaaaaaauguucuauguauguaucucuuuaaauagagaaaaagaaagaaaggccaaacuuuaacaacuggcaaaucuugcugaaggguucauggauauuuauugugcucuuuuuuucaacuuucuguagauuagaacauuucccaaauaaaaacaugaaaaaacaacuuuuaauagaauagacauuuacauccucucccauucaaaauuugggaaaaaaaucagugaaaguggaagagaaauggaagacugaaauaaucuuaaagaaauguuacagaugucaggcuuaaagaaaaaagagucuguuugucacauguguugaguacaguucuaacugaaggcucauccagucuuagauaauuacaauaauuuacuuuucuuaaguaaguaaacuuuauuauuucagcagcuggaauuaaaaugggcaacaaauguagaauaaguucucaaucauauaaaauaguaucuaauuguucagauaauuaaaugaucuaauguacuuaaagcgccagagaaccuggcacagaggauauggccugacuacuugcagagguaugccauagauuagacagggcauagacacagcugacacucacaaacaccuguugacugacucacucaacuccccaucaccucgaaaccaagcucauauacuccacagaagugauugcuaacaguucuggguacagcauuuuccccacguguacaaucggacauaugcaauacauauacauacaauacagcugacccuugaacaacacagguuugaaccaccuuggucuauuuaaauacagauuuuuuuucaguaaacacacuggaacauuuaggggauauuugcaacaauuugaaaaaaaaaauagguaaguggcauggccuagaaacacugaaaaaaauuaagaaaaagguaugucaugaaugcauaaaauauauguacauacuagucuauuuuaucauuugcuaccauaaauauaaaucuauuauaaaacguuaaugcagagcugggcgugguggcucaugccuggaaucccagcacuuugggaggccaaggcgggcggaucaccugaggucaggaguucgagaccagccuggccaacauggugaaccccaucucuacuaaaaauacaaaaauuagccgggcgugguggcagccccccguaaucccagcuacucgggaggcugagggaggagaauugcuugaacccgggagguggagguugcagugagucaagaucgcgccacugcacuccagccugggaaacaagagcaaaacaccgucucaaaaaaaaaaaaaaaaaaaguuaaugcagauacuguuaagcaauauugugcuggcuugagcagcacauauacagauacuguuacaauauaaguuaaguguuuuauuguuuccuugcuuaaagcauuugaaacaggccagggagcgguggcucaugccuguaauccuagcacuuucggaggccgagguggacggauuacuugaggucaggagaucgagaccagccuggccaacauggcgaaaccccaucucuacuaaaaauaaaaaaauuagccaggugugguggugcacgccuguaaucccagcuacucaggaagcugaggcaggagaauugcuugaaacugggaagcagagguugcagugagccgaaauugcaccacugcacccuagccugggcgacagagcgagacucugucucaaaaaaaaaaaaaaaaaaaaaaaaaaacgauuugaaacaaaaugaucucugacuucauuccauucuaagacagagaaguucggucucaaacauuuuuccuugaauauuacuauaaaaguugugcuacaacauaaucauugacaacuuuuuuuaaaguuaaaauuuaucaaaacuuauauuuauagaccauauauggcacauucacaguugagaaaaauguaaacaaacauaaauaugcaguauuaaaucauaacugcaugaaauuaacuguaguacaaaacaaggaaaaaaacgcauccaaugagguacagaaggaagaaaaaaauuaacuguaguacacacugcacuacugcaauaauuucauagccaccuccugcugcuauugcagugagcucaaauacuaugaguauucacuuaaaacaccuugugacacuacucaucucugcaugagcaguucaucucuucaguaaauuguguauggcaguaagaagugaucucuggcguauuuuucacuguguuuacuacaaaaugguaaaccuugaauaacaucaugagacucacacaaagugcgacuagcgaugcuggaagugcucucaagaagcagagaaaagucaugauggccgggcgcgguggugcgugucuguaaucccaacuacucuggaggcugaggcaggagaauugcuucaacccgggaggcggagguugcagugagccgaguucaugccacugcacuccagccugggcgacagagcaagacuccaucucaaaaaaaaaaacaaaaaacaaaaaagaaaaucacugaggagaaaggauaucugcgugaauaggacgcccagcuacuuuuuguauuuuuagcagagacaggguuucaccauguuggccaggcugcccucgaagucccgaccucgugauccacccgccuuggccucccaaagugcuaggacuccaggcgugagccacugcgccuggccugaacagguuuuuaaugcagaugaaaguauccuauucuagaaaaacaccacaaaggacauuuaguaggaagagaagcaagcagcaggauugaaaacaaaaagagacaggcuaacucuacuguuucaugaaaacguagugggguuuaugaucagaacugcccuuaucuauaaagcugcuaacccccacccccaauccuugaagggaaaagaucagcaccagcugccugucuuuugguuguacaacuagaaggccuggacaauggaaauccuuuuuucugaauugguuccacugaugcuuugucccugaagucaggaaguaccuugccaauaaggaacuggauuuuaaaauuauuuuaauauuggacaaugccccuggccacccagaaccccaugaguucaacacugaaggugucaaaguggucuacuugcccccaaacacaauguuucuaauucagccucuagaccagggggucguaagaaccucuaaagcucauuacacgugguacucuacggaaaggauugucaaugcuaugggagagaacccuaauacagagaguaucaagaaaguguguaaagauuauaccauugaagaugcuauuguuguuauagaaaaagccaugaaaaucaucaagcccaaaacaaaguccugcuggagaaaaaaauguguccagauauugugcauggcaucauuggacuuaagacagagccaaucaaggaaaucgugaaagagauuguaaauaugggggggggggaaaagugcaggggggucggggugaagggucucaagauaucuugaagaaauucaagagcuaacagacacaccagaguaguuaacaaaagccaauuugauggggaugaguccuuccaaaccagugcaaggugaugaggaagaaaacugaggugaagcagugccagaaaacaaauugacacuagacaaucuggcagaagggccaauuauucaagacugcuuuugacuucuuuuauggacccuucuauacugaaaacuaaugcauuuaaacuaaagcaagugguggaagaauugguacuguauagaaacauuuuuagagaaaugaaaaagcaaaaaugucagacagaaauuauaauguauuucugcaaaguuacaccaagugccgucuacccucuugccuucccuucuaccuccuccaccucuuccaccucugccacccaagagagcaagaccaaaucauccucuuccuccucggccuacucaacauuaagacaaggagaaugaagaccuuuaugaugaaccacuuccauuuaaugaagggcaaauauauuuucuccuccucgggauuuucuuaguaacauucuuuucucuagcuuacuuuauuauaagaauaugguauauaauacauauaacauacaaaguauguguuaaucaacuguuuauguuauugguaaggcuuagagucaacagcaggcacuuaauaguaaguuuugggggagugaaaaguuauaugcaaauuuuccacuguggggaggggcggggggcggucagaguccccuaacucccacauuguucaaggaucaaauguauauccaaugguauuauacagguugagcaccccaaauccaaaaaugagaaauauuuugagugacaacaaugcucaaaggaaaugcucauuggagcauuucgaauuuuggaucuuuggauuugggaugcugaacugguaaauacaacgcaagcauuucagauaagggauacucaaccuguacauguaacuguacacacagaaucaugcuauaguuuugcaacuugcuuuuaauaucuuaauuucugacgagguagcuuguuuccaguuaucugaaguagaauggaugccaaagaagcuaucuguaauuaagagcucacuauuccagaaaucauuugccaaggcacuccaaucauuugccaaggcacucucauaguuacacucaacauucuagccuucuggguaauguuuacccaucuaacgugugcuacaauaaacagcaguguuccuggccgggcgcaguggcucacgccuguaaucccagcacuuugggaggccaaggugggcagaucaccugagaucaggaguuugagaccagccuggccaacauggugaaaccccaucucuacaaaaguacaagaauuagccgggcaugauaguggguaccuguaaucccagcuacucaggaggcugaggcagaagaaucacuugaaccugggaggcagagguuacagugagccuagaucgugccauugcacuccagccugggcgagagagugagacucugucucaaaaaaaaaaaccaggaguguuccauagucuacaguauucaugaaguaccacuaggcaaagaauugugaguuggagugggcaaaaguaggagcagaagugcagagacaggugcuuagucuuggauaugccauuaguuacauaaucuugacagaccagugaccuggauuuaguccauuaaaaugggcuaaacuaccaugggacaugacucgccugacucuccacagaggcucauucugaacacauuuugcuaaguaaaaaggaaaaaaaaaaucaaaacaauacaaauaccagcuguuauaggauuuagugcaggaaaagaaaaagagaaagaaguuaaaacaaauuuagaauauauaauauuuagaauaaaacagauuaaaugaacaaaguaaaguagcugaaaauuucaaggggggagagacgaaguacaauaagggccucaauaacuccaaccuauucuacuuuuccuuuuaucccugaugcuuuguucugccucuaguggaugaguuuucaacuaauaagacagaaaugcuaacacagguugcaguuaaacacacugcuccuuccauucuaaauaucccaguacugacacuaaaauaauuacucaggaacaccaaugguaaauaaaaccucuauggcuauguuucucaagguccaagaauccuaguuacuugaggccauggucucuggauuuuaagaauugucuaggauaauuucaugagcauauucuggauaaugcggaugacaaucauuauaagccaguacuacugugugauuucagugcucccaucuggauuuauaacuacuacauaauuuuauaacuaaguccuaauuuuauugcauuaagcagguagauuuaauacauaaauguuagguuuugccaugugaaggucaaaugaccaucuguacaaauaaagguucuacaguaauuucauagaaaaagugguaaauaacuauaaggcaacauuaguagaggcauuccaaacucccaucagugccauauacauauugugaggagcauuaguuucacaucaucccuagcauuaccugauguagauuuaaauuuuaccgaauguguaauuucauuuaguuuuauaauuuauaaauguauuuuuauuuguuuguuuguuuuuugagacagaaucucacucuguugcccaaacugaagugcaguggcaggaucucggcucacugcaaccucugccucccagguucaacugauccucuugccucagccuccugaguagcugggauuacaggcaccugccaccaagcccagcuaaucuuguauuuuuaguagaggcaggguuucaucauguuggccaggcaggucucgaaccccugaccucaggugauccaucugccucggcuuuccaaagugcugggauuucaggcaugagccaccacgcgcccagcccauauauuguuuuauagucaaacaauggcuucaggucaggugugguggcucaugccuauaaucccagcacuuugggaggccgagguggaaggauugcuugaggccaggaguucgagaccagcccaggcaacacagugaaaucccgucucuacgaaaauuuuaaaaauuagccaggugggccaggggcgguagcucacgccuuuaaucccagcacuuugggaggcugagguggguggaucaccugaggucagaaguucgaaaccagccuggccaacaugaugggguuucaccccaucucuacuaaaaauacaaaaauuagccgggugugguugcgcacgccuguaaucccagcuacucgggaggcugcagcaggagaacugcuugaacccagggggcggaggcugcagugagccaagaucgugccacugcacuccagccugggcaacagagcgagacuccgucucaaaaaaaaaaaaaaaaaaaaagaaaagaaaagaaaaaauuagccaggugugguggugaaugccuguagucccagcuacuagggaggcugaggugggaggacugcuugagccugggagguggaggcugcugugagccgugguugugcacaucccuccugggcaacagaacaagacccugucucaaaaauaaauaaaugagcuucauaacuaguauuauguugauauauauuugaauaacauaauaauuuggguaaaccaagggucucauauuagucaaguuugagaaaaacuugcaaaacgucuaauuaauaccuucaacuccugcugguuuuacgaagaaaaacauucaccgaauacuuacuacgugugcaaggacugugcuagcugcuguaauucaugaagcuugcaacuguaauauuagauacuuuauaaguuacacagaaucagugggcgaucauucaccaagacuuccucuuccugccuuuaguauguuaacauuguuucugacauguguuucuaaauaacuacuugggggcagaagucacagcuauuuuuccuccgacacaauauuugacuuccuucugacacuggggcuucaaguuagggcuggaguggacagagcaauuucacaacacagaaaacagaauaaagaguccaucaccugagucucucagucgagcaaguuccugccgacguuucuuucguuucuccuucuucagggcggcccuguacuuuuuguggcuggaagauuaagacauauacacgacgaucagcggcuacaaugcagcgcugcccgagcuccccgcuccucugugcccaaugaaaggaaauaguucgggugcugaggagagaaaccuugcuuccuguauuuuaauuacagaacagccaucuaucaucgccucauccucccacucccagacaguucuucuccauccgccaaccugauccucuccucgcuugccugagccacagccgcccgugcaaguccggggagggcaccagagcgcgcaccaggaaggaauggagcugccgcgguggcucacuuagcuuggcccagcuucucuuuucuuccugccaccacauccuccaugcccacgaucggcccgcucgccugcucaucuccccguacggcgcuuaccuugguuucucgggaaacgucaucuucucgggcgcagccaucuugccggcaccgccccgccccuccaggucuggcaggaaagggcg

SEQ ID NO: 192870 - RNA, 20705 nt, Homo sapiens
cgucgccauguuguucccuccgcgcuggacgggagcagcuggagcgggagccuggcugcgcuaccgcggcugccuccugcugugcagguccccgacccucucucuguccucauugcgcccagacgggccggcccagagcucccgggucgucuuucguguggccgcgaggugagcgggacucgggacuccuucgggaccgggcggagugcgcgggugucggggucugagggggcggcucgggccucgggcagcuggggcggggugcggugcgcgcggggcuagcgcgggucacaaggccgccccgggagagaggacggcugguugucucccugccuccucucugacgcaggaggaaagacgguccccacacccuuggggagagggacucacagaaacacacacaaacacuggagaaagggagauacaaaagcccggacacccgugcacauacacacggagaaauacacccggucaccugggaacacacguacacgccagccuuucccccaaccacuccgggacacacauccacagaccccaaaccaaauccuacacccgaaugauuaauguagggaaaacaaaggcgcucccaugacuugauuuuggcgaccucugaaguuccaccuagcagaacguguuugcucgaugucuuacgaccacucgggugaggaauucggaaaguaaagccaaucuuagaggcugcaggcguuuugggggcauuaucugauucagacgcuggcuaacguuucacaaucgcguucccuuuuuucuuccaacuugguaaguaaaaaggcaaaaugagaaauuuaagugcugaacuuaauaaauaguugguggacguauugcuuuuuuuuuuuuuugguaagggaugacacaucucgugacuacaguucuuuugaggaauaacuuuucugcuaguuuccaaaucggcacgugaccacaaucuuuucauaggauuuuagcguccugauaaaaaucaaugggcagaauuugauugcuucuuuaaaaauguguuuguccuucggucucuggcaccauuguaauggaaaaucccuacauugccuguacucucagaagcuguccaguguagcaaaacuagagauaaagaaaccuggaacgauucaguuaggaacuuuuaagaagccagccuuuaguuuuuccuuuagaagauuaugaaguuaucaugauugcuucucuagaacuuuaguaguuauuuggauuccuaaaucuaagacaaugcuguggcagucuggugcuuuuaguauuuuugugucugcugugguaaauuccucguuuauacuacaaaguuucucuucuggagacuuuugggaucugggcauauuuuuucguuuauuauuuggaauguuagaguagauaggcaaacacuaaguagaacaucauuggcuuugacuccaagccggguuuuagagauaagggaaauaauaccuuagugcuaucacuucuuuuccaaccucucucaucucuuuuuguuucuaucucaaccauuucuucugucuggacuacaguacucuggaggccuaaagagaagauccuugaguucucgaaauuauuuuuuuuuagccuccccucauuucugaccauuuauugagcacucacucugcggcgaauauuccguacguguaaauccuguacguacaucauuuuauuuaauuuccauagcauuucuucaguaagagcuccauguuacaguugaggaauuugggggggcauaggaagguucagucuguuuuccaagaugacccagguugugaugggguggagcggggauucaaagcaggucuggguaauuuuagaguaguaguuuucaacuggaagagaggacaauuuuguccucguaggagacauuuggcaaugccuggaggcaucuuugguucacaccugggggcaagggaggugcugcugacaucuaguggguagaggccagggaugcugcuaaacauucuuuuuuauuuuuauuuuuguuauuuaauuuuuaaauuuugcugcuaaacauucuauaaccuacaggacagccccccacaacagaguugucuagcccaaaaugucacuagugccacgguugagaaacccuccuuuucagcaguccaaguaaccccagagcuuacauuucaacugcuuuuguaguuuuucaaaugcaaugucguuuuccuauuugggauaccucaucauuuuaacagugagcaggggaaaauucucucuacugagaagcauauucacuugaaagauuaaagagugaguggcugggcacgguggcucacgccuguaaucccagcacuuugggaggccgaggugggcggaucacgaggucaggaguuugaaaccagccuggccaacauggugaaacuccguuucuacuaaaaauacaaaaauuagccaggcgugguggcggaugcccguaaucccagcuacucaggaggcugaggcaggagaaucgcuugaaccugggaggcagagguugcagugagccgagaucacgccauugcgcuccagccugggcaacagaaugagacuccaucucaaaaaaaaaaaaaaaaaaaaaaaaaaaagaccaaauaauuucugguagcagaaucuguuuuuuguuguaaggcaaaaaugacaaaaagaacuuuagagcuauucagagccauuaaaguggacuuagaaaguuuaguuucugcauuauuucaguugucugagcagccuguggggcacugauacaaaggugcugaugagaagggcgguggggagucccaaccuuccugaagcuuacaguccaaucacagucauaagauuagguucugacaucauccuagaacagaauuuauugccugggcuacucaaggacaggggccagguguucauuaaaaaaaagcaaaacaggaaaaaaaagcaaaacaggcugagugugguggcucaugccuguaaucucagcgcuuugggagacccacacaggaggaucacuugagcccagaaguuugagaccagccugggcaacauagugagacccccgucucuacaaaaaauaaauuaaaaaaaaaauuagccuagcucagugugguggugcaugucccagcuacucuggaggcugaggcagaaggacgacuugagcccuggaguucaaggcugcagugagucaugaucacaccacugcauuccagccugggcgauagagugagaccuugucgcuaaaaaaauaacaauaauuaaagaaaacaacuccacacucggcacagaaguaccugugucaugguguuuacugugggcagacuuaaauaaaauggggaaaacuugauguguguguuauaguuuuguacgguuaaccacgugugaauauuuacaagaaucaaauugagaagccauucuuguugagcauaaaauucauccuuaaauuucaccucaccagacaaauaguuaugccugcauuuuaucacuggaaucgagaaagaaaugaugaauuuuuuaauggcuuuuccauaacuuucugguguuuucuggucucuuuuucaugccugucuaagaucaggccuuucaaaauauguacugcuucauucugguggcaguauuaacuguuaggugaacuuugggagggagugguugacuggagcagucaaaaaggaucgcaucucuuuuuaggcaucacugaguguuauucacgcaaucaacauggcaucuuuuugucgguagcuuugguuuuugacucaugccaaugcacagcacguucuuugcugaugaauagauuucucugccucuuaucaggaguugucugcugugggguagggaggauguugaguuacacaccucaaaaugauugcuagugcauacacauggaaucuaacaaaagugacguguuuuauucugggaaaggucgagauaaauuggugcuagaguugucuuguuugaucauuaauuggcuugcuccuccagccaacuuaggucaccacauuuccuucuggguaaaaugagauggcugugcuucauaaucucuaggagauuauaugucacaaaguagaggcagcaaauuauuagcuuccaaguaguucugcccaggcaauguguuaagcagcaggaggaggaaguaagccaaauggaaguguguguguguuugggcaacgcaucuaacuugaaagguguauagauaauagacucuucagucagaaccaagcauaagagaauaggauuugugacuaaguaggccaucaacagagaacauuuauuaaggacuuuuuuguagaggagugagggugaacucaaaaaauguuucagggaguuugguggaaagcuaugaugcaauuggaaggcgaggaugccugagggaggagacguggagccaccuagguguguaggcagaggggagggaggucggaggcggucccaggccguguugccagagagcccaggggugccagggcuaguuagauaacuuggaggagaaaucucuguuucucaccaugacucuugguacugugcauguugugaagcugugugcucuggguauuuccacauucuggauuuuucaaauccuuuuguuaauuuuugaccauggugaguucaggcguuguuauuauguugcuuauuaugaauacagugaggaugacuagguguaaaugaauguaagguaacagcuagaucugccugagguggagagagacuggguguguauuuuggaaaaaaaauggagaagugaaacaggcuguucaggcuucacauucuggcugcauggaagccagcucauugcauucuccaggaguucucugggagucuguggacacagacuccacuuuugucuuaggccugacucguacaaacauauucuguuguuugacaggggauggagaaacacuauagaacaacuggacacauucauuucauugccacauucuuuauucaagugugacagagagcaaaacaguauaaaggaguugaacugacuacuguauuuuaauuucaaguuccugugaauuggauuagauuuuuggguacagaagcuaagguaauuuccaaaagguuagugcccauaagacugucuauguucucagaguuagaaaaaccugggaaaaaaaaaagccuuacagaccucuguuucuacaacuugcugugcagaacucuaacagauaggaguguuuaugcagcuaggugacugcucuggucugugcaguuucacaccuguguauuugaucagauguauauaccuggaaauacauacauaaugugguuggaagucagauuagaacugccugaggacuacccauuggugaaugcagaacauucuuuggaaugagugcuaguauucuuaaauaacauuuaaaaauaguuguuugggagcaaacaguugccacccucauaauccacuuuaauuugugcccaguacuugauuuuuaucacagcaguccuggaaaaccuagcuucaugaagauaugaugucaucgaaaggaaugcagugcaaucuaauuaacuccccuccaguggggugcccuacaaaugucaaguaucuauguuucccucagaaauuuaaaauagcccacccugcccuugugaauuugccgugaugcuuuggggcaccucagcaugcaguuugggaaccucaggauuagaaguugguauuauuggcucuaguuuauggacuacaagguauaguggugaggagaaaaggcaucaaaguccguuuuuaauucuccauccccccuuccaguaucuguaagcuuuucccuugggccccucauuucccccagagcuuugcaguuuugggaugcuacccuuuuaguugcuaagcugaggggagggacagacaggaaagagacugcaguucagguuuccugugcaaaucgucccuccagcuccacuuuccuuugugcuuucucuccauuuucugcugggugcaauuccuuaggaagugggucugcuaggguagcacagggaugugggucauggaaucuacagccuuucagggaccccucgagccuccggacccggccugucuggagaagucucgagaagugcccgugugcuguucaguucuuuuccaguucucuggugggaaucagcuuucucauuguuggcugcugcuuuccgcauuagguuucauugucucuucacucugucacucccggaccauuugcuuuccacuuucuaaauuuuguugcugucuugcaucuacaguuguucuuucuugguguccuuuuuggauuuguaccuuacguagaccuuuucugucacugggugggagugaagauaacacauacuugaccugcccuauuuaguuagaccuggggaaguuuguggacuucuguuuauugaucuauaaaacauggaugauaguguccaacuugcagguaauuuuaaggugcuauaugccagguaccuaguagauauucaguuaauaguggcugcuaauauaauuacagccauagcauuuauuauuugagcaagcaaggcaauagcaauagguagugcgaaaaguggacauauuucauguguggcugaaugaagugcguaagagaaaagaaagagauuuucgaaauggagaaaauaauuagcucaguuuuagauauguugaauuugaacuaccaucaggguaccagaugaacauacuauacaagggguugcaaauucuugucuggcucagacaugcggauguagacuuuaggaaucacugguuuuuauagcccagggagauaccaucuggaaacagguaaggguuucagucucgugaaauagcuucaugaagagcuugucaggaaagggagcugucuauguugaagaaagcuaaggggccaaggaggagagaaagcagaaccuauuaucagagugguuuuauggacaauuaggaaacauuuucaagaggauuacugccaggcuguuuggaccugauagaagcaguaaugggugguaaguccuggcucagacuugaaggucuccccugugccucuagcuagaugugugauccuguguaagacacuuucccaguuagaccuguuuccuuauuuguuuuuaaaaaacacuugaggccaggcacgguggcucacaccuguaauccuagcacuuugggaggccaaggagggaggcuugcuugagcccaggaguucaagaccagccugggcaagauggugaaaccuugucauuacaaaaaaaaaaaaaaaauuaaaaaaaaaauuagccagucuuggugguaugcaccuguagucccagcuacucuggaggcugaaaugggaggaucacuugagcccgggaguuugaggcugcagugagcuaugaucaugccacugcccuccagccugggugguagagaaagacucugucuuuuaaaaaaagaaaaaagacuuggguacccuuccaagauuuuaguucaugcacauucagacagauggcuacaccugagagaauucacuauauacuagcugggccucagguggagaugcuggucaaacuugcagguguuuucuagaaacauacacaaugaaguccugagagaagaacuuuucccuguauucaccuuaggguuguaugugccguagggcauucagaugaggacugagaaaaagccauuggauuggccauuaggaggucuuuggugacuuuugcugacaaucagggggaaaggauggggugggagcccugguguccuauaaacugagcagagaguuaaucagguuugcaggcacauugagaaauggguagugaugggcagagugagguugggcuuggaaagcuuuuugugagaaaagucaguuucaacacuucgauaggggcagaccuggggggaucauugacaaagugacaguuacauuggauaaacugaacuugaugaagagcugccugcaguguugagcuggugacaacuucccugcagagugguauuugggagccucuagucuagucgaguccuauauaccggacauagcugccccucuuuaaauauaucuucuuaggaaauccucacuccuuguaauuaacuucucuaacagucgagaaguuuccuuuugcuguggcuccaugccuuguggagccccucacucagugaguuuguauaguuccccaaccccuagcuuugucugcuguaaauuaaagacauuugguuucuuaucgaacuggaagggaggccucagaaccaauguuucuuuaggugauagcagaacguugcagaucauuuuugauuuguguuuugcugcuuuaauauauuuuucugacauauauguucaaauucauuccuuucauaauuuguuuuucuuccugaaauaucuaccuuuaauuccccauguucucaucuugugacuuuuaucuaugucuuugcauuuuaauucugucuuccaaagugcacucuauugucaaaaaguauuguaaguaccuuuuacagguaagugucaucgcagguagauuuaugcuugguucuuaaaacuuaagcaaaacaaaaaaaaauuauucucacuucucaggacuagcaguuucccaugaguaaggcuguucacugaacuaucacaguuuauggucaaagugugauauucauaaaagucucaugggugagggagaaaaagaggaaauucugcuaaagacagaaacucuugaaggguguuaugagcuacagaaauggaucacacauaacauacaaaugaugcaggcauguagcaaucaguucuugguguccaaacuccuuaagaucugaugaaacauuuuuuguucuuuccagaaaaaaagcgcaagcacacaagcuuccaccaaugcucucauccuuauuucacaugugauucuagggaguguauuuucucccugaagcucauuucauggacucccaauuaaccacacucuaggccugcacuguccaacacaguucccacuagccucauguagcaauuuaaacuaguuaaaauuaaaugaaaaauucaguucuucaguuagaccagcuacuuuccagugcucaguagccacaugugauuaguggcuaccauauuggacagugcagauuauagaacauugucgucauugcagaagggucuguuggauuuugcugcacuauauaguuucaugaugguuuaagauuuaguuccuuaacuaagucuucuuuuucuuuuuuuucuuuuuuuuuuuuuuuuuuuuuuuggcccuucucacuuccuccuuucccacuccccccaccacuguuagugauuaguuaacauaccuacagaggugccuuguuuuaagaaaaauguuaacauauuucuuaaaaguuaaguuagcugauucagcuucaaaaaaaguuacuuaauugaaauaaguucuuucaauaggggaggugcucugacauagcgauaguaugguuugauaauacaguuuuucuccucuagcugccuccuguucuugagguaaugcucagugauuaacuagauaggacuagauaauuuauuucaccuuggcaggucuugccuccaaguuggccuauuccuaugguauuuccuuuucuuucuuuugcuucuuccugcacacuaaguaugguauuuucugacaguauuuuucuuaauucuuuauuuauuuuucuugguaauuucuugcuguagagcugguacccauuagacauaaugacuuuccuugacuugcuucuugcucauaaauuucuguaagacaaucaggaaguuuuuagaaacaaacaguggaaccaauuaggcuguuaagugagacacgccuaaauuaagcuaugaggaaauaaauacagcuccagcaaaaauagaaauaauuuucagauuauccaugcuuuuguuucccugguuuucuuugaaccucauuuccucaagcuaugaagugaaaugaagugguaaguacaccucuaaguaggacauucagggugaauccaaaggaacuugugaauuugaccaaaaaaaaaaaaaaaaucuguuccuaaauuuaaaccaggagugauaaauucauuuuaaguuuuuggagggguuacagaguauguguuuuaaaaucucaaguuuugagaaggcaguuuacaaaugaugccugcucucccuuuggcagcuuauuaaggaauguagucguuuuucagcauuugccagcucccugucgcagucagucaauaguacuuauuuuaaagugggauucucauugggauugcaaguaagaaucaauguuuuuguuccuacccacacauuuuaauagaccucaaaaauagaaugcggggagaacugauagagaaacaaagaauuuuagguacagaaagcacaaauagaauaauaauagaauaacaagaauaaaagaggaaguaauauacucuucguucucaauguagcauuuauuugcaccucaccaaauguagagcauuguacgagaaguggcagaacaaaaaagggacaagugaauggaugcaauuagguguugugugucccucccagggaguugacauuguaauuaggaaacagacacauacacaacugaaggugauuagagcauaaguaaaugagagcuguaaagagguggaaaugaugagagcaaagaaaagagaaagauuagguugcuggggcgguccuggcuuccuacaugagguaaucuggacuaggcuucugaugacuaagauugucauagcugucgaaguagggaggggccucccaggccaaaguaacagcccgagcaaagauauggacagaaaaugccagugauaggugcggggauggugaguaguagggauauaauugggacaggcuuguaacugacauugaauagcucuuugaaugccaugcucaaaauccuguauaauaaaaauaauaaauaaaugaauuuaguuaucugucagaauggagacaauuagauccaggaccaauaaaaaaagucuaacuucagucacauacacagucauauuagagauuuauauucuuuuuuuuuggagacagagucucacucugucacccaggcuggagugcaauggcacaaucucggcucacugcaaccucugccucuccaacaauccuccugccucagccucccaaguagcuggaacuacaagcaggcaccaccacaccuggcuaauuuguguauuuuuuguagagaugggguuucaccauguugcccaggcugguuccugaacucuugggcucaagugaucugcccaucucggcuucccaaagugcugggauuacaggcaugagccaccgugcguggccagcagauuuaaauucuugaugcuuggaccuugaggcuuucuauucuuccccuugguuuauuguaggauguggcuuuggaagccagcaagggguuggagaaggccagagaaaaggguacuacugauaaacuauucaugaacaauugauaguauaagauaaaaguacauaauggaaaaguugggaaaauaguguuauaagaaggaaaggguuaacauaaaauguucuuuugucuuuugaauuuugccguaucugcuggcaaugugguucauuuguuuuccugccagugaccugcuuauccaacuuuacauucggauuaguguaugacacauacagcauauguugguaccggcacguggugugggaauccuaaaguagugucuguuguacauguaaaugauuuauuuaaagggaugcugcugaagggacaaggagaacauuuguagcucuaguaguguaaaucuaauucuagggucauauuuuuaauucucaggagauuugcacauauauuuucacauacaguaaaaauuuuuuuuuuuuucaagguagggucucacucugucacccaggcuggagugcagugaugugaucacagcucacugcagccuugaccuccccaggcucaggugaucuuucuaccucagccuucugaguagcugggacuacaggcaugcgccaccauguccagcuaauuuuuguauuuuuuguagagaugaaguuuuaccauguagcccaggcuggucucaaacuccugagcucaagugaucugccugccucugccucccguaguguuggguuuacaggcgugagccauggcgccuggccgaauucacccuuuuaaaguauacaguugauugguguuuauaguauauucacagaguuguacaaccaucacuacuaucuaauuccagaauauuuuuauuacccccccaaaaaaaccccauacccauuagcagucccuccuccuuuaccugccacugccccccgccccauccguugacaaccaugaaucuaccaucuccauauuugccuauucugaacauuuuauauaaauggaaucauacaauagguagccuuuuguucugacuuccuucacuuagcauaauguuuuugagguuuaucuacguuacaacauugcauggauguaugaugcauuuuauuuauccauucauuaauugauggacauugucuuucuuuuuaggggaaggugguuugauaauaguauggguaugcauuuuuuuggugcaaucuaaaacauugacaacucagaaauguauggacauuucuguaauuggauaguacacauccauguaauguggguuaagagagcauguuucacuuuuauuagacauaguaggcaugucaauuacagaauuccuuaugguaaaugguagaggcacgcacaggaugguuaagagugucgaggaaggggguucaguuggagauguccaguagguguucgggaggaggugaggucuagcugcauccacacggcugacuaggaguuagacagguaaagggccagggauuugaaugugaacaagguaaaacacgaagucauauaguaaauaucuuacuggaggaucaagugugagguauaaccaccucaauuuucauucguaagcccagcugacacuguuaguggagagggaucauagcagcauccaucccagcuuguccaaggccuuccuccccaccucacccacagcccuucucccauugcauccaguuagcuuucuggacuccuuaucugaccaggucacccacugcugaagcuauuucagaggguccccaucauuccuagaguacaggcagaaauccuuuccauggcuucuacucgccucccugcuccugggccucuuccuucagucuugucuuuguagcauacucuucacucucuagccuccgggugcucaggccuaccuugaguucucccaguucaugccagggccaggcuucuuuggcagggcuuuggcauggauugguuccacuuucugguuccugcucccuccucuuuucucauaguuuucucuuucuccugcugagcuuagccuguggucaaaccuacuuccccugggucaaaucucccuccagcagaaucagacuuuagugagggcuguguucucauggcagcacguggcuaaaaugaucauggagacauugcuuuggaacacaucacacuagaaaccgauguacagucucucauuaacacaguguaacacagccuaguuuaccucugauauuagaaguuaccucuuuuuccuuaacuguagcucagcaagugaaauaguuggccuguguuacaggaucauguuugcauguaaauuaagucccccagguggcuggacucucauggacucaggcaacuccguaagauaguggcauggggaaucugagugugauugagagagccccagguuuacacauugugugucucacucacugagggagauggugggcagaaucccuugcacuauuuuaagguguucuucgauuuuugguugagugugaauaguuguacuuuguaccauauaccucucauuuugugagguacaguugugacuuaaaugcauuuuuguguggaugucacaaacuugggacuguauguguggcuuguauccucagggucuggcucauaguaggcacucacuaaauacuuauugaaaaauuccuuucccaaucguucuaccaaaugguaagcuucugcaaaauuugacucauuucauguaaaacauuuuuuaaacuacuuaaacucuaauaaagcauagacacucacaugugcuuuaugcuacaugucaguaagauuggagauuacuaguucugucagguuaaccuugcucuugagcagauuuugaaauaaagcaagugguugaaagauucuuaccauuugcaauugcuuauuuucauucuaccugcagcaacaacaguagaaucucagaaacagaugcauaggcagcugggauugacguagccuaguggguuaagugccugggcuuuagagucagucggccauguucauaucuuacucccaccuuuuacuaggugugugaccuugagcauguauguaaccucucugagucaguaucgucauguguaauagguacuaagaaacuugugaggaauaaacacaguguuguagcuugcauaccauacugggcucaaggcuagcugcuguuguuguuguuucaucuucaaccccaaaugucaggauuuugaagucucauuuuauuauugauugaauuuauaaguuaaggacugcuguauguaagucccacaaaaaugcccuuugcuuuaaaaagugguugguggggagagugguugaaaccuuugguucagaccaauagaggcuaguacuuuagcacaguuccacauagugaucacugggagaccuugacauugaauuugaucuguaggacuaggauccuucagcuuccuaauguaggccuguaucauccucuaauuuguucugccuguugcccuuacugaagguugauguaagacaugaccauagaaagaaccugucuguaaaacugccagugaagacuucuucauguauucauuucacagacacucuugcacuccuguaaugagccuggcacugugaugaaacacuuuucccgugucguuugagugcaucuucucaacaacccuaggagguagguacuguugucacuguuguucccaugaggcuucaggauguuaaauugcucguccauggggcugugcucauggcauuuggugccaggaagaaguuuucuuuucugacagugugcuuugauuugcacagaaacaagagcguuuucauuuuugccuuggcugcccuguaggugggcuaccuugagccuuagcuugaccuuuccuauaucacguuggugccccucccucacauggcccuuuucugucuucccuuuuguguuaucuuuauuuuauucucuggaauaugacucauucugagccaccgaaaauuugggcaaguuuugaagaaugaaugaaauauuacacauuuccucuugauauaauuucauagcuaucucugaauauaaaacuuagaaaagaagauggguagaugaaaaacuuuuugaaaaaugcaaugauuaaaguagaauauugauuguaugacuuuuuugggcugagaaaggucauggauaguauucagguuuuuaaguuaagaaucuggcuguuaauagaagucagauacuguacuuuaacauuuuaauucuucauuuuacucuuaaaauuaugaaaacauacacugcuaaggugagcuuucuaacuuuuuuauguagauaaugaugcuugaauugaacaauuaaauuaagguaaaauuuaugaccuauguaauaugcuuuucuuauauagauuucuuucuuucuuuuuuuuuuuuuuuagauagagucuagcucugucccccaggcuagagugcaguggugcaaucuuggcucacugcaaccuccaccucucagguucaaguaauucucaugccuccgccuccugaguagcugggauuacaggcaugugcuaccacgcccggcuaauuuuuguauuuuuagcagagaugagaugaggucucaccauguuggccaggcuggucucgaacuccugaccucaagugaucuguccgccccagccucccaaagugcugggauuacaggcaugagccacugugccuggccccuuauucagauuucuuuauagaauuuagcagaauuacuaauguuuaaccuuggugaaaauugccuuuggacagucauuuuaaacugugaaguauaagagacuucacguuaccuuuuuaggcaaauuuugaaaauaacguaguaggaucccuuuauuuauuuaacuuauacuaaagaaauuucaaaggauuuuacuguuuuuaaagaaaaaauaauauuuuuaauguccauaagcugauugugguuauauuaauguauagaucaaaugaaacuggcuuuuguuagaugucacugguaaauaagaugguguguacaaugauuuauaucaccauguguguuuuuauacaacucuagaguuagagagauauucauguagaaauuaauuauuuuagcaaaugcaaauauauucccaaauaggaauaucugguaggccucaaacuguagaugggaaauguaaaaaauuguacccuauacucuguuuccuggugggcuggcauaccccaaauucauuuggucagaaugagacaaacuaagaagucccacauuauuaugaaaaaagaacugucaaagugucuuggaaaaauuacaaauuaccacuuucaaggaauuucuacaacuuaauuuaguagauauaugcaaccaauagucugggugggguuuguuagauugcaugaucuggcuuauaauuugauauaaagaugcuaaaaauucagugauguacaguaaaacuuugugucugguaaggcuguuagaucaguagagacuuauuaaaauacuggaauaaauuaugucuguuguacucucauaacacaacauggaaauugugugaaaggaacaacauugggagaguugcuggggcaggguucccaguggaggugaccaugcuaagcaguucugaaggcacagcgguucauugggggggucaccagcaaggagcagcauaugccaggguggaggcaagaggguguggggugugcugagugaguggaauugaauuuuaguuccgggugauggugcauucagaaugacugaagcagagacugugaggggaagguggcuagagugaggcuggccaagagcaggggccaggugucuugccuuagaaguuggacuuaguccuggaucucugggaaacaacccgcugaagaauucugaggagacauuagauagaugguuccccuaugucaaaauaguugguuugcuuuuaugguuuucaaucuuuucuuuuuaaguuguugaagcaagaugccaaagaauuaaagcagccaauuuagcacauuguuaccuaugucaggaaaguaaggggcuugggacuguugcaguuuccucuuuaacauuaauagucuggauauugagcaauacauuugaaauugaaaaagucucucaaaagguaugcaccuuaacugccacacacuuguguuggacaguuuaaauuguauuaauauuaauuauaguaguaauuacuguaguauuaauuuguuuuguuuuuugagauggagucuugcuuugucaccuaggcuggagugcaguggugcaaucucagcucacggcaaccuacgccucccagguucaagggauucuccugccucagccuaguaccugggacuacaggcgcuugccaccacguccagcuaauuuuuuuuuuuuuuuuguauuuuuaguagagacgggguuucaccauguuggccaggcuggucucgaacuccugaccucaagugaccugcccgccucagccuccccaagugcugggauuacaggugugagccaucgugccuggccuguaguaguaauuugaaagaaccaguaagagguagggacuaagguaugucccaucauuuuuuaauaguauuucccauucacuugauuucucacuauacaagccacuacaagguuuuuaucagaacaguggagcauguggcuagaagugcagaauuccuacauguuacaguaaguguucaguuacacuauaguugcucacauugcauauaaccaggagacagccagauaauguuuacugcagugauuuuacaaauucauccuggucaauauaacaauuauuguucaugucuuuauugccuucccauggagggauucauaauaccuacuuuccuauuaagguuauugaccaaauuugcucuagaucugugcucuccaauuggcucauuaaauguggcuauuuauuuaaaauugaauaaaauuuaaaaugcgguuuuucacuuccaucagccucaugucaaguguuccacagucacaugcggcuaaguggcugcuauauuggacauuuccauuguugcauaaaauucucuuguacagugcugcucuaauaguuaucuucuuauauacauuuuaguauacuuaaaaaccauuuaauacuaaaguacagauuaaaugauauaaucugauucgaaauaacuggggagaagggagaguuggagggguuauggaggaaacaagauuugccauaaguugauaauugugaagcuggguuuagaguucaugggagcucauuguauuguacucauuauauagaaauuuuguacauguuuuacauuuuucacaauaaaaauguaagcagaaggauuaaccaggaacugugcucccaccagcaccuagaaguagcugucugucaacgggcaucugaaaucucaccccccacaggcuggcucuuguaguguaguaaaguuuuuaauccugccacaggacuucuaaagaacacauauaguaccacauuuucauuuaagguuuauuucauucuaccugaaaacacacaaguagcagcagucucauguuccuuaaguguuugaacugcccaagugaaucuuguggauagaaugugcuagauuauauuaaaaauuccauugcugcugacauuaauuugaacaaauucaaaauaauguucuuaaugaagagaauaaaguccauuuacucagugguugguucauacuuuauuucacagccagguaagucaguuucugucucuggcuuuccugguuaacagcaccugugucugaagagagguggagggaguaguagagaaagucccugguaggagagaggccuuaagugaacaccaucacugugcacugaagggcuguuugaaguuguuaagagaaacaugugggcugggcauggugucucacgccuguagucccagcacuuugggaggccaagacagguggauugcuugggcccaggaguuugaagccagccugggcaacgugguugagacccugucucuacaaaaaaauagaaaaauuagcaaggcaugguggugugcaccugugauuucagcuacuugggaggcugaggugggaggauugcuugagccugggaguucaaggcugcaguaagccaagauggucccaugcacuccaaccugggugacagcgagauccugucucaaaaaaaaaaacaaaaccaaaacaacaacaacaacaacaugcgaacuuuggucuccuacccaucucuaacaaaugguggggcuuacuaugagcagagaggggcuuaucauagaguaacgguucagagcaagggcuuuggggucagacuugggcuugagugccagcuucacagucaacugugaccugagaaaagggaagagugagcccuucccagcuguuucagagaauaaugguagaauaguagccugcacauggcuaagugcucaguaaacaacaagucuuauuauuagguauucccuggggccauauguuuuauuucagcuaaaugcugauauucguagaaucauguagaagaauguguagguauaaaggaauguaauggugccuuuuuauuuuacaggguucuugaagcuuuugagauuaacaauggcaggaaaaucaucacuuuuuaaaguaauucuccuuggagaugguggaguugggaagaguucacuuaugaacagauauguaacuaauaaguuugauacccagcucuuccauacaauagguguggaauuuuuaaauaaagauuuggaaguggauggacauuuuguuaccaugcagauuugggacacggcaggucaggagcgauuccgaagccugaggacaccauuuuacagagguucugacugcugccugcuuacuuuuagugucgaugauucacaaagcuuccagaacuuaaguaacuggaagaaagaauucauauauuaugcagaugugaaagagccugagagcuuuccuuuugugauucuggguaacaagauugacauaagcgaacggcaggugucuacagaagaagcccaagcuuggugcagggacaacggcgacuauccuuauuuugaaacaagugcaaaagaugccacaaauguggcagcagccuuugaggaagcgguucgaagaguucuugcuaccgaggauaggucagaucauuugauucagacagacacagucaaucuucaccgaaagcccaagccuagcucaucuugcuguugauuguuagauuguugaugcauucuaaccaacucacacauauacacaaaaucaacauggggauggagaagagaauuagcguuugcagcaguguaucaucuacuaauaaaauuaaacuaauguugcugcuucauuaguuggugggagaagggacacauccacucuuggaggaauauauuuacucaauaauggcaccuuacauuuauaaauuguaacaguugucuaauaacguuucuuuaauuuaaauauguaaguugcagagcuaauaaaugaaaugaccaagacuuuaauuauaauaaaaauaagaaacuugacuauucuagaaguuauacuuggauuuuuuccugggaaaauggagaacuacuuuuuauauguguauguuuuuaugcaauuagcauuguauucuugguucagggaaauacuuuccuaaagcaauaauguuagauauuaaagauuaaaaucuaauguauuugcaa

SEQ ID NO: 192871 - RNA, 11799 nt, Homo sapiens
aaaaaggaaguaggggugcgugagaacgccggcggugaccgcagccacagcggugaccgagugagaggaaggcggcggcggcggcggcggcggcgugaagucacugcugcucuggguucggguuggcgacugaaggcgguaccggccucccggaacagcccgggggagggcuuaggugcagaagggcaggcuggccgcggccgguuuggucuggggaccacgggcuggagcaggugggcaagcgccgggacgguguggggaagacacuuggcagcuucucgaccucuggugucccuucguuucuucgaauuccuauucaugcgccgcacccuucucggacccccagccccucgcuaaggcucuggggaugggggucaagucuaggcucaauggaccuccccuccuccacccgggucaccacuccucggaaauccucgccccacucccgccucaggccuguaccuccuggcugugacgugguuucucagcgacugccucaccucagucccaaaauccucacugccuuagauacauacgugcccccagagguuggccuggguuucacaguauuucccuaagggggcaauauauuaaagcuguccuucgaaguuaguacccugccugguagaugcccaugggaugacaaagaggaggaacaaggguugaccagauuaggacuaacgagagaauagucugaguccagagacauuaaucugucucuuuguuuuggcagguggaaauuuaaaauuguuuacagucaacacuguuuccagccauggguuugucuccaucugcuccugcuguugcaguucaggccucaaaugcuucagcguccccaccuucaggaugcccgaugcaugaagggaaaaugaaagguaaucggcccuuugccuagaaaauaaaaacaaaagauaauucacggcugggugcggugguucacgccugugacagcacuuugggaggccgagguggguggauugcuugagcucaggacuucgagaccagccugggcaacauggcaaaaaccucccucuacaaaaaaauacaaacauuagccagacgugcuggugggugcccguaguaccagcgacuuuggagguugagguggguaggaucgccugggaggccaagguugcagugagccaagauugugccacugcacuccagccugggugacagagugagacugugucuuaaaaaaagucuggaaagccucuaaaggaagaggcaguguaguaugcugcugaggcugguaggcaugggagucaggcacccugggucuggucguuauuuugcgucuuauugagguuugugacucuaaacaaguuaacucuguuagccucagucugucaucuguaagaugaagauauaauaauguuucacaggccugucaugaugauugagguaguacaugagaacguagugaguacucuaaaccagccccaacuucccaaaguuuacuugugccuacaucagugguucuuaacuggaggggggcaauccccccuucccacaggggacauuugccaauaucuggaggcauuuuugguugucacaacugagaggaaagugaauagagggcaggagugcuccuaaacauccuacaauguacagaacagccccccaacaaagaaucagcuggccccaaauaucaagagggccaagguugagaaaccuuagucuagaucuagcugucuuaauaaauaacuuuugcucguauagccauuucaguauuuucguauauaaaaguaagccaucacuuaacgggcuugcuguccauucuuuagauaagaaaaugaaaauggaaaagcugucuuucauuuuuaauucauucaugucuacuuuagauuuuuuauauuaaaguguggcuugaaucaguaagucgugaagggcagaagcaacauggugugcuuacugaguacuaauguuugcgcuguuauucauuucuucagucagccagccuauucugagaggucacugcccauucuguaccaagcauugcuggauuuuguuuguuucugcacgagagaauaacaucauacaaaauggagcuuugccugauagagcuuacauucucaucuucauaagcuauguggucuuacgacuucauaagcuaaguuuucucccuauuuuauagucaaggaaacuaagacuuggaguaacugaugcuccaagucacauaguaaguggcaaagccagcaaaaguucugugaccuuggacaaggacaggcaguguucuucugggguuucuuuguacaggaagaauugagacagaucagccaaagcaggugugcuccuguucugaguguccucagggagauucuagaacccuuacuuugguuuuauuucauuugcuguauaucuuggagagcugccagacuuacuacauuaauaaagaaugugggugucuauaggagaucgaaggggcuacugguuauaugacgugaaaaguugaaauguuauuuucuuuguaacacccagcugggaucuaugacuuggaaaggauuggugcuuucagugguagagaggaaaggcauagcaagucuuccuucaccccuaaagugggcaguggcacagggcaccaggaaaugagggcuugggaggagaagugcagggaaggaagugaaagcaaacucagcuuuuucauguguauugcuguaguugcugcugcugcugccugaggccaagauuccauuacaugagcagcugucuucugugucucagcucuccaagugccugcucauucucugaaccaguuucccagucccucacuaauugggaucagcauccugggucuuugggcauagcccuugcuauugcucaucucauuaggcucagaccuucccucguaaugggcaucuugauccuguauggguuguggaauauuuucuuuauugucugucuuuuccuguuaaacucuugccauugacugaugggaauaggccauaggccacgugguuuuccugugccuuguuucagucuugagacaaagcagaguggcauucagauuuuuuugcaguagccucugugaugucuccucuguucauuuucuccuccccuuccuuguaccugagauaaugcaucaguaaugaaagccuggauugcaacuguguccugauuggaucugggcuucucuggaacuagugaauggaaagucaaggagacccugugaaauguggcugguccccucuuagguuccucuaacagcuccccagcugcucauccagccagguuacucaaaccauggcacagauaacacaugcucuugcaacugccaagguuuuuuggcuuauuuuugcugggggugugacacaauuagagaauguauacucauuuuucuuucaaaggaaauguaaauuuuagaaccuucucaucuuuaggauuuuggaauguuagcuaguucaguucuugauagauuuaaacagaagaaaccuggcuuuuccuauggugguaaucauuggucagaaauucagcucuuuagugcuccaauugagagaguuagauguccugccuucauggugacaccauuuuuauacuugauuauuucaggcuguccagugaauacagagccaucuggcccaaccugugagaagaaaacauacucugugccugcccaccaggaacgcgccuaugaguacguggagugucccauuaggggcacugcggcugagaauaaggagaaccuagauccuucaaaucugguaauccacacucaucuuuucuuucuggagcuuuuuaugcaggguugcuuauacagacucccaagacaaguugcaaauggcuaggaugaauucuucuguccuuugaaaacagagaaguuagauauucuaucuacagugaaaaucuagaauguguuaguaaguguaguuucagggagugccugggaaaaaaaccagagugauuaugaggagccagcauaguuguacugggaauaagccauaccaaaugaauauuuucuucugggacaguuacuaggugguagaugggaaauucuguaagaaccauagcuagaguuaguuaagguaucuuuggucuggggaaacuuuguagacacauuacaugauuggggaacuucuucagguacaauagggugccagccugcccgagucacuagggugguucacugucgugugacugccagcaaauuuaaugccauugagaagugagggcaagguugaugugacaucacuacauuuugugauagacaacaucagaaauuguggucuaaaguuuggaaucguguuuuaacgggaggcucaggcauauacuucagagggccacaggauuaucaagaauagaaauuuuagugaaccagacagccuguaaagaaacuagaaauauuuagccuggaaaagaaagggcgugggggauacaauagcagcguccaccucaggaaucaacaaacuauggcccacugccuguuuuugaaaaugaaguuuuggacaaugcaccaagauuaucuugcacauaggccuucaaauauuuacaccagaggucauuggcaaacugcuucuauaaagggccagguaguaaauauguuugguucugugggccguagggucucugucacacuacccaguucugcugcugcugcuuucucuguagcaugaaagcagcgacaggcagcauuauccgaagccccuggcagaccacuggccuagaugaucucuaauaggugagugguucagaacaugggccuuuuggaaccuuacagaccuagacacuuaccccaugggaucaugauauguagugagaaugugaauaacagcuaacuuuucuuguggucacuuuuuaaaaauuuuuuauucaaggcuagccaacugaagcagugggagaggagaaggaacaaagaaaucuguaacugguugugaucaauuagucguaaacacuacuguacucagaccagccucuuuuggucacuuuucuagcguuuaagcuaagcacccuacauucuccccuuuaauccucauaacaacucugugcagccaguauucuuaguguccccauuucagagcuaaagauacugagagugaaggagucauucaucccacaucaccagcuaggaaauggcagagccaaaacugaauccuuauccaccucagacccauguucuuaaacacacuguggugauaaugcagguagaauacucugcagugccuacuacacauagcccuuccugcugucgguauucugagggccuuguugugauggagacuuuuaauuaauguuuacuaggaaauccuuuauacuucuaacacagaaaguucaaggccagucauucccaaccuugggugauuuugccccucaggcaaauauccugcugaacauccugcagugcuuagaccaccauaacuaaaaauuguccagcuccaaaugucaauagugccacggaugagagacccuggcuaaggcuaagugcuagcauaacaguauuggugacccacaugucugggagaagggauucuucccaccuucugaccucgcagcguugagaugcaaagacucaucuguaauauauuuugccuaagggaugaagcauaagcagaaaccuaaaaaaucugagaauauuuuuuuaaaaaagcauugcuguacaugugugcuaugagaguuuuccccagagaaugaauagucauuuuugaaaagcuugucguaaaguuuuuagaaaugccugaagaucguggcguuaguuucuacuucuuauuccuuggugacauuacuucuaaauuuguucaaaggagaaagaggccaaaaauuuaaccacaguguuuaccauauuugagaacuuaaucagugaagaaacacaaccucaguaaugugacucuucaaaacagucaaauuaugugagaagucugaaauuuugaugucacugauuuaauaaguaaucugugcuuuuugugugauguauugcuuuccaggaaguaguuaauuauauugccuuuuacuuuauauccuauaaaagcaaaucuguucauuuuauuuagaugccaccaccaaaucaaacaccagcuccagaucagccauuugcauugucuacugucagagaagagucauccauuccgagagcagauucagagaaaaaguggguuuacccuucugagcagauguucuggaaugcaauguuaaagaaagggugagugaacauauuauuuaagauaaaaauuucuugucagaauauccaagaguuauaugcuaaagagauuuuuuaccuucaaaacaauauaguacauuuuuauguauuaaucaguuuauaaucaccugauuuuucacaccugucagaauguaagugcgagaccaguguauuaaaucaggguucucaagagaaacagaaccaauaggauauguguaggggggcaggagacaaggaaggcaggaagauauuuauuguagggaauugacuuacacaauuauauaaagcuguggagucccaagaucuguagucagcaagcuggagaccgaggagagccgauggcacacuucuggucugaaagccagcggucucaagaugcaagaagaacugauguuucaguuuaaguccaaaggcaggaaaaguccaaugucccagcucaagcagucaugcagaaggccuucccucuuacucauggaagggucagccuuuuugucauucaggucugcagcugaucagaugugacccacccacacggaguggggagggcagucugcuucacuuagccuacugauuagaauguuacucacauucaaaaaacacccucacagacacacccagcauaauguuugaccaaaugucugggcauccuguggcauagucagguugacacauaaaauuaaccaucacagcuaguaauagguuuuuuaaaaaacugaaaacacuguuagauaaaauguuuagaaaaaguuaggggaucauugaucagugguacuaucugaacaauugucaccuuaaaaauagaugauucuguaagucugguuuacugugacucaguaaaaugagacuaaggugaaccuuuuauauuuguuuucaaugcuucuauaguagcuuuggauuuauagugcugcuccaugaucauggguaaaucuugaaaaugagccuuagaucuguuaaauucagagaaaaugagcauucuuaguucuuucucaaaggggaauguugaauaaaucaucuuaugaaaauauguggauuaacuuuauggcauuaucaggaacaguugucaaauuuuaccaaauauucuuuccuagguggaaguggaaggaugaggauaucagucagaaggauauguauaauaucauuagaauucacaaucagaauaacgagcaggcuuggaaggagauuuugaagugggaagcccuucaugcugcguaaguauguuugagaucuuaaauguuucaagcaucuuuguuauuucauaucagcuuucuagaguuuuaacauucaaaucauuuguucuaauaaaacauuuuauguagcaggcauggcucagugacaauuguugcaugacaggccacccuucuuaguugaaaaauagcaaccauuuuauuaggcuuguggauucagugggucuggguagccaaggacagggcaaggauggcuugucucugguccuugaugucuggggccucagcugcaaagacuuaguggucaggauggcuuccgagccgugggcuagagucuucugacggccugcugguuuacuccucuggcgaguggucauggccucugaauauggcuguuuucggcuucgucauaugguggcuagguuccaauagcuagaguuccaaaaagcaucucuaucuccauuuucugacccagccugggaagucccaaagugucagaagccugcccagauucaaggggaggggacagagacccugccucucagcagaaggagcauuacagcccuucgaaagcagagcaugugggaagggagaugcuaaaaugccaucugccccaagggaggugggaaagacauuuuuguucccucaauagcauuuauugaauccccauuaggacuaaacacaaagagaugucuuaacucagagcucuuuuucucaaggagaauagguaaaugcagcuguguguguuaaaggagacaggacuucagucuguugagaguagugguucucacacuggagcgugcaucaggaucauggggaagguuuguuaaaacccagcaugcugggucccacccgcaggaugucugacugagucuguuucggguggugccuagacuggguguaucuagaacacugcauaugcugcugguuugagccagauuaugucauaaacagugguuuuaaauucauugcacaaugcgauuaauuaauuucuuggcuaaaguccacuuaaugauuuuuuuaagguguuuuguuuguuuuuaauauuugcacucugaaguucauugguugcacucccuggcugucacaggcugggccucaggccuggggugggugcaugugagaggggaacaacugcaaccguguugcccucaguaaucucuggacugagaggagccacaaguguuugcagugaccuacuuugaaaguguguucuaauuaagaccaccugcuaauuacuugugugauuauggagcaaagcgaagagagaaaagggaauuucaguuugucaguuucaauuccuucuccaguuauuuucuggacggucaaaauuaaguagaccguuuaaaaacucaugcuaugaucuccagaagaaaguuuugccuagauugaguuuaccuuuuugccugugauccucuugagaagagauguuaaggagaggaguaguuccuaaaaggagaagaaaaguaacucauaaguccucaaauagaaguccuuuauacuuuggaaauuuuucucccucccacuuacuuagacaccuaucuuguuauccaugggagcagcuaacaauauagguggccugcugacuuggccaccacucccucugucucgguaacagcugucugucuagccuguaggugggcugugaacuccacgaggacagugcucagagggucuuguauagcaggucagugcccugcuauacccuggugccuacagagggcuggcaccuagagaguccucagcaggggucugcggguagagggagugcauuugccagcuaggacucugccacuccucaucuuauguguaguuauuaaggagcugguccaacauuaauuacaauccauuucuagggauuaauccaucauuuucuuuucuucauaaaggcuguucauugguuugaaaugaaagaagaguauaggauuuucuuguuugucugaaaaaccccagcugcucugugccaaaaagaagcaugaugcacaauacuugaggcuguuuuuuuuuuuaauuugccuuuccuccuccaccaaauggaaaggcccuguuuccugacuccucaaagugcaguguagauauccagaaggaaggggaggcaauggaaugcaccaguccagaaggaaagaggaacauuuuuaacaaauaggcacuuguuguuugaauuauuuuagaacuuaccuuucucuguaaauguuauauuaugugaaauguauacaggaaaaaaauggauauuacuaaaaaauuagaacaucaucuuugucaaagaaaagaaaauauuuuaacagacuuuucuuauuuggggaauucuagagaguguccuugugguccaucauugauccgguuuggagggaaagcaaaagaguauucaccaagggcacgaauucguuccuggauggggugagugucagcgcagaaguguuguuucaccauccucaggucagggucaacuuucucuucacaccaaaaccagucuaagaauugcagugccaucuugcaaaacuuaaugcauauucaacuguagaugucuuucucucccugagguuugcccauuaaugggcagauuuauuaggguguaguagauugcuuccuauauaucauaggguugaauggaguuauugucaauguucuuggaucugcccucuuacucuucccgugaucugugucuuuggguuuaugcacuuagccauccucccuuucuuuucuagcauacuugagauuuuuugcucacaccugcaucucugcaguaucucagcugaccucccuggcuuaggucucuuccccauuggccuuauuccuuuguagacagaugagcugucaucugauacggacuuaucacaguucuucagugccaucuucccuuagugcuguucacuguguaauucuucaagucugacuuccccaguuagguguuugggagcagguguuugcaugugcuucuugaguuuucucauggcuuaaaccgggacugaauguauugcaagcauuuuaacacucaguggcauguuuuuauuccagguaugaguugccuuuugauaggcacgauuggaucauaaaccguugcgggacagaaguuagauaugugauugauuauuaugaugguggugaagucaacaaggacuaccaguucaccauccuggacguccguccugccuuagauucacuuucggcaguaugggacagaaugaaagucgcuugguggcguuggaccucguaaagcacuguuucagauggaaaaauauaaacuauuuuuuucugagcgauacauuaaacuauuuuccccagauugaauugcacucaugauguaaugggaacuucaaguggguaaucacacuuuuuccuucacuuaacgaaggauacuaugcacuguucacuuuugacuuguguuguaccuugcaguuuauagcagaucauuuuguuuucuuccuacuuagcuuaagugggaagcagucucucaguuuuuccuuuaccugcaguauugucuguauauuucaucucgaaaagccugaacaaccucugaaaaagagcuuuuaaaaagugaugaaaguugcuuuuuuuucuuacuauuuucucaggaauacuccagagauguaaagccugagaguccauggugaugcucaagagcuuucaucuggccaaauauuuuaacuaaagcuguucauuauaaauaagaggugauuauaccuuuuuuaaaaaaaguuaccauuauuucuaaagccccuaugguaugauugugaccuuuaacaaaaugcaaagguauacacuggaaagguacucagcaaaauucucuccaaauucugauuuauaugaauuucuuggacuggauagaguacuuucaacuauaccuuccuuuggaacauaccuuuuaaaaaauguucccuuuaaauccuguuauucuaauauguaacucugcucccaacaaacaggucuccucauuguccuuggcauuugacaaguuaucccaacuucgaaucucauuucuuccuuugcuggcagccuccacccuuccccacaucagucggccuaauccaaaccuugaaagccuggcuuaagucccaguaucagugauggucccccucuaaaacaugauuuuauauuuggcugaguguuaaaauucacaagaugagcauuuuuuucccagauggagaacgcuucaacucagucuagauuuuuuuuguuuguuuuaaggaagcucuaaguuugccauugaaacuuuuuguaccaguaauccauaaacugguuguucuauuuauagcagcauguuacaaaugacugcuuuuuuuuuuuaacugucuauacuauuaaauccuuuaauuuauccugaaugcuguaguguuaaauuaguggaugaaauuggcagucugugggugauuaauuugguauggauuugucaguuuuguguggaguuuaagaaauagaacagccuuaaacucuacauuucaaaauacuuguauauuuuaaaauaaagcugauuaguucacagguuuugaa

SEQ ID NO: 192872 - RNA, 175325 nt, Homo sapiens
gauuggcgaagcuccuccgcggcccaagccagccaccuacaacgucucugagaacugauuugaaauaagagccaggcgguccucgcuucccugcgaccgacuuuucauaggcugggggagaaaagguugagaaacuugacauugucucgagcagagugcguguagcaacagaucaaagaaaaagaggacgaaaacgugcucuuugcugcccguagauuucgccggguugcuuuugucuugcgggcuccugucggguucgguguuuccgcucugaagacugcgacgcgggcuccgaugcagcucgcucccugccggaugggucaugggauucuaaacaugaggcagguaagcucaggcgguugcgcuggcggcggagggggcgggcgccgcccgggaccccugcgacguguuacugcggagagcuugcuggguuagcaggcgccuggccguagucgaugcguuuggcggaaagacggggcugcauuuuccuaagacaaccaaagaagcacauuuuaccugagccaccccggucugguccucgccacccgcccccacuuuugccucuaauugugguugaugucaggcagucguuguaaagggcuuacaagcaguuuguagaauauauguaaaucaauuccaguuugcggccgcuggaauguaucgugcaggauguaucucgagcuuuuagugccucuacccuaugcuuugggcuagaauaaagacagcugaauguccugaaaaagaauuucacggggccucuuaucucauuuugguuucgcauucugagcacuuacuguguuucuggcggagaaggcggaaccagcuugaaaugagcacagacaguccuuccagaaaaaugcaaauuuguuuuucuguucuagcaguuuggaaacuguauugcuucuggacgugagaaggcagcccugaaaguagugagcggagaaagggcugggggauuacuuaaaugagucuuugaaaagaauucuaaaccaacagcuucuucuguggcucuggggcaugaugauaaaauuccuuaucaguccaggaagagguuuauagcuuugcuguuaagcaagaaaaggaaagaaaaaguggauguaggaagccaaggagagggugugauuuacaacucaaucaaaguuauggaagaauuuuaugucaauauuuaaauaucaagaacaauacucauauaaggagaaaacaaggcuggaaaaacaugccaauaggcuuggaagggcagggauuucaagaggaaugcuauugcuuuuaccagcucugaauaaaucuggaugggaaaguuagcaucuguaucgcaaccggaaaagcucuucacuuuuucuucuaaguggguugggugcucgccacccugcacacuuugggggaagugagcuuuccauuuaagagcgcaggggagggguuucgaacuuucugucccuuucccacagccuugggagaugaagcagagcccccuucgaauggucagcgcaaacccuccgccuucuugcccccucgcuuguucgcucagcaagcaggcuuggcaaguuucagugagugcagaaaaacacuugcggaggagcaagugccgucugcuugcaaugaauugcccuugccuugguagggacuguggggaggacgucuuuaaguucugcaaacucacaguccaaccucauacuuuuaaugucuacuaaagugggaugaggaaaaggaaggagaaggguaauuggaaaggauugaaaaggaaaaagaggaacgcaaaacauuuuugacaaagguccuuagcuggaacaaagaaguuauuugauccugugcagagccaccuguccucuccucgguggugucugagcucaauuuccagaaucccuguucccacacaauuccucaggaaccauggcagucuccgugccuuaugccuaagguuugcuucccccagcuuggaaugguuuuucccaugccuaguuuguuguggcauuuacgugaaguuggaaaacagcccaguauugaaauuuuagggguacaaguacacauauagugaacuccuuaguuauuuaaugaaugggcaacuuuucaucucacagcuacguaugucuacuaauuuuuuuggccuguucagaacuuugaaagagggugggauggaacaggggaggagaugaaggagagagacaggaucauuguucauccaaagaacgaggacaguuuccagaaucuagcauguuguuccacugcagucagaacaagaauguagggaggaaugagauggcaguguuauuggcauggguuaaucccuacuuuauuugaguuucucuuggggaaaccugacuguugcauccaggcagggugagucgaauucaccagccaauuugucaucucagcccggcagcuccagcuggauuuacaggguuaacuaucaaacagaccugugugucaucagcucagcaaugaaauuggaucucuuugcugaugagugaucugucccuagggcugcacaaauguuguacacugguguggcagcccagaagagaccccugccugccacugauagccagaaauucuggguagccagaaauugcccgcagaauuagaaggcuguuugccuagcuauaagauucagagggguuugggcuucugccagguuggcagaaaaggaacauuccugaagccaccacuucagguguagaaggauaguauucuuugaggguuccuaaggccacggcugaguuaggccaaagaaaaguguaaaucugauucaccuugaucaggaaguaauuuuaaaauaugugccaaccugucucugcccucugaucauaaacgggaaacuuuuaugaaccuuccuugagaaggaauuugcucuguucccaggcaaaaggaaaagcauggccaccuguucuagaagccuggccgaaaacaacagguuugccuguggcauucccgcaacugcauauauccuccccacauggcaagccacccauugucccuacacacaagaagaacaaauaguucauucuugagcugggggaaaaaucagauucucuaggcaaaauugccuacuagacauauuuuguguuuuuaacauccugauaacuuuagaaaaaaaacucuaagggaagaaggugcaugauguauuucugaucuacuaaaacaaaguaagucacguagcugcuaaauucuugcaaggccaggaugcugcuguuucaaggaagccgugaaucuguuugguuagcccguucugcauucuuuagauuggaauuaaaaugcccaaggacaucuggcuuaauaaugaaagucuucguauuaaucuuuccucugaggauuagaaaguccuuuacaaacacgaucuauuuauucucugccacauccccaggagagaaugagguggcaauuugauccucauugaacaaauggugagacgaaggcagagaaagguuaaguauaaagagacacagcaaguuaggggcaagucuggggaugaauacucacccacccagaaagacuaccugugcagguuuaggaucucaaauggcauucuagggauuaaaacagaaucucucuuacgacauucuuuuucuuaucauucuguaacuggcaaguauauugugucccaaguauguuguaugguuuccuucauuugaaaguccagacucuuaacaguucaaaaggcaguucuguucucauuucucccaacauugagaucaggcagcuuuuaugaaaucuaauagaaagauacaguaacuaacuggaauuuuaaauaugcaucugagaaauguucccuuucaacagauguuuuaaguuuuugcacaugguuuauagagcucagugucuucaacauauguuaaaauuuuaauuucuucucugcuaucucucuuucagcaaauguuauaaucauaagacuugcugucaguuuaaagauccuuguuggucauuuugaaauaauuuuuuugagucauguuuuuaguucgcuuggcuguagaccgcauaggcuacaagcaaauccguuaauugguaguugcauguuauccacagacauuccagcaaguuuuaaggcuaagugcauauguggaugucuccuggcuuugaucguuugugugguaaauagacauccaagguagcuauggcaaccugggcugugcguuggugaaaggaggggauuuaguuacuggacaaagaguaauuuguuugauuagaaaaagguaggggcaaaucaggacauuuuuaacccacaugauuugaggaucccaguucaaucaaaucauuuggauuuuucucaauaggcaaaaagaaguaauggcuaagcgcaccagaguaucuugcagacguaauuuaauuauuuuuaaacaagugguugcuacuuuccaaaagcaauuuauacaaugaaaaggaaguacaauauaucauauaaauaucaucaauaucccuauuguacuaaguaugaacguuuuuauuuucagaacuugaugggacuuugaaagaccaggaucugauuagaggugugcauuucaguuaucuaccugcaggggucaggcuugaaguucccguggucggaagaucaggcagcggacuucacugcagggagcccgaggcagagucagagagaauugcucugcuuauuuggaacaauuaguuagcgauucuuuaaucuugugaccaaagcuacuaugaaaaugaguucauucaaggaagagaauaucaaauacgcugugauuaaagaaagggcgauaaagccaggucaaacagcaaucuaaucuccguuuacauguaaggcaguuuaucgggaagauucuggcucauuaucaauuccuuugauuucacacaaaagugagcucagcgguuuuguucuagaaauuuguuugcccaguuuuaugagcuggcauguuauaaaaauuucuuuaaacuaaaaaggacacaauauuagggagccaucuggauccgaaauauuuuucccccucuggaggaaaauauuccauugacacaagaucaggaugguuaauggccuccaggaggucaggugauaguaggagcacagaaaauugaggcgcagaacaaaaugccaagaggggacuuuccugaaaaaacaaaccagaccaaagaaaauaacuuaccugcuuugcgcuaugaaagagagguucugaguaaacauggaagaggugcugaucauuuguaguacaaguggauguugaaggucuuauauucaguccaguguuuaugaugaauauaauauaaaggcuguccuuccuuucuuauaucauucaaugacauuuacugagcacucacagaauuaauauauucugccacauuauacgugauuauuaaugugccagggcacuuucuggguuccaaauaugacuuugguaaggccccugcccucaaagaacuuuugaucugguguacaauuuauuguaccaguagcauaauguagguuuuuccauggucaaaauggaugcucauuaauaucuauauuuguauggguagggauccacuugaaaaacugaugguauccaaaaccuuacugaacuuaggagacuugagaagugauuuguaauugugaaauuuaguugauuuuuagcccacauguccauuuguagaaauuuaugacuucuuacauaaagcagauuucucauaauuauuaaauaguaauuuauuuuucucaauagagaaaaguaacucauagguaguccccaaucuaggaauacuuuauguuuuaggaguuuguuguuugaaacccagagcauuuuccagcgaaaaauaaucaaucugauuaaugugagaucaaguucuguguuuugaggacaugccacuguguuauacaggauggaaacagaaggagaaagaauuggcauacuuuugguaauaggccagucauggcaauauuugaaauaggaaguucguacuaguuuucaccuuucuuucuccauccuucugaugucuucuggucucacuggggcaucucccccaggccuguccuaauauauagugaauucauaauuguucaucuucccacccuucccuuccccaccuccaaaccacucuccuguuuccuuuagucaauggucucuaccacauggcaggaaagaaguaauaugggugagccaaagcucaugacucuuaucccuuuaacccuuaggaugaaucuuuaauuggggaaauuucaagcaguggagccuggagcuacaaaacacaugauuuuccuuucagggacaauauuugggggcagggccaugccuuuggcagacagaacuugcuggugugucugcccgugggucagaccucuucauuuguucuuucucagcaaccugccugaacuucuggacccacuagggucuuugugaguaacagccagggagccacaggcccccaguugagagggaauuauggcguuuguggguuuggguuguuuguaaguaugcucuuuguaugcugagcacugucuacuuggauuagaauaaauggaaagaaaauagcuguagcauccucuuauccacacgaguauuugaguugguguauauauuucuacucguuugucugcuuaucuuggaacugaguuacuccagagcaagagucacauauuaauuaccuuugaauccccagacccaagcccagugucuggcacacaauaagaaucauuaaguguucuacaggcacaugcugggugaauuuuaguaaaaaagagaauggaaaaugcuccuuaaaauccgaagggauaugaagaagaaagggcauuagaaagguccgggaaacagcaaggacuaaauagaucaguaguagagaaaauuagcauagguuaugauuacugaacuauauguauaugguuuuauauauauauaguccauuuauauacacauagucucucucugucugucugucugucugucugucucucucucucucucucucucucucucucucucucuauauauauauauauauauauauauauauauauauauuccuuucaguuguguucugggcaagaacacaacccaaaacaugguaagcagcuuggcuuauccucuguuugauuguucugcagaaaugauuacgaaaugggucaugcccuccaauagcucaaagccuaaucgccaagauagaaucugcugcuuucucucauugaacccagccugauaguuuaggccuuagguccaugugcaguuguuuaauuuugcaggugaguggcaugcccaagguuacuccagaacugagauagcgugucugagagaagacugaagccuucuccauguagaugguggccacauuuuucauagugaaguucaagauuugugccggacaaagcauuuucauugcugguagguguaacagaccagaaguuauaguuaaaaaugacaaaauagaaauuucagggacauuuaauaguuuauggaaacaacaggacuaauauauuaccaaagggucuaugcgguagacugugguaucuguccuaugucaaguuuuggaguguugcuuugguuguguguauuuagaaguggucuuccccaaacaauucggaggaagggggauguuacugggaaaauggaauucauugaaugcccugcugaguuaauaauaaguagaugaauggccaaauaaagcaauauauagauggacggcaccaccaaauauuauuaauagagauuuauuuacuuacauaggaucaagucuucuguacgaaauacauuaggaauccagacuaagaauacugguuaaaguuuagcauuucuggguugacguuuuagcacaagaaacacuuuacccuccaucugggagcaagguaugagggagacuuagguucuacaccuagaagcuaagucuucuagacuccccaucucauucucuuuugugacuguaccacaugccuucuacuaagauauaauuuggauguuuucaggucaugugcuauaauucaauaugcuaauaaauuccaaggcaauuugaauggaauguugguuuauaaugaggcaacucaggaaagacuacaucaucuuuaguggaaaauacuguccaaaaaauccaaauaguuaaaugaucuuauauuuggguuuugugcuucuuuuauguguauauucuuugcucugauuuuaguuaaguaugaaaaugucagacagcaaaaacuaggaggauuauauuuauauaaaagaaaguuuagggaaugagaugagucauuuagcccaugaauuaaucagcugugcuuugaggaaauagugcaggaagguaaaauggaacaaauagacgagagaagaaagcgugacuucuuuuagucaacauaugauggggaaagcgguagagaaaaauuggcuauuuggugagugauucacuugaguuccuuuucaguggucaauguuuaaagugaaauccuaaugagauuguugcugcccuuuuuguacggcucugacuaaaagagggaaaacagucauaauaauuaauugagagggguaugacuuucugaguagauaaaaacaugauagacuauuagauaaugaauauuuauugcuugaugcuucucagucuggaagagacacuuucugaauauuucuccgcuuucuaacauuucagcugucagaauugaaugguucacauauaaacuacauuguuuugguuuaacuaacaaagagugauaagacaugaauuguuugugacagccccgaacauugauaacagaagacauuaaugccugcagacacagccuacaugguaaaaaucuggaaacaaaaaugcuuauuauguuaggccaucgugcuuugaccuaguuuugcuuuucugcuuggaaauuaugucaauauuaguuacaucaucccuucggaugagcaauuccacauucuuguuuauuucagugucauauuauuaguuuuuguauauuuaguucugaccucugaggagccaaacuaauccucauugacuugcauuuuccuuuugaaaugagacuucugcaugauaaagagagaggauuuuauguauuaacaaaacaaucuaagaugccucuuuaaaggcauucauuucuccuugauccggagcuacugcccucuugaagguuccuagaggccauccaguuuucugcugaucagaauuagucuuuuuuucuuugucuuauggggauggaauagauuacugggccuagaacugccauaguugaauaacaaaaaguaaaacugugaggcugaugggacauuucccagcccaucauccuuaaauuugcccuuuucauguuucugcuuuacuucuucauccagcagaaacgggcuuagcauauuuuucccauuuaacauuuuuauugaauacuuuucaaaaugaauuauuuccgcaguugauuucgaacacauuuuuuucugucauuuaauacuuuauaucacuagaggaaagaaccauuuaauucuuucauacauuuaugaauucuaaucuucaaagagugugaguucuucaagugaucaacuuacaucaaauuuacaaguauaauuuacuaccaaaagaccuugaacgcuuuuuggugcacauguuuuggcauuccuuauuaacaaauguaaugaggcaaaagcccacaagaauauguauuccugguuccucuuuaaaaauguaccauuugcucuuauuuucuaauuaaggcuuugaagguuaaaaaucccuuuguuguuagcuccuuuacaagucuccugccugagugcagaaaacauaagaagggaguguccucuucagagcauaaccaaaccaacuaaauuuuaaccagguaaauuguugauuagcauuggaucauguaaagaaacaguaugaaaguaauugagauaggcacaacuccuaauugugugaucccagggggcuucaaacauuguuugaaacauucaccucagagauuauauuccaugucugauccuuaugcuaauuugaauacuaggauccugaagaaaaacuuuauaggauuucuugagucccuaauugguauguaaacaucgucauucccaagcugcccaaaguugugaauuauaguauaccaugugucuccuguugugauaucaauuucuacagcaauuuuucugcuuguuguaggcaaauguaaauauauuucccuccucuuacacaaauaguggccuuucacauacauuauucuucacccuggcuuuuuucugcuuuagaguauacccuagagaucuuuccauaacaguccacagagagcuuccucuuuaaaaacaaaacaaaacugcauaucauugcacuaugacgauguaccauaauugauuugacccuuccccuacuagucacguggaguguguccaauauuuugccauuaaagcaaugugcacugaaaaacguuguguucaucaguuuguauggggcggauguaucuguauuaaaaauccccagaagugggauugcugggccaaagggcaaaugcaguuucuaauuuugauaaauaaauaacauugucuaaccagccugugugagagcacugccccagagccucaucaauagagagcauuguccaacuugugcaccuuugccuaucugauaucugaaaagcggcaucucuguguagcuuugcauucucuucugagugacguugagugucucugcauguguugaaggucuauuugcauuucuugugcaaugucugcucauauccucuguuuagaaaaacaaaaagaaggccgggcgcgguggcucacgccuguaaucccagcacuuugggaagccgaggcgggcggaucacgaggucaggagaacgagaccauccuggcuaacacggugaaaccccgucucuacuaaaaauacaaaaaaauuagccgggcaugguggcgggcgccuguagucccagcuacucuagaggcugaggcaggagaauggcgugaacccgcgaggcggagcuugcagugagccgagaucgcgccacugcacuccagccugggccaaagugcgagacucagucucaaaaaaaaaaaaaaaaaaaagaaagaaagaaagaaagaaaaugccaggucuaguacaacgauguuugauggguuuuuuugacaaugauaaaacuacuauuuaguaagagaaucacucccggcaguagacuuagaagcacacuaucagagacccucgaguaaagacccuaacgugccacaucuuaacucugugaccuuggguugauuccuuaaacuucccaaguuuccucaccuguaaaauugaaaugauguggacaacucacaggguuuauagaauaaucacuaaaugaaggauuauauauauaaaugauauauaaagcacuuaacagaguauugguuacauacuaggcacuuaaaaauguuagguuaacuucucuuuuuuuagguacaaacuuaagguuucagagaaggcuggguuuuauggacauuucuaccucuuacccucugaaugaauacacauccacccacacagaggcauguaaauauacacauauguacacacgguggaauaauaucugaaauggcuguaaugauucaaaagcaucucuuuagacaaauguguguguguguguguguguguaugcacgugugcauguauauguauaaauaucccuguaauguaagaaaacuaauuuguugcuaaaaauguacccuuuucggacaaauuauccuaauaugcuaaaacaacaccaaauaguauuaaauggacaugaucacuuaucacuaccuuucauauuauaauccaaaaaagcauauuuuuccuucaucuaucuuauucuuuacaacaauuaaacucuuuuacaauguuacacaccuuauacuuacagcuauaccuagaaauaaaauuacacuuauacucauguuuauguauuucugucuuuaaaacaaaaaaauaaacacagcaguaaauacaaaagguagaaauggaaaaaaugcauuuuagagggcauggugcugagggcugagaauauaacacuggucuuuaaaacaacucuaccacugugaaugagaccauuugggugaucuuguuucccagggcuguguuguuacagaaacauaauuuuaaaaauuguauuuugaaauaauuacagauccauaggaaguugcaaaaaaauguacugggcagucugcacccuuuacccaccccuuaccccaucccuaacccccagaaaccaguaaucaucuguucuccaucucuauaauugugcuacuucaagaauauaaacguaaucauacaguaugcaauuguuugagauugacauuuuuucccgcucacuuaauuuucuagagguuuauccaaguuguugcauguaucagucguuuuuuccuuuuuauugcugaguaauguuccuugguguggauauaugacaguuuaaucaucaacuuguuuaaggacuuuggagcuauuacaaacaaaguugcuaugagcauuuguguguaggauuuuguaugacuguaaguuugcauuucucugggauaaaugcccaggagugcaauugcugggucauauggcaaguacacauucaguuuuguaagaaacugccaaagcguauugcagaguggcugaaucauuuuacauccccaccagaaauguaucagugacccagcuuucucugcauccuccccagcauuugguguugucccuguuuucauuuuagccauucugguagguguguaguggugucucauuuguauugguuuucaaaaagugcagaagauacuucauaauccaguuuggguguguucaauaccucccagguaaaauucucacacauaauaugggccuaucuugguacaugacugaauugucaaaaauaucuaugauugcugccuuuuuuguugaaccuuaacugaaauauugagagcaaaaaagaaacuguguugugcaaaauauauccgaacauuagacugggcuucaauuuauacucugagacacucagagaauuguuacuugcucaagacauggcagaugcacgccccaacaccuaacuucacuuuaggaauagacacauuagguaucaggaaaaauugcuaagacuauuuaaauuccucuccccuuuuccaacauauuccauugccuuugcauuugcauaaauuaaauaggggcaugaucugucuucauugucaauauacauguagauguguguaaaucuacaaacauacauauacacagacauacauacacuggcucugugggcgucaaucccaaauguuccccaacauccagucuagauucucccgggucaggauuucucaacuuuggcacuauugacauuugggguuucauaauuauuuguggggcuguccugugcacuguaggauguuuagcuguaucccuggccuuaagcaacuggaugccaguaacacucccaugcccccaaagugugacaaccaaaaaugucucagcacauugcaaaaugucuacugggggcaaaauaaaccucccuuugagaaucacugggguagacagaagagaaggagaaucucaggcuucagguuaccucacuggguuugcugaaacuugauaagaaucuccuuaccagcggggaucagguuuuggugcccaccuguucauuucugauaacuaccaaucucuaaaucuguuucugcaaguuauggcugaagauuagugguuaacagagaacgauaucagccuuuguuucuuaaagagcuuauauucaaugcuuuaaaauacaaauuggaucuggcacuguugugguucacaccuguaacuccagcacuuugggaggccaaggugggaggauugcuugagccagggaguuugagaccagccugggcaauauacugagaccccaucucuacaaaacaaauaaaaaauuagccaggccugguggugcaaaccuguagucccagcuacuugggaggcugagucgggaggaucgcuugagucugggaggucaguucugcagugagcuaagauggcaccacugcacucgccugggaccuugucucaaaaaacaaaacaaaacaaaauaaaauaaaacacaaauugaacacacauaauugaaaagcaaacuucaugcauaccugguuuuguuuuacuuuuaaugauguuuuaucacuuauauuagauaucaugauuauuuuaacagauacaaaauuuaauagguaauaaaauaccucauaaaauaggguauaucuccauaugcauagagaauuuuauagagaaauuggcacaauuccuggaucuuccucugauucaauguguuuaucuuugaauucuaauagguuuuaaaagacauuuaaagaauugcaaaacaggcaaaggaaaauaugauaguguuuuauaauuuaaauuaugucuacauggcaacaauaauuauuauauaaauuauagaaaauguuauguauuuuuuaacuuuauaaauuuaccccuacuugauaaauaauauauuuuguauuuauuacauuugguauauaaauauauuucuacuuuagaauuaaaauaaggugaaaauaguuauuuuuugaaauacuguuaaguugcauauucuuaccuguauuagaauuaaaauauguaucuuauauuuauauauaaauuacaaauuaccugaaaaaagaauaaauuauaaccgcauguaaaaauaaaauauuccuguaucaguugugcaauuuaaauuccgguuuuaguuuucauucuuuaaguuguuacauuuggaagauuuggauaguaguuaucaugaacucacuguuaucuauggcucugacaguaaaauacgccauugaguuguacuguaauaugaaucucccgggaacgcuaagccaauucagaaugaggcauuccugucucaggaauagagauuuauaaagugaccggagguaucacuauuucuagaggaaggugcaccuugaaguauucucauucuuuucuaugcauuuaugaucccagccuacuaaacucaagcaacacuucaauacagcaaagccucuuggaaguauaugaguuuaauaagaaaauuuaugaagaaagaauacacugaaaugcagacugacccccaaaauaauaggauacuuuuuaaaaaauguauuaguuucauagcauggcaaauaauacucaaaaauacuuugaaaaugcacauuuuaaaaaugcccaaaggguuuaguagauuauguugagagaaggcauuggaggaagaaacauuauagccauaagaaccaggaaaaugauccuccuuuguuuauaggauuacaaagaggaauuuuaacuucuaaagugaaaauacaaauuacuuguguaggcuaaaaucacccuucuuagaggaaaugguacaaauuuucuucauauaguuuauguuccuccagaaagucucugugaagugauaacauuauaacugcaugcauucuccuggugacuucauuuaaagucugugauguaguaacaucaugcacacuucccuuuccuacagagcccuuauguucucuauagaccaagagguuaauuaauuuuuagaguuauauagcaaagaguugccagaaccccaaauaacauaucucuaauuuccaaaauugccugacaaacuauauuuuaaagaagccauguuauucuuaggauaaaccuaauaaugucacuuuaauccccagucaugcucaucuuugccuuucuuccaauaugugcaaggaauauauaaggugaccuuuuaagguuacaguaucuucuuacaaauuagaguugaugcacugagguuauaacagcagcugagcauucucaaaagcugcagauugagccgacaggcagauuagcaaguacauaaaauguuaguagagaaaaaaaauagacuucaauuuuuuggcaauccuguuaaacaacucugugaauaagucuuugaaacuuguacaguggaagguuugaauuuuccucaaugccuggcacaaaacuuaccuaucuguugcauaugugcauugcugaauuaauuaauggaaaguaaaauuuuaaaauguaaccuugguuauuugggauaaaauggcacuuccauguaauggaaugucauaacugaaauuguagggauuuucagauacucuagcuggcacuaaaucucaucagagcccuucaaguuauaacauaagauagcauauucaauaugagaaaauauuuaauugucagccuuaaaaauguauauagcagaggcaaucccuuuuuuuucugacaacaaagccuucuaaaagcuuuucaaacuauacagcuuugagauuuauaacuuugaaccaagaaaacauaauuucaagaaaugaagagaacuucugauuaauucuagucuaaggcagugaaguccugcuagauuuuaaaguauuauauucuucauaauuaaugucaagauagguuccucccuguggcucauuauuuucuuguaaaaaguacauacugccuguguuuuuaaauuucagguuuucucaugccgcucuugucuaaugauccagcaaguucaggcauauaauacuuuugaagaaucuauauuuaaagacuaauuauuuaugcaugugugucuauguauuuugaaauauauauauuucaaaagacuguuuuuagccuuuggcucaaauauuuuuuuuuuaaggaauauaauauugaauaucuggacagguuaaaaaucuccaacauuuaacuauaaauguuaacuaaugcuuuccuuuucauuuguuaaauugcugcauaaaugcuuuaaaaaguauguuaccguuggcauuaagacaucaucucuuuuacuuaccaaagugcaccaaucuuugggauugaaccauuguagcugcuuuaagccaaaaauucuccccagccggguuccuuaucaucacccuugccacagaaucuauaucguugggaguuaaagaucuuuggucucaaaccuuauccugguugaauuccugucauaucaccagcaaccccuuucuaauggcccccaggaaugcuagcacaacaggggaucuucaggaggcucauuccaaugagagacaucauuugcagugacaaaguuuguccuuagaugaaaucuguaucucucucucccuauagcuuuuaccccuguuuggcccccucucuacaacacagaacacgugcaguuacucuguucucugacagcucuucaaagacaaagcuaacauggccuucugggggcauuuuuuccagguuaaauaugcccagaugugcuugauuuggacucuauccuuuaggaucaagccauguuaguaaguacaaauguccaacauuuaaaagaacuguucauaagagagacucaccagauuagaggaaagagauaccauucaguuucuaauacacagugaccuuaaugccacuauuuuaagcucucucugccuggauuguagagacuuugccuaguuuaccucuggaauagaaauucugaaccuuugcuagugagugagcaauaacaaugaugacagacaucuagcuagauacuaagaaaaaaagucaugaaugaccaaagugugaauuuuguuucuuugcuugucugauaccccauggcuauuugcaauaucuuauugucaugugcuaaaggauuuaggauauuaaucaaagagaaaagcgguucuaagauggaagaaaagacaaaaaugugggcagauaaguaggaaaagaaggggaugaggauucaggagcuuuuuccagguacuuggaaaguugaaggcaacuuaaaucauuuuuaauaauuuaagaaauaucauuuuucauuuuuauauaaaauacuaaaagucuggaaaauauauaggcaggcacaguguguuggcaauaugcuguuuacagguuggcaaaacaagccagugucuaaugaaaaggaagguugcgaagagcuuagaucugaaacugagaggcaugucuuguuccacaccuugagaaacacuuggcauauaccaggugcucuguaaauauuugcuuaguaaaugauagaaugagcaugugguggcagaaugaugccuuacauggcauuacccagacucauaggcaucccuagggacuguaagaaaaguuugugggcuuuuuucagcguuuugaaaaacccagaagauauuguauaauuacuuuuucaaugauuguuuuaucaaauacuucuaaaccugaggauuuaugaaguuaaaagugaaaagguuuuuuaaaaaauguuaugccaaaugagagaagccagucacaaagggccacauauuguaugaucuuuuuauauuaaauguccagaagaggcaaauucauagauccagaaaguagauucgugguugccgggggauaggggaggggagaaugcggagugagugcuaauggguaugggguuucuuuugggagugaugaaaaugcucuggaauuaaguaguggugaugguugcaaaacucugaauauacuaaaacccacugaauuauacacuugaaauggauguuuguaaugugugaauuguaucucaauaaagcuguuuuuaagaaugauaagcauagcauccaagcauuuaaaaauuuuuuuaaaaguggucauuggugguaaaaaaaaaaaaaaaaaagucagaaacuauuugcuuaauuguuacagagauuuuaucccagauuaaaauacuccaauuccgcacuuugggaggcugaggcggguggaucacgagguuaggagaucgagaccauccuggcuaacauggugaaaccccgucuguacuaaaaauacaaaaaauuagccgggcaugguggcgggcacuuguagucccagcuacucgggaggcugaggcaggagaaugggcgugaacccgggaggcggagcuugcagugagucgagauugcgccacuguacuccagccugggcgacagagcgagacucugucucaaaaaaaaaaaaacaaaaacaaaaacaaaaacaaaaacuccaauuccauuucgccaaagggaacaagcagaauauucccacaacccuagggaacagggguaggcuuggcuauuagucauucuccuucuuccccauucccaauaauuggaaaaaaaaaugugugugcacacguacguguguguguauguauaugucugugugcauaugugacaagggcaguagucagagcaggaucaugugacuaccaggaucuauggacagccccacacuauuaggggagaaagugucaagcuauuuguacgguucuuauagagcaugaaucuaggccaggggucagcacccuuguucauaaaggaccagacaguaaauauuuuggguuuuguggccaugcagucucuguccaaaccccucagcucgacauagacuauauaaagcaauuggagguaacuguguuccaaaaaaacuuuauuuauagacacugaaauuugaauuucacauaauuuucacaagucacaaaauaauauuuaaacaauuuuuuuuucaaccacuuaaaaauguaagaaccauucuuagcuugugggccacacaaaaacaggcagaggccuggauuugguacauaggcggccuguggucuauaguuugcagaacccugcucuaggguaaugacugagaaagggacucuacuaaucagcagguuguugggaagcacguuacuuaccuuaagccaguauaaaacuuaaagcaauaaugcuacauuaugucuaaaggcuaagcuagugagaggcuaaauuauaacacucaacuuuuuuagcaaauaauuaugaagcaucagcuaauaagaccuuuucuuaagaguauucagaguauaauaaugcuaccuugugugguuuggggauuuuuauuuuaaguuagggaagcuaugaaucucuugaacuuuguccauuaagaagucugccaaagcugugaauuuuaaagccaugggaauuuuucauugcgcuuggcugcugaauuuuaacagcaaaguuauucauuaaguccacauuuaaaaaaaaaaguaucaacaaugcuucuuuauacuuuaucugcauuugacacacuuccagauagaugaucuuuaauuugacuaaugagugcauccuuuguuauuuuaaugacaaguaauuuacagaaagagaaaagcuuuucaacacgcaagucucuuaaaucuggaauuuaaagucccugauguucagaagcaggaagcaacaguugguguaagacagggccacuaggacacuggaaaugcauccuggguaaugagugggaaauacaaaaggaagaaaacaguuggaaauauguuggccauuuuauaugacacuuucuggguuuauuuucagguuggagcacaagucagaagcugaagaacuuggagauuuuggggagcauaugucccaccuuccccaacccccaaguauccaaauauccccuuugguucuaucagagaaguauuaagauuuauuaauuagaagaaaaauuaaaguuauaaauguucaauaggaacauaaggagaauucaaaaaaauaaaauguugagcucaccacaguuuucagcagaaauuuuacucuuuuuuuuuucuuuguugagauggggucucacuauguugcucaggcuggccucgaacuccugggcucaagcgaucuucccaccucagccacccaaaaugcugagacuacaagcaugccacugugcccagcuaaauuuuacucuuuaacugauuuuucaaugcauaaauaaaugaauaaguggguaaguacuuacugaggacacaguuuucaaccaaacccuguagauacucaggaugaauuaagcaugggcccugccuucauggggccuaggguuuacucaacuuuacagaaaacccagaaauauccuaacaaauguggcaacugaagaacuuuauuccuaauccuaaaacucacuuucuuuauucucagagcaauggauacagcauucuaaugucaaaucauuguuuccauguuacacaauacucuaacugucaaggcuaaacccugucuuaaggaagggugacaauggcuuuguucuuaugauaauagaagagauaaaaagauuauuuacaaagcuacagccucugaaaaauuggaaguauuuuauacaaacaaccaccucaauucuucucacagugauauuuaaguguuugugcgugcugguuucuguuaugugggucuuuaccauuuucauuccuccuugcagcucuaugaguuaaguauuacuauuauucuuuuacaaaugaggagcaugaggccuggaaaaauuuaaaaacaugcagaggugauaaaauacugggaaaguuucacauucaaccaugucugaugcuuaauccuuuuccuucucuuuccaccauagcauaugaucauggcauaucaucacuguuucuguuuccccuauagaaaauucaggaaaauuaacacauggaagaguauucagacuuucacuuuucuucuuacauaaucuuugagcagcccauuauaggaaaauaagggcauuggagauuugaagaggcagaaugaacacguucuagauguagaaagaaaaguucuaagcagguaaaagacaaccagagugaaauacaccagauggaugcuugacuuggagaagaugcuaagcacuaaauaagccaggugguagagggugugaaagcggagagcccugagaaauugaucauuaagcggaaggugauuaaaaucuuccuaagggacaguuggucagagcagaggucaagagcuaggacuugucuggcaagacuuauuguggauucuugaaggguuaagaagucagucagagacccgggauuggauacuguauuugaacugauugucacucaccagaaucugugaucuaggagacagacauugccaggaucccccccgucaggauggucauagagaagggaagguguguucauuuacuauugcugcauagcaaauuagcacaaauguacagauuaaaccaacaccccauuuauuagcucguggcucuguagguugcaagucuggguggcccagcuguguucucugcucagggucucacaagacugaaaucgagcuguuggccagacgaagcucuuaucuggaggcccuagggaagaauuugcugccaagcucgcucugguuguuggcagaauuuacucucuggcagcuguaagacugaacuccuugauagcuauaagcugugguccacucuuucuaagggacaucugcauuccuucuuaaguggccaucuccaaccucaaagcaacagcacauugaguccuucacacacauagaaucucucuaaauuccucuuucaucagucaggaaacguucucagcaguuaaggguucaugugauuaggucaggcccaccugcaucaucucccuuucuaacaucaacugugcucuguaacacaacacaauccaaggagugaugucacauucacaaguuccagggcuucagguggacaucuuugggcugccauuuuagaaagucugccuaccacagaaggugaugaagaaucucagcuccugccuugcuccuuggugagcugugugaccuguaauaacagcagcuuuguggaaaauuggcccacccuuuccuaggguuaaagggccaaagcgaaguuuugugacuuuuucuuccucuucugacacuggcuucuuccucuaaggaaaucugcugcuuuugguguucucuucuuuccuucaccaucuccugguguuggugccaagaagcacuggaaggcaggugguccaucaauuuagggcaacugaagguuuugagaucaaggcauacuggaggcccagacaucacaagagggcagcacagagcaagagcugauaaauguugagaugcagacuuagcaggcccuagcucuuucugagaugauguguucaucugcccucaaaacauccucucacucaacaugugccuccuaacccagaccccaaggagucuuuaguaagaacauggcagauaucacaugugcugaccaugggguuaucacaaaacauuaacucuccaaaaaucugcugcuuggaaccuugguuucugcaacuaagaaaugaguuaaaaauguauucaagguugauaaauuuaaaauggaaaaaaucaucuucugaacucuagcaauaugaaggccacuuuuuacaagucugaugcuguagugcaguguuuacaaccuauuuucauuuucaacccccugucacaaggagccuguugaaacauuuuuugcuaauugcuccuugcaugaaauuuuaauaccacaaauauaguauaaaucuauuuauguauaucugugcuuugugcauaaaaagaguaagguuuuuuguuuguuuguuuguuuguuugccacugagaacuaguuuucucgcucuugggggcaauauugccccuauugacagugcauguuauaauggggaaaaauugcuaacauuuuaauauuuaguaaaucuucagcuuauauagucuauuugauuuggaagguggcuguaauacuuuaguuguacuaaaagguacuugaaauuaaucuugaaaagucagaagaaucuuuacacaugaaaaaucacccaauauauuauauuuaaaauaacaacuugcaaaacaaaacguaaagucugaucccauuuuuguggcuaagagguacagaaaaugacuagaaagaucaaccuguggaauguugcuucuuugcgguuagauccuucuauagguguuuugcucuuugggaauguuauaaauauucaccaauauacauuauacauauguauaauaaauacauauuauauucaugucaagaagaauacuauuuaaaaaguuagccauucucucucucucucuuuuuuuuugccuucaacauuuaggauuaaugggcaguauaaauucaaucauucacauguagcaaaaggagaaauauuucacauggcccauucaugacuccuuuagaucucuagagggcuucaagccucaaaguuuauuguugcauucuucuuaauucugguugaaugcauguacauuauuuucugcaaagaaauaccacccacuaaagacuguuccuucucuucuaacaggguuuugguguccccagggcucccuuaguccuauuuacuuuggauauuucaggaguuacuguagguuuaacuguggugaguccuuaagcccucuuuuuaaauucauaaacugucucuaaucuuagcaaaaugucagguuacacuuuugagagguuugggaacuugacauuuuguagcccaguugggguguaggcugcuucuauucugagcaccuuguuccaauuuaugucaggaggaauuauauacaggucagggcugggagcagguuauaauuaaugggguggacaaguggauuuuuaauguuucauaaaauaaaauggaaaucacauguucuuggaacuguuguauguuuuaaaauauuuacauuuauucuaguaaacauuaauuauaacugauauauuucuccuaugaacucgcuaacugugaggucacaagccauuguucacugaguagaaagaaugggugacaagcuaguuacaagaaaaaagacaguacuugggcggguaucggugagugaacucguggaaguaauccagucuuaggucuuucuccuaauuuucucuuauguuuaaagcacccccuugccaauaugauccagaugucaguccuucuaagacagaacugggaggguuuagccugugaaauuucugaauagcuccuggugaagaaggaacacaugaccaauguuuaacuauuugucuuuucaaaauuaaaguuuagaaguaguugaaauacugccagaaucuacagcguccacguuuuauucauauuaguuuaucaaaaauuuccaauuccuugaagcuguagcagcaauauguugcugaggaaagaaauuuuuuuuaaaaaaaauuuguacuuauaauugacaccuaauaauuguacauauuuaugggguacaaugugauguuucaguacauggauacacaguauaauuaucagauugggguaauuaccacauccaucauuuuaagcauuuauuauuucuuuguggugacaacagucaaaauauucucuucuagcugucuugaauauauauuacauuguuauuugcuguagucacccuacugugugauagcacaucaaaacuuacucuucuugucuaacuuuguguaccuauugaccaaucucuacccguuccucccuucccccauacccucagcagccucugggaaccacuguucuacucucuacugcuaugaaauugacuucuuuagauuccacauaugagugagaucaugugguauuuaucuuuuuuaauguuuuuaaauuuuauuuuauuuuauuuauaauuugaauuuuuauuuuagauucaagggguaaaugugcagguuuguuccauguaguaauugucuucugugccugacuuauuccaccuaacauaauguccuccaggcucauccauguugccaaaaaugacaggauuucauccuuuuuauggcugaauaguauuccauuguccuaaucauccccauaaagaaauauauuuucuuuauccuuuugucuguagaugggcacuuaggcugauuccauaucuugacuauugugaagagugcugcaauaaacaugaauaugcgggugugucuucgacauaguaauuucacuuccagaaagagaucuuuaagagucagaaaaacccagauucuaaacuggucucugccaugugccaguuguguggcccuggagaagaugcuuuaacucugugucucaguuuccucaucugcagaagggggaaaaugauacccacuauuuagggauuggguagggauuagacccaauuuguauaaagugccuggcauauuguagguauuuuuuuaaaugccaguuauggauauaugaaggaaagcuccaaaaaaugaaauucaaaggaagccuuauguaaauugcaucacaugucaaccauuuggguguuaggaauauugaugcauucuuuauuuugccuagaauucaucacucccuaaauaaauauuauuuccauuaagucaccaaauuuuauauauauucuuugucuuguauggugaagaauuaauacaagugcgcuacucuauuaggguauaacaguuaccuaaguaauguaucaugagaccuuuuugcccuuuucuaaggaaaauaaguauuuauuggaaggacaacuucacacacagucagcagguaauaauccgcaguacuucccaaugcugcuucuaugggcuggaagaguguuuggugguucuauauggcacagggcuacuuguccauacccuugacccaaggaugucacgugcacccaaucaaccuggaaaucacuguggugacagaaguuggggcccaaucacccucagggccuugacacugauuuugaguauaccaguuuggaaagucucugcagaauuccccaagacauuaaguuuauaauaucccuugagggguccuuagaaagaaaaagugccuauguuuuggugucauuaucguucuucagggcaaggcuuggugaaaagauacugagagaagacaguacagauagaaggacaaagcgaacaaaaauaaggacccacugauuuuaucuuugcaagcucuaaacugaguuacagauugagaucuaaaauauauacucaauacaugcauccucaaaauguucuucacacauuugugcccaagacauaguaguugauaauauuaauacauaaauauauauacacacagauauauaugccuuacaauacaguccuauuuuuaguguguaacaacuguacuauuuucaaaauagucaucggcacaaacaccaguaccacggcuaaaucugacauuauugaucuuuucucccucuaagaauaucuuuuguaggcccauaagugagagauggcagaucuccugagcuucauucaguccuuuauggaaauauuuaugaaaacccuacugugugcucaguagcuaucagaguucuuggcauauaaaagauuucaaaauaaauuugccuaguauugcuuugggggaugaggacuuggugauaucuuccucuccccaaaagaaaaaguggugugugugugugugugugugugugugugugugugugugugucagagggacagagacagagguagagagacagagugugagaguguguggguauucagagagagaacaugagucccagucuuauccuuaucuucccucauacaaugcaagcuauuuggaauuguagagcuggaagugaucuuagcuaacauuuucccaaucuccuacccaauacaggagcgucuucuacaauaaccuucaucaaaggguggaacgcuaaaauguaagacuagaggucucuuuuuguugggcaauaauuugauucaauuauggugucauuauuugguaacucagguggcacaguauaaauuucugugggaaauuggaauggggagcccaagcuggacuggacaugacugcaccauggaaggaggacauuugggaccagucuugagcugccauuguguuccacugggaaacuaaacacuagugcuuucucaauuaguuuauauauuucucaaaguauuccauagucuuuaguuugugcuaacaaaauugaucggaaguacuauauuaaaauuaucauucauuuuuuacucuuacugaacagcagugagaaaagcaggaaucuuugucauuuuguuuagcauguaaaugcacaaaaaccucagcuuaccugaacuuugcuaaaaugucaaaccuuuauuaaccacaaguuuucuacauuauacuuuuccuaaagauuugugaaauacaaggaagaaggugauauuaugaauuacuguaaaaauccauggucauggauacaauuauacauucaagucaaucuccuacgucaucucuauuuaugaucaaaugaaaaaaggucuuuuuaaugaugaucucaaggaaaaauaagauuugaaauuaccucaaacuuuucaauuagauccaauaugugauuuguaguuaugcaaguaaaguggacucaagcauuguagaaauguuucaauuaggauuuuuuuuaaguuaauugagauuugaucauauuuuuauugucaucuuuguucccacauggaaauuaauuccauuucagacuuauuucuuggaggguguuuagcauaguuaucaccuuaaaugaguaggguagggugcguaggguggcuuuucauuuuuggaauuuaauuauuacucucucuauauauauacauguauauauauaugaaaaagaaagagcuugccuuggcagaaguguuuaaagaaacaugaguaguuaaugcccucacugugauuugacuuccaucuuccuuuuuuuaagcacauuuuucauuuuuucccccuuuaaaccugccauuuagagcugaaaaguauuuuucaagaaauggagcaaugcuuucuaucccauuuauuaaaguaaugcacagaaggaaaugcaccgugguaaaaacaauuuauacgagaaaugauaauguuuugcuaaagauaaccaggaagugaggaggagaaaaaaaccccucaaauagcagagagaggccagauggucuuuuuuuuuuuuuuuuuuuuuuuuuuuuuaacgcagucccuaagcaggaaauuuuguuugauuaagaagacacuggucuugauuuucauucagcaguuuugaggaacuuuuuuuaauggacacacacacauauacacacacacacacacacacacaccacaagccauuuucauucagccaaauuaucauuugugcuauuguaagcaagauucugcugaugaaaaugugaagucuuaaugauaaagaagaaaacgaguucccaagucucaguuaugaaagaacuuggaauuuacccacuacccuaaagacgcucgaucauuaccauauccaucauauuguuguaaggucugguguuuuguuuuguuuucuuuugauagccuggaauggaagaaagacuguguaccacaguggcuaacuaggguuuugugagauacaggguagacccgggggaaaaaauagagguuuuggaguucaacaccccagggggcuaaugugcauaaagcgacugcuccaaaggaccugaguuuaauccuuggagcugccagucaggaucaggaugaagaagcacccaugcaaagaauugcuucuggaugcugauaggcagggaggugaagggggggaggugggaagggggaacggagcaccccucuuuggacugugauguuuuggcagucggugcuuggaggaggguagcuggcaguggcuccggcacaauaaagcucccuucggugaagucaccagcauccuugccauggucuggcacccuuugcccagcaccccuggagugugcaauuucccagucuguauucuaaggaugaaaaugacuaaaguugugaaacuaacuauuugcaucuguuucaaagagaaagagucacuuggaauuuggaauggaaagaauagauuuagacaacuggcagaauuguucggaacuaugcccugaaucaagagacccuguugacuuauauaaggacaagcuaaaggagcuacguaaaagagagaaccaacauaucuuuaccaugaagaugacaaaucaggcauucaaauuuguuuuuucaaaaaugaaauguguucucauauaguugugugauacuuucucuaaucaguauucauauuuauagucaaaauaaguauaacuucacuuuaauauagcuuagccaccuugaaagcucacuguucuuaaagcuagauuuuuuuguaagugaauuuuuaagcccuagauugcaucuuaaguacugaguuauuuuaauuuugccuuuuuuuuuaauguuuaaaagccagcuucuugucuaauuugauucaauggauaaaauguacaggaugaaacucacacuuaaaaugcauuucaaugagaauuaaauuguuuaaaaugaaacuuuuuuccuuuaaauuuuaaauaaacaaauaagaugcaaagcaaaauaacaacaaaaaacucuuaagucaacucccuuggggauaagggauaaccuuagggauaaggucauaccuuuugauauuaacuccaaacucaugccuuguauucguguuuuacaaauuacauuuauaauuuaucucaaagauaacaaggaagcauacuuugauaauacaagaagaaucucucagacuuuagccugccuugagaauauguuuuaaaagccauuagaagcuuccuagcguuuaugggauuuguucuuauauagaguacauuuuuuuuuacauauauuuugggcagaauucucaagucuccaaauaaacaguuuaaaucuuggcuuuuaggccaaaaagucuuugggcugggaauaacucacccucagaagacuacuugcuuuauaaccccuccccuggaaugcugcgacccugucuucccacaaaccuuauuugcuucacuguggaagaguggcacagggcacccaccacccagacuucccaagcucuucucuuggucucugcuauagcuacaauagcaacuuuauucuccuacaacugagagaagagagacagacccucucauauuguuguauauuguuuuauacucagaaaaggaaagagaagcaaaacuaaaggcagguagcccggcgccuaagaaccagacgcgaaaccaaggaaccagaccugaaaccaggccugggccugccugaccuaagccugguaguuaaaauuccaccccugaccuagcaacugauguuaucuauagauuauagaaagacauuguaaaacuucccggucuguucuguuucacucuaaccaccagugcaugcagccccugucacguacccccugcuugcucaaucgaucacaacccucuuacguggaccccccuuagaguugugagcccuuaaaagggacaggaauugcucacucggggagcucggcucuugagacaggagucuugcugaugccucuggccaaauaaaccccuuucuucuuuaucucggugucugaggaguuuugucugcggcuugucuugcuacauuucuugguucccugaccaggaagcgaggugauuaacagacgguugaggcagcuccuuagguggcuuuagccugcccuguggaacaucccugcgggggacuccaaccagccggagcgacgcggauccugagagcgcucccggguaggcauuugcccaggugggacgccucgccagagccguguguggcaggcccccguggaggaucaacgcaguggcugaacacugggaaggaacuggcacuuggaguccagacaucuaaaacuugguaagacuagucuuuggaacuugcccacuccauuuguguggaagcguggucugaucacccacggcaugccuuuaucggcacuuugguuuugguuuugacuugguuugaauugcuugacggaacuggucuugggaacuugcccgcuccauuugaguggaagcguggccugaucacccacagcgugccuuuaucagcacuuugguguugguuuugguuuugacuugguuugaauugcuucacaggacuggucuugggaacuugccuacuccauuugaguaggaacuugccuacuccauuugaguggaagcauggccugaucacccacgguguggcaguaccggcacuuugguuuuuguuuuugacuugacuuggauugcuugauacuuggauugccuggauugcuuaguuuugguuuugaccuggcuuagauuucuggauacucuaauuuugguuuugauucugguuugguguaaacugcaaaagugugugugugcccuuuuuaccuguucuuuguuuuguggugugcguguggugugagcaugguguuuugucucaaagaagcaugggucaggcacaaauaagcccacccuacuaggaacuauguugaaaaauuucaagaaaggauuuaaggaagacuauggaguacuaugacaccaggagaacuuaaaacuuugugugaaauagacuggccagcauuagagguggcuuggccaucagaaggaagccuagacaagucccuuguuucaaagguauggcacaagguagccuguaagccaaggcacccagaccaguuuccguacagagacaguuacagcugguuuuagauccccuuccccccacaguaguuaagagaacagcagcauaagcggcuggcagaggcaaggaaagaccagcagacagaaagagagaggcagaaagagaggaagaaacagaggcaaaaggaaagucagagagagacagagagacagaaagucaaagagagaaagaaaaagagaaagagagaaauauacaaguaguuaaaaaaaaaaacaacaguauacccuauuccuuuaaaagccaagguaaauuaaaaaccuguaauuaauaauuaaagguauucucaguaacccuguaacacucuaauacuacuuuguugucaguguaaacaagggcauaucccaagagcacugaggccuuccuaucaaaaauccuuaacccaguaacccgcgaauggcccagaugcauucaaucuguagcggcagcugcuuugcuaacgggaaaaaaaaaauuaugcaaaaaauguuguauaauuuaaaaguacucaguacuauugaagaaacaguuuauguucaagguguauaagaaaaguaaaauauaccuuugguaaaaggauuauaaggaggcauaagaauguggauuuuuaccuacauuaaaagguuaaaaaaauuauuguuuugaaaguuuaagcgaguuuugagacguuaauuguaaagaaaauucuguguguaaacauauuagcuaaaguuaaaaagguaucauccaguuuuucugugaacuggacauuaaaauaaaaaugcaacagguuuuucuuaaagcaccaaccugcucuuuaacaaaaauuaugaaagguuaaaaagaguauauaaaaucuugcuuauggucaaacauuaaaaauuagauaaauaugucuacaagguuuuauuaaaauuaaguuuaacaucaauaacacuaauauaaagguaaaauuuggcuuaucuaguauaaaaaucauacagaaagcauuguuaaauguaaaaugguauuuggcuuucuuuggucuaaaaacuaauaaaaauaggugcuaaaggaaacauucauuuuacuagaagaucauaaaaguuaaaaacuuaaaacaaacuuuggcaauuaagacagcauaccaagaugcaaaugccugguuggaauggaucaaauauuccaugugcacguuaaacaaaagcaauuguuaugcuugugcacauggcaggccagaggcccugauugucccccuuccacuaaggugguccuccagucgacaaggcauggacugugugguaguucuuuuccaggauucuacagccuggaguaauaagucaugccaagcucucucugcuauaucccaaaguccggcacccugcgggucagcccccgagggcuguccagccuccgucucccaacacuaaguucacuucgugucucucacgacagggaggaaacuuagcauuccuuggagaccugaagggaugcgaugagcuuaagaauuuucaagagcuuaucaaucagucagcccuuguucauccucacgcggauguguggugguauugugguggaccuuuacugggcacucugccgaauaacuggaguggcacuuauacuuuaguccaauuggcuaucccuuucacccuggcauuucaucaaccagcaggagaaaaaauaagacauuguaaagcgagagaagccccuuguaggucuuucaacucucauguccauuuagacgcaauuggagucccaugaggaauaccagaucaauguaaagcuugaaaucaaauaguuacaggauuugagucaauauuuugguagaugacaguuaauaaaaauguagauuaguaaacuacaucuauuacaaccaacagcagcaagcuuuucaugaguuaaaagaaaaacucacgucagccccagcccuggggcuaccugaccuaacaaaacccuuuacacccuaugugucagaaaaagaaaaacauggcaguuagaguuuuaacccagacuguaaggcccuggccaaggccaguggccuaucucucaaaacaacuagacgggguuuccaaaggcuggccugcaugucuaagggcccuagcagcaacagcccuguuagcacaagaagcagauaagcuaacucuuaggcaaaaccuaaacauaaaguccccccaugcuguggugacuuuaauaaauaccaaaggacaucauuagcuaaugaaugcuagacuaacuagauaccaaagcuugcucugugaaaauccccacauaacaauugaaguuugcaacacucuaaaccccgccaccuuacuccugguaucagagagcccaguuaaacauaacuguguagagguauuagacucaguuuauucuagugggcccaaccuccaagaccauccuuaaacaucaguagaccgagagcuguacguggaugggagcagcuucgccaacccuugcaaagugacucugaagaagacgacaagcccugcuucagucacacccagaagcuaacugguccaugcacggccgaaacaugaggaaacucaucgcaggacucauuuuccuuaaaauuuggacuuguacaguaaggacuucaacugaccuuccucagacugagggcuguucccaguauauacaucaagucacugaagugggacaaaagguugcuacaguccuauuauuuuacaguuauuauaaguguacuggaacucuaaaaaaacuuguuuguauaauguuacucuauacaagguauguagcccgggaaaugaccaaccugauguguguuaugacccaucugagccucccaugaccauaguuuuuaaaauaagauuaaggacugaagacugguggaggcucauaaacgauacaaguaaaguguuagccaaaacaaaacaaaacaaaaaaagaagugcccaaacaagucaccuugaaauucgaugccugugcugucauuaauaauaauagguuaaaaauaggaugugguucucuuaauuaagaaagaggcuauauggcagaaaauaaguacauuuaucauaaauuaagacuguguaaaaauaaauguggauacuggucuugugucauuuaggcuacuuggauaaaaaaaaaaaauccuguccaccuucagcaagggaaaaguggcccuuccuguaccaguggucaguguaaccccuuagaacuaguaauaaccaacccccuuaauccucacuagaaaaaagaggaacguguaacccuaaaaauugauggagcuggacuggaucuucaaguaaaugucgugguuugaggaaaaguuuauaaacgcucuccugagccaguauuucaaaccuucuaugaugaacugaaugugucaguaccagaaauuccaggaaaaacaggaaauuuguuuuugcaauuagccgagcauauagcccagucucucagugucacuucguguuauguaucagcacaaguguaaauaugugaaucauuaucaaucuauugcacaggaagacauaaguagcaaaaauaagagugagaacucccacuaauaaaaagugagagucucaaaggggggaaaugagagaagagagacagacccucucauauuguuuuauauuguuuuauacucagaaaaggaaagagaagcaaaacuaaaggcagguagcccggcgccuagcaaccagacgugaaaccaaggaaccagaccugaaaccgggccugggccugccugacccaagccugguaguuaaaauuccaccccugaccuagcaacugauguuaucuauagauuauaggaagacauuguaaaacuucccagucuguucuguuucacucuaaccaccggugcaugaagccccugucauguacccccugcuugcucaauugaucaugacccucucacguggacccccccaccuuagaguuaugagccuuuaaaagggacaggaauugcucauucagggagcucggcucuugagacaggagucuugccgaugcccccagccgaauaaaccccuuccgucuuuaacuuggugucugaggaguuuugucugcggcucguccugcuacccaauuuucucugcgauuauuuuccuucuaacccuuucuuaaagugaugggcucuaaaaaaucaugauucagcugcuauugcaauuuuaccuagccagugaauuuauuuauuuugagaugcuuuuugauauuauugucauugucaaaugacauuaugacauuucaaaagacauuggcugucagccagugggaucuagucuuaacucaucuuuggugcucaccggucauaaagcuguagucacauguguuuauuucccccagcacucuucccucauuuccuuccuuuccuuccugaaauuuccucuuccaguggugcaaaagcuggugaguaaguacugacaaaaccaaugccucuuccaaugucucuauucauuuccuuccuguccaucccuauaagcuuaacuguacauccaugguuauuuucaacuuugaguuaacaucguagaaucaaacacuuaagauauucagguaauucugaauaccauaugcuaugguuugaaugugucucccaaaauucguuuguuggaaacuuaauccccaaugcagcaguacugggauguggggcuuaaugguaaagcccuuacgaauggauuaaugccgcuauuaaaaggguuuguggaaguggguucuuccucuccugcucuuuugccaugugaggacauagcauuccucccuuccagaggacacaggcuucaaggugccauuuuggaaacagagauaccaggccccuaaccugcucucuguucuucuuuuuuuuuuuuuuagauggagucucagucugucgcccaggcuggagugcaguggugugaucucugcucaccgcaaccucugccgcccggguucaagcaauucuccugccucagccucccgaguagcugggauuacaggcgucugccaccgugcccagcuaauuuuuguauuuuuaguagagacgggguuucaccaucuuggccaggcuggucuugaacuccuaaugucgugauccacccgccucagccucccaaaguucuggguuuacaggcgugagccaccguaccuggccuaaaucgcuguucuuuauaaauuacuuagucucaagaauucuguuauagcagcacaaaauggacuaaaacaucaugguuccugcuuuuuuggcucacuaaguguucguggcuuuucucuuucaaaauuuuauugcuaaaauaaauaaagaugucacuacuuuacaauaauucaucacauuccauuuuuuuguaagaaauaguaaaaguuggauuucuaugcccuugaaaaagaacucuauccuugaggcaaucugaaacuaagcauuuaacaacuugaaaaauuagaucacaacccucugaccaaacaccagaaaguuuuauacugaaauucagauacucuuugcuuguuuauuggcagggaaaaagccaaaauaucaagaaagccagcacaaauaugaguaguaauauccccuuagcuaacauagauuugcaccacccaucuaccuucuaucaugucauccuuuuuauuucuuucauuuuauguaugagucuuugaaauguuuguguuuuuaaaaaccuuuuauuuuuuuauuuccuucauuaaaauguaagcucuccaagggcaggccuuuaugcucauauuuaccaccaauuugcugcugccuagagcagcuccuggcacacagaaugaccucaaaaaauaccaguggaaugaaagaguaaugaaagaaaugacucaucugguuuuacuccaaaagaaguaguucuaauuuuuuuuaaugcuuaaagaaagccaaauggauauacauauaggauuuccagugucauaaaaguaacaaaauuagcuuacucuuccaaacucuuauuuuauuaauauuuuuuaauaauaaaaaauuauagaaugcuucaugaauuugucauccuugcauuggggccaugcuaaucuucuuuguaucauuccaguuuuagucuaugugcugcugaaacaagcaccaaacucuuaaaauuagcuuagguucagagugaagagcugaaguugcagaccagacccaagcuguuuugggacuaugaaggacauuaagggcucuguuuauuugagcaaaaucuaugggugaggcuuaccugcuuucugccaauuuuccuuguacaacagcugaugucagagggugguuggauaaggagcuuggagccguugguaaggaaguucuuaucacuuucuugcaggcuccuuuuaccucuagucuucuaugacucaagggucauucagugccaaaugaaauucugccucugugguaacugcuagaaaguccagugaugaucugauuucuaguaacaacuauuggccauauccccaggaggagauaagaauugugucuauuaggaaauaauuuuccauggaucuaucaccuuuuuguaccucuugugagcuggagcacugaaugauuuuauuccagacuauuccccaggauguuuguauagcaaacagucuugggagauagagguaguaucucgcgccaggggagaaggcagguuuguuuguuguucauuauauuaaagacaaugucuuccuccagggcaaaaguugggcaggcuaacuugcaguccauuauaaaagauucagauuuccuaagcuuggaguugcuuagguaugaugcaaaucuccugagugugcaaacauggaccuaggaugcuccguaggacuucgagaacaaggggaaccaacagaacaugaaacacauaccauuugaguaaaaacagccuuuaucuuugauucaggugucuucugccagcauucaugaaacgaaacuggcaaauagcaaaaaucugaaacauuucacuguucuugauaguuucacaugcuccauccaugccagggucccuuauuuccugcaaaauaaaaaaauucugacaaagagugcauaugggacagggugaccuucacugggaagcggaagugaagccccaaguucauggugggagaucagugguaaugaacagagguaugucauaguguaggaaacagaugaaauugccaaugugaagauaagucauuaguguuaagaauaaaaaugcuaguucauuucacauucacauacuguuuguucacauaagaugcuccauaaauguuauugaauaaauggauuuauauccuucuugcuugcaaaaaugguaugaagagguuuccaguaaaaaacacagauaaugaauuuauucaaagaagagugggaagaggcgauucaggacaagaagggaagaaggaccccaaucccccauccccuaccacccuguccuuccauaagagugagaauuuugucaggcauuuuaaaaaguucaccucacuaauccucaaaggacccuuaagauugcucucagauaaggaaacugcauagaagauaggaagagcaucugugaguauaagauauguacaguaucuggcuccgaucugccuuugcaaggaaauggcagagccaggauuugaacucagguuaucuggcuucaagguacuacauguuuuuuguuuguuuguuuguuuguuuuuuguuuuuguuuuguuuuauaugacugaguuuuuuuacucuaucacccaggcuggagugcaguggcgcaaucucgguucacugcaaccuccgccucccagguucaagugauucucuugccucagccucccgaguagcugggauuacaggcacccgccaccaugaccagcuaauuuuucuauuuuuaguagagaugagguuucacuacauuggccaggcuggucucgaacuccugaccucaggugauccgccugccucggccucccacagugcugggauuacaggcgugagccacugcgccugaccucuacauguuuuuuuuuuuuuuuuuuuuuuuuuacaggacaccacauugacagugucagcccaaaacuagaccaagaacacuugggcacacugagcucagggcuuagcccaaaguuuucugaaagcaugccagagggaaagcuggaugaaaugcuuugguaaagaagaaagcacaucagcucaucacucaucugacaauagaaaggacugaucaggaaguggggaaaaggagaauaguggcaaaacauagaaaagagaaaaaaaaagacugaaauuuuuaauggagcgcaaaaucagacauauuuuuuuacuuuuuugaacuucuuuagagacuacaauaauaauucuuaugugauaaguccaauaagcuaugaugauguuuuauuaaauguaccaucauacuagcagcuuuugcagaauuugcaucagaagaaaaguauaagauauuaccaccaugacuuggcaaaagcgguauacuauauuaauguuagccacuuaguugcugucauuguuucucagcacaguacccauugccuaguuucccugggaguucuugaaagcucuauugaaaaguuauauuuaaaguguaaguuagagugugcugugaauggagagaaaauuguuuuucuuuuuguaaaaaauucacuuuccuugggacuauauacuaaguuagcucaguuauuugacagaaccaguaucuuauuuuacaaagagaaaaacauagaucuagaaauuuccagaagcagaucacugguugaaagggcggggcgggggggggcaugugauugaaugugauuugaaggcaguuuuaauuuuaugacacuuuacaguguguguguguguguguguguguauguguuuuaaugauaaccuaauuuuauugucccagacuuaaagaucugugccaccuggagaaacuacaguucauccauuagcauguaaaucuguuaagaguauuuuugcuugaauuucuccgagaaggcucccggcuuuguucuguacagacacacagucccgacgcuguucuuaauauccuguuuucauuugucagcgcuguuguccuuuucauugccauguucccaucauuccucuucuuucauguggugcuuuacaauaacauucagaacaaaagagucacuccucuuucuguugccuuuaaaaaaaaaaaaaaaagacuucuuccccugacugcagagcuucagugaucaggggaaauguuuaaagcauguuauucguaauaguuaaccaggaguugugaauaaggguucguuuuccuuacuuuuuaagaucaggagguagcuucaggguauugugagcaaaagguuuuuguguguggcugacuuugaaguugagggaaaaagcgauuuucuuugagaaaaggaggcaucauauuugagagaauuuccaaucugcucacacaaugggaaucaguuacucuauaacaucgucauuaccuccaugagucacgagacuaguauuuguucuugucuuugaacuuaagcuuuccaguguucagagaacaguugugaaauguugcauuggccaucaucaauaacuauuuugcuccugguugguaauaauugggaaggggaggguguguacuuucucugccuucuaggagaguauuauauaaauaaagugagaaaaaguuuccccaagcggcaagcuuuucuccagggcacaaucuauuauacuugcugcaaaaaucccacuugacuggucuuucagagaauagaucacuugcgucauuuugcucauuuccaggugaccuuuugcagauaugagcaggcaguuguuuuuaaauaaacauuaucuacagguuucuguuucugcacuaaggaaggaauguuucuguaaugcagaagggaugcuaugacugagggguuugugaagagugaauucuagccagucucaaauaauucugaaaaggugcuuuuguauauguauauguguacuuauguauacaugcacauuguauauaacuacaaaaacuaauuccauuauggacauauauaggacuuuauacagacauaguuauaugaauauauauagaaauaccuaucaaacuauaaauacauuugagaaagcauucagggacagcaguguuaaaagcuuuucaucugugacugguuucacagaaauuagugacuuccauuucugcuaccaucacgcuguuggucuguucaccaggaggguugauuuagacuucugccaggagacuagguguggccaucucucacccucuuccucucuguccagucugcuaucauugccuucagaaccaaauucuugcaugauacccaguacagcauagaccuggaaaacaucggucauuuucaauauaauguaaaauagguucugugugccuuuaaaacuaaaugcuuuauuucuuaaacuguaaaagacaugaaaugucugagacauucagauagugggaaauuucaucugcaaguugucagauuaugcccuuuagaagauuguaauuuuuuuuguuguuuaucauuuucucuugagggguggaguaaauauuucuuuccugauguuucaacuucagauguucaggcuaauuuuccacuacagugccaaaauagggaaaaguuaggccuguagaauuuugacaauuuaaauguuguuuuaacaaaagccaugucuugaugaaaaguucuuuagaauucuacuugaugaucuaugugugucucuuccgaggacaaugagaacuucuuaaggaagucaucuauaugugaaauugaguaauccuuuuauucauuguuaaaagacaaaugaaguuauaauuuggagagacauaagccaaaaaaucuauguuugcauuuuuauguccuaacaugugaagcaugcuuugauuuacugugaaguguugcaauggcaauaaaguagauguugagacgugcagacugggcagcccgaggaagcaguucuugccucugcuuccccuuuaucaugaauguuccuuaaacaccuuugguggaguccaaaugucuggauuaugaauugaauugugcaagauucuuuuuuuaaacacuuuccugaugauuuacuuuacuugcaguuucuugucuugcauggugauaagcaauauccuucaaagaacugcagcgcaggacuuuuuuuuuuuuuuuuucuuuuaggaagacuacuuccccuuccuccuuuagucaaucaaauuuuaaaagauuacuucuuuccauucucaguucacccuuucuuugccauucuggagacugaaauuuuggacacccaucacagauuugcuauuauauauauaccguguauguaauauuaaauauauauauauauauacacacacgauguuuuuauauauguguguacauaauguaugcauacguguguaugugaaaccuguguguauauacauauauuuuaaauuguuuaucaggaugauagauugcuauuuaggucacuauuuuuggaagaaauaaaugacuguucuuugugucuguacuggagauuguucuuccugauauaacuuugaagaaaacuucuuccagacauuauacauuaauucagaagauaaaggcacaaaauaauguguauauuauuuuuuuaaaugaacaagccagcaugcagagcauaaugugaucaugugcucaguacgacacugaaaggccccaaaggcaaaugagucuagugccuguucccagccccaggagcugggcaggacggcuccuauugguggcauugaaagcuagcauucagccuucugccacaggacagugucucauucggccaagcugcugcuggucccuguaaggaaugagaguacagaucccguugccaaguccucauuuuuuuggaccaggcaguggguguugagcugaccugagcuaccuuuccauuuggguucaguugaacauugaguaggccagaggauagggaaguuguggcgggggccguggaaaaggcaguugauucuucaacucgggcaacccuggcggaguggaugagguggagcuggccuuccuggaauuguuggaccgauuuuccuguuguguuucacuguugacgcacucacagacacacaggaccgcuccagcacugccugccacccaccgucuggucucgguggccugucuaucauuucguggguccccauccucugccuacggcgauguuucuucaaaaagaacuagugugcaguccauugguggguauucaaggugaucucuuugucagaaucuagagaggugcucaaagaacuauuaaggaccaauguacuaguuccuguuuuuaaccuguuuaucagucuuucaauugaacaaauuggauuucugaaacugcugagggguuuucugcacuauuaggacagaacaggauagggugguuguuccuccaggaaucuggguuguucuuuugcauugccauuugucuuugugcuugucugcuuguauaaaugaaccucgagaaggaguguuuaaguauucuguuaaguaaauuuggaagacuagguuucaauuaaaauaaccagacagugugacccagcuuccauuuccccuuaauuuugaucauuaaagccuucauauccccacagacaucugccaugcuucgaagugauucuucucaggaauguucauucauuauuaaucagguugcauggucaggcgaguaugugauuauuuuaaagaauguccuagagauccaguuacuaagaaugagcauguuauaggcagaugugaaaguacagaaaagauuugguuaacaguuuaauuugauuugcaugaauuccaccagguggguguuuggcgaaauuaaaagucuucccugguucucacuucagauaugagguaaaaaaauaauaauaauaauaauaauuucagcacuucuuaaagaagaaaugucaaguuauucaaaauaucuauuguauuaauuauuuuaaaacuugaggcuagcaucucagugcucaucugcuugucacuuuuuuuuuucaaacagucccucugguccccuacaauuuucuuggcagaaauucuuaguugucuguuacugguugagcaaaugaauuugagugugcugacauuuggaggcuaaaugcagugauaauucagaguaacauucuuuaccuauaaaauguuacuggaucaccuuuuuucaccuguucuuacuugauguauuauuuauacuguuguuuuuaagaaccacuuugcguuuguacugaaacagccuacauuaugcuaucaauuuccagucuuucagaaugcaguuaaauccaacuggauccccuucuccccuuuuuccaucaguucauggcccuguuuuacugugccuuugcuaacccaccugcuucucaaauuggccagagugcuaaucaguaaaguaacauuuggguagugucuuuauucgguggucuuuaucacucaaagucaaauacuaaauggcauaauugaauaugcagaugcugagugcuuguauuauguuauucaaaauacccuaugaugaauucaucuuggauguagcagccaguuuuuauugaguuuguguuagacaaguuuuugaguugagaaauuaugcuuauuuaagaugagagcaagucccuucugaguuggguccccguugcaaucugccucccaaacucagguugauuuccaguguuucacacuucaguaguuuugaguccucugaaagucuguauuucugcugguccaagauagaaacaucacucugcagucuuuaaaaaauauuucaccuauaguucuauaauaaagauaaucucauagcaaaaauccaaacagcaauagucaacuaaaucuaauuacccaggugaauagggguuaagaggagcggacaaucaaguaaauugacuugauuucguuucugaaauuuaggacucucaaauaauucauuuguacauuuucaaugcuauuuguuguuugaaauacuuauaggagcuuccuguucugaaaccauuuucguguggcuugcuguaacaucgugcaauuuuaacaguguguuugucaucucaguuauguuuugguaaauuuaacaauaaaguuagucucuauaguccagaggauauuuggaaaagaacuagaggaagugccuugggaaucaucugggcaguggcugacagccacgugguauuaacgauuaaucacaggccacccaguguuggcauacaaguuuauuccuuggucuaaugacucacuaauuucccugguagugaaggcuuuagaguuguacaaagugaggggcuggaaguaaaauuauugauagaauugauagaauugcauguucuuuuucauauacuccaaauuagaaaaauaauuguauuucauggaguaugcagacauaaccuagaauacuuguaggaaagcauugagagguggguuuaccuuaucauuaaaaaggucaaugccuccauuaagggaaauuugggauaaaaauuauggaugaugugcugaugaugggcgaucuccuuauucuaauggaugcuguaacaaguuagcacaaaccugaugguguuaaacaaugcaaauucauuaucuuacauuucuagagucaaaagucugacacaggucucacugggcuaagaguaagguaucuuuagggcuguauuccuuuugggggcccuuggggagaauucauuuccuugccuuuuccagcuucuagccugcauuccuuggcuuguggccccuuccuccaucuucaaggccaggcauggcuggucgagucuuugucauaucucaucauucugacucugacucuucuuccugccacuuccacguuuaaagagccuugugauuccuuuggguccaccuagaugauccaugcugcucuccccaucucaaggucagcuacuuagcaaucuuaauuauaucagcaacagucaguccccuuugcucuauaaccuaaaauauucacaagcucugaggaggaggcuguggauaucuuuggggaccauaauugugccucccccaaagagggaggaguagaaacuguggugucugcugucuggugaccaggaggacagaagcccugugaggagacaccaggagcccuguagagaagacaaagacaggcuaaugagggaagaggauaaaucccacaucaugugcauuccaagucugaggcacuugcaguacaugaagcaaagaacugucagugcuaaaccggguuccagaaagggguucucgaccaucuugggauacaagccuagcagucauucucagagaggcaguacaugaaacaaacaaaaaacuggauggcccugucaaaggaaccauagaccaucagaaaacacuuaggcuuugauuagcaagagguagaagucagcagugguuagacagaggaaaacuaggaaaguacaguuucagugacauacagugaugugguuuguuuguccccaccaaaacucauguugaaauguaauccccaaugugguggcauugggaggaggggccuagugggagaugucugggucauggggauggauccuucacaaaucgcuugaugcccuucuugagguagucaguucuugcucucauggagacuagauugguucucacaggaguggauuaguucccaugagaauggaguuguuauaaagcaaaguuccuucucuugagcagaugccaguaccaugcuucuuguacuucccagccuguggagccacgagcuaaauaaaccucuuuuguuuauaaaucgcccagccucagguauucuguuauagcaacacaaaauggacuaagauacauauuaugagagaggaaaggaaaggaagaagagggaggugugaaaacauuuacaucauuauuuuccagcaaaacaucuacuuauuaauuuuccauuuuaaagaaguacuuuccucauaagucuugaaucuauaagaaaguuuuuucaaaagauguauccaaugccucccacgauguggggcuucacuguaaucugucacugaagacucuccugccuaggggagugauuagagugagugcuagagggacuguagggaacaucuguggacacucacccauggauacucagacagcuaauaaguagcagaacugcaggaugucuuagauuaucccgucaccuguccagcucucuccccuuucauucauuauucugugcuguguucuagauguuuaaaccauggacaggcagaggugugagcugugauuuguugccauucccaguuuguugcaagggacucucaagauuaucuagauccucuucucaaugaggaccaaucugcccauucacaaaaauguuaagcuauaggauuuccugacaacaauaugcaugugugauuuccuuuuauugaaguagaaaugaagaaguuuuuuuuuuuuuuugaggcauggaaauuacauuaugacaguuaagaaaaggcaaaagcugcuguuuuaugauauugggguuuuuguuguuguuguuuguuuguuuugagacagagucuugcucuguugcccaggcuggagugcaguggcaugauuucagcucacugcaaccucugccuccuggguucaagugauucuccugccucagccucccgaguagauggaaucacaggcgcacgccaccacacccagcuaauuuuuuguauuuuuaguagagacgggguuucaccacguuagccaggcuggucucgaacuccugaccucaagcgauucacccaccuuggccucccaaagugcugggauuacaggugugagccaccaugcccggccugauacuguuauuaaugauauaaauaacaauguaagcuauauauauauguguguguguguguguguguguguguguguguauuagauacauauauauauagagagagagagagaaagagagagagaaagggagagagaaagagagagagagagagagagagagugaaaagaaagauaacauuuugcauaaaauucccacccauguaccacuaucugcuuggugaaucccuguucaucuuuuaaaacccacuucauacuuuaccuccuucaggaagcuucucccugucuccucucccccuauauagaguugauuauucccugucugucuuuggcaugcaucuuuuuuuauguugcauuacaccuuguucauuuuuuuuucucgauaugggcucacucuguugcccaggcuguagugcauuggcaugaucacgguucauugcagccucagccucccaaguaucugggaccacaggcaugugccaccacuccuggcuaauuuuuuuauuuuuauuuuuugguagagauagggucucacuauguugcccaggcuggucucaaacuccugggaucaagugauuaucccacuucagccucccaaagugcugggauuacaggcaugagccaccacaccuggccuuguucauauuuucucucucggaaugaaccauaagaucauggagacaggggccagcuguuaccaguacuugucucaggaccaaguacauagaugaacuuaaguauuuggugaaagaaugaauggcaaaaaaaaaaaaaaaaggaaugaauggcauuuuaauuucuccaaaaagauauuuuaaagaaagcuagaaaauaaaccauacuaaguuucuuuuagaagaaggaauggaaugaguacaaauaagauacuguagagucauuuaacaaaaaugcuaucuaugccauuguaaaaucuggguaaaaguggaaaaagugggaugcacuauagauaucaaaccaaaaccccuuccuuuuugguagcauacaggcaaaagauuuagaaaauuggcugaaauucaccuaccacaucugaguauugugucuucaccuaauacaauuaaccauuuacaguacagacacuugcauaaagcacuaugccaggugcuauggcaguaaaagaaaauaucuaguuuugagcagcuacuauuaauucguucuuacaugaguugccccuaagcacucgagucacauaauuuccauugaugucagauucaaagcccauugcauaucauuucccauuagcacuggaaacuuguaagugcuuguucaagucuugcuccgccauccuugcugcuguugcccacacagcauuuuauucauaccucucugagaaugauuuucauuuauguucugguuaucuguauaugccucuaucuuccaauacauggcucaacaaaauaagaugugcaggccaaugcuggccugugaccuguuuuucuaaauaugguuauguuggaacacagccauacucauuccuuuauguauugugucugauugcuuuugcacuacagugguagauugaguaguugcaacagggccccuuuggcccacaaagccaaaaaugucuacuauuuuacccuuuauagaaaaaguuuguugaccucuguucaaauauauugagagauccuuaaagucaagggcuguguuugauucuuuuugguuuuagcugaaaagucaguacauuuaauggaaucaaugaauguuugagucauuuugugugcugagugcuguucuagguguuggugguacguucuucaaagagcaaagcaaaaucucugcuuucacagagcuuauauucuaguguugaggacaguggggacagaaggagcaauaaacaaacuaaaagaauaugucagugauaaauauuauaaagaaaaauaaaccgagaugggggaagaauuaccacgauggguaggugguauagugguagaaggggaauugguuuuauguggguucagagagaaagugacacuggagcagagagucauguggauucugaagaccuugcaggggcgagcaggggauugaugugcuuggcauguuugaggagucagaacgaggccaugugcucagagcagagaaaggaguggguagcgugggaggaagugagcucacugucugagucuguguuuucuggggcugguuuauucuggugaauuucucucugggugaaaugggaagcccuuacagggcagagcaaaaggagaugcauguucugucauguuuuaacaacaggcucucuugcuucugaguggaggauagacuauagggggaagggcaggagugaacagaagccaagagaccauuuagaaaggucuuaugauaguccacauaagagaugaugcuggcuuggcccaugauaauagagaugaggugaugugaaccccagauucuggcuucuucaucuaacucagugccuggcacacaguaaacaucuguugaaggaaugaauaaaaugucaguauuuccacugaggucuccccaguggaauccuuucuagaaauucucaucacaccucucugggauggaauccuggcaccugcauuaaaaauauagucaucauagcucuccagacauaauuugaugcucauccuucuauucagauucauugguaggcauucuuguuuuaucugagaacagagcagaccaaaagggcuacauuuuuccuuuaauuuauaugcuucugaugagaagguaaaagaacuuugauuuaaagauaauucuacauuuuuucuaugauuaaccaaaauaauuauuaauagguaaaaaccuuuccauuucuucugagccaucuguaggaagaggugacagaccaaguggggaugauauguuucuuacaacagcaacccuaggguuuccauugcagguuguagaaagauguacaagcuuuaauauuucaagucacaguugcucuuuuauucuuuccuauauaauaaaugcuagugaaugguugaagauuuuuuaagauaccaggcuuuuaugaagccaguagcuguuuaauuuuuaacaggcucgggacauacuuuauacuuuuaaugaucaguuaccauucaguugguagcaagaugagcauuaauuucaccaaagcaccauauugguauuucugagggaugcuauuucagaaggggucaggguauucuagaaaccgugaauuuuguaaauaagcggaggugugaauacaaacgauugauugucagaaucacuaaacauagcuuuggaugugaagccuucccauaaauccggcugagaacgcucuccccaccacccccgugggugauuugaaccucccgaccacugggugaacugcacuguucucccacagccugcaaugggcugcauguaauauucccaucacuggucugcagaccucugcuaauggucuugaaagggagaagguucaaagcggcuugguucccaggccugcuaaugagcaugaggccucuucacccuuaaugaacugggguuuguguggaauucuuucuacuacucuuuuugaugggaaggcagaugagaguucacaaaagcacucaggucuuuauggcaaggggagcaggcagcugggccacccucggguggccuggaggagagcaacauagcuagcagaggucguacccaggccaacauagcucugagugugaggcuggaccuccugccagccuggccuguugcuggcaacagugacaagcccguggugggaguuuuuuggccaaaagggucccucagcaguuuuguaagccuccuuaaauugcuuucucaacuguaaucauuaucauugucauaacauaacuuaucacaugaauaugaugaccacugaaauccuuguucuaauuaacuaaaucauugcucuaaauauuagucauugguacucaaacuuacugcagccacugaaaaagcccccagauauuuuucuccacuucguucugccuacccacgucccacugcuggauuaaacaauagaauuauucagaaacauaaugaacacaugccaaaaauauugccucuaucacaaucaucuuugugaaagucaauguuuuuucucaggaauauauuuuggaaaaugacaucccacacuuaaacacgaucaucucugcugaaauccccacauuugauuucauguacauuucaugcccauuucuauaguuacugccuuccuauuguucugaaaccugguuugguauugcagaguaaaaguccuuaaaucucguauacauuaauacguaaguuuauaaauucaaauuuauaaaagacucuaguuuauugaugaauauuucuacauuuuaauuuucugugcgagguuaaaccugacucugacacaauaagauuauucugauuaaauacaaauuauggaaauuacaguuucaauuacauucuaguuuugaaugaagccuuuuaaaaaacaaaauugaaaaaaaaaauugcacauuuucaguuacugaacuuugagaaaauguuaacugguauaugauggcucaggaugcuuuuuccuccuuuuuuccccagugaauagaaagagaauuauuuggaauguacacacacuuacccuuucaugaccuguguuuggaauuauucugagaugcauucaaagcugacaccccccuaugguugaccucccugugccuaaucaaaucuuacauucuuguuuccagauagcugaucagcuuccuuggguuuugcugaugacacaagagagcuuugccugaagauggaaacacuggagucagaacugaccugcccuauuugucuggagcucuuugaggacccucuucuacugcccugcgcacacagccucugcuucaacugcgcccaccgcauccuaguaucacacugugccaccaacgagucuguggaguccaucaccgccuuccagugccccaccugccggcaugucaucacccucagccagcgaggucuagacgggcucaagcgcaacgucacccuacagaacaucaucgacagguuccagaaagcaucagugagcgggcccaacucucccagcgagacccgucgggagcgggccuuugacgccaacaccaugaccuccgccgagaagguccucugccaguuuugugaccaggauccugcccaggacgcugugaagaccugugucacuugugaaguauccuacugugacgagugccugaaagccacucacccgaauaagaagcccuuuacaggccaucgucugauugagccaauuccggacucucacauccgggggcugaugugcuuggagcaugaggaugagaaggugaauauguacugugugaccgaugaccaguuaaucugugccuuguguaaacugguugggcggcaccgcgaucaucagguggcagcuuugagugagcgcuaugacaaauugaagguuaguccgauccgccuuaagccaaccccuuucugccagaaaaugucauggaaauaaaaaguguauucacugcuagcuacauggcaggugaagguuuucuccucaccuuuguuaucugauuaguuuuagcauguuuuuggcaaccuauaaauguuacacaauaaggguaucuuguaaaaguugacugcugcuuguaauuuuagcguugucaaggugagggcaaauucuaaaaaucuggaucauuuucaauccaugcaguuuuucuggaucauuuucaauccuuacaguucuuccaaagagagugcugccucucucugagagagagggagagagagagagagagagagagagagagggagagagagggagagagagggagagagagagagaaugacagauaaaaucuggcuuugggcauuuggggaacacuuacuuuucucacucaucugggaaaacuaauucacucucauuguaccuguaucuaguuacugcacaaacaaaagaauagagggaagaaugucuguagcaaaugugggauuuuagaggacacgugaccuuuuauuccuuguauaaacgauauccagcuuauuggugaaauucagugcucugacaaucucagguuucacgaaagaauuccuuuucguguaggcucuuuauucaguaagguuacagucaagacuauuugaacuucauuuuuuacaugaaauuauuaaccuaacuccagcuugggggauaaugauuaauaugacuauaugugaaauaaaaggaucacuuucuaggcagggcgugguggcucaugccuguaaucccagcacuuugggaggccgaggagagugaaucacuugaggucagcaguucaaaaccauccuggccaacaugguggaaccccaucucuacuaaaaauaaaaaaauuagccgggugugguggugggugccuguaaucccagcuacucgggaggcugaggcaggagaaucacuugacccugggggguggauguugcagugacccaagaucgcgccacugcgcuccagccugggugaaagagcgagacucucucucaaaaaaaaaaaaaaaaaaaaucacucucuaaguauggauagaaagcacuagggaagaaauaauaagccaagucuccacauguuuguucaauuucaggcaacagugggucuaauuauugaaaacucagcugagagaguuugagugagauacuauguucaucagcuaauuuuagaucacaagacaccaauuaaaagaaaggaaguauaaauuaaaagcucuaaguaaauauauauugaaguccuuccucucaggaaaaacacauaccauguuguugagcaaacaaaaugaaucacaugaucaaaagaguguuaucacuuagaaaacagugucaccuuuaacaaaugguuucuaucaccucuccuuagcgcuaaugggugguuguguuuacugggaccacauaguuuauucugugacagugggauuaacggaccacaucugggauuuggcuuugcuauuucuugacauguugagggaagccgacaugcugaagucaauuccugcuucucaaugucacuugggcaacaaaagcaucaccugggcagcauguuucacuucaaguauccaaagaauuacuggugcaaauccaucuuuaaaccauguagaggaagucaagcacaaggacucaggugacacagacaacagaagacagccgcugacaggcuuuccagaacagugcauggcagcacaggagaaaaguaccaccaaaguuaaucauagcaaaggcaaugcauguaugagcugugccucuagagcaaauucugaagaaauugcgaaggcuauuaauuuuuacaaaccaagguaaucuuuuuuuuuuuuuuuuuuuuuaccccuuuuuugguuggugguggagcugaagggagaauauuuaggauaacugaacagagauguuugauuuuuguuuuccaaaauguaaacaugccagaucuuuguuucuuuauuaaaaauguuccuuugauuggauuugcacuaccuuuuaaugauuguuuguuaaaacaccacaaucauaaugauguucaauauuuaacaacucccaggcuugauauuuauuuaaaucuuguggucagguucugcucaaguacucauggccugucacagcagaguuauuaaauauuuacauaacaucuccaaauuuaugaagaauuccugucaugcucuagcccucuuugugauaaaaacaaaacucuucaguuacgagcccugcacacuuuaauugagccaguggccuaucgguuguucuacugucacauggagggccugacaauuaaugaugugguuucuuuuuauuuccuaguuacagaaauauaagcauauaaacagcauccaaugcaccgaaacacauuuacagccguucaauaagauguacuuaugagcauuugaacaaauaacuuaucgacauagcauguuuguuuuaaaacaugccacuuacguuagaauuuuaaaaauaauaauuaugacauuuggaugucugauauuucaguuaucgcauacuuaugaacauauguacauccuuguuuuauuuaaaaccuaagcacaauauaaauguugauuuuuuugaaggaaguaauagcauaccaagaggaccaaaaccaaggaaguauauuucuguuaauuacuacuuuggucugaaaugugcucugaacaugcauuuuucuguagcucuaggaucucauauagauguggauuugugaugaugugagaacacagauaaagcauggaggaauuugaggaugcuuucauugauaagacaauagauuugcuuuauuaauuugcauauguaaggacccuggugucuuuggaaacauuuuuguccuucuguuaguaaaaguuuauuaccugaagaagggaauucugcaauuauuaugaagaauaauuucuugcaauaauacuaaacuuugggggacauauuuuacucauuagaucucaguauaagagauguuuguuuauacaaaaaaucagaauaucauuuuguacauuacaaucuuuuucuaaguguaaaagaaaaagagauaaaaauucuaacauguugaacucguacaaauaaaaucauccacaucauguaaaauagcaucaugucaguaaucuaacgcuuucggagacuaugcauugagaggcacucaugaaauauugaagcaaagagaaaauuaagguagcauuuccugaacucuacuaagauaaaaagagaaaaguuuuccugccaagugcaaaggucucuaaguggagcguauccauaauguggauauuucuuuacaucguuuuaauugaauuuuaagaagccucucaguccuucaaacuuggaggaaaaauuugauuugugaaccacauaacauauaagagaauuuaauauaauuaaugcauuccagaguuuucaaggaauuaaaaugcaguaguccucuuuuucuguuccaacauacaagguuggagcucuuguuucuuuucucuaauuauaccuauaaaaauauacaaauugaaaaaaacugaccuuuccuugccuuucaguuucagcauagccccuucaaauuagcugaagcugaaguuccaaacuauuguuuugcuauucuuauucuaaaggcuggcugaggaaguuuguuuguauaaugcauguuucaacggaucaucccauuguaauuuuuuaauaguuugauuuaaaaguucaaauuaaagcucagcauuucuauguagcacuuuuuaucuggaagugaagacaugagauuucauucuuggguuuaauuuauagauuguaagguucuauguuugaaaaaucuuucccaguuugcaacuaggaaaguuguaaguguauacugagcuagacuucuuuuuauuauaauuucuauaacuuguuucuucuuugaaaaccaguagcaggcauagugcagguucuagugcuauggugugugaugcacacacauacuugcauauacauauacauacaugcauuuauuuauuuauuuaauauuauaaucuuccugaaucuaaguuggagacaaauucaagugaccaguauuuucauuagggauauuucauucugcaggcaagagaugacaacaaacauagcaauaauaacuauauucccaucacucaaaauauuuuaccuguuccuugaauguuugguagauggauacaagucaacuuuggacuugguauauuuuuugugggaagagucuuaucuugaagggguuuuuuuuugaaguuacaaauauguguauuuuuuaaaaugugucuuucuguuuauugguuucuaguuuaaaucccuuaagaucagggcucaagacaauugcauauggucucacuuauggaugcaguaugcuuuaagaaauauuagaauaaguuuauuguaucuucaaaauuuccaugagcucauuaauguuuucagucuguguaaucaauuaaugacuaggagaggugcacuuaggccuuccacucagagagugaaauuuucuuuuuuuuuuuuuuuuuuuuacuuuaaguucugggacacaugugcagauuuauuacauaaguauacaugugccaugaugguuugcugcaccuaucaacccaucaucuagguuuuacaccccacaugcauuagguauuuguccuaaugcucucccccgcucgccccacaacccugacaggccccagugugugauguuccccucccuguguccauguguucucauuguucaacuuccacuuaugagagagaucaugcgguguuugguuuucuguuucuguguuacuuugcugagaaugauggguuccagcuucguccguguccuugcaaaggacaugaauucauucuuuuucaggccugcauaguauuacaugguguauaugugccacauuuucuuuauccagucuaucauuggugggcauuuggguugguuccaagucuuugcuauuguaaauaguacugcaauaaacauaugugugcaugugucuuuauagcagaaugcucuauaauccuuuggguaucuacccgguaaugggauugcuggaucaaaugguauuucugguucuagauuuuugaggaauugccacacugucuuccacaaugguugaacuaauuuacaaccaccaacaguguaaaaacauuccuauuucuccacagccucgccagcaucuguuguuuccugacuuuuuaauaaucgccauucuaacuggcuugagaugguaucucauugugguuuugauuugcauuuuccuaaugaccagugaugaugagcuuuuuuucuucauauguuuguuggcugcauaaaugucuucuuuugagaagugucuguucauauccuuugcccacuuuuugaugggguuguuugauuuuuucuuguaaauuuguuuaaguucuuuguagauucuggauauuagcccuuugucagauggguagauuguaaaauuuuucucccauucuguagguugucuguucacucugaugguaguuucuuuugcugugcagaagcucuuuaguuuaauuagaucccauuugucaauuuuggcuuuuguugccauugcuuuugguguuuuagucaugagauccuugcccaugccuauguccugaaugguauugccuagguuuucuucuaggguuuuuaugguuugggguuuuacauuuaagucuuuaauccaucgugaguuaauuuuuguauaagauguaaugaagggguucaguuucuguuuucugcauauggcuagccaguuuucccaacaccauuuauuaaauagggaauccuuucuccauugcuuguuuuugucagguuugucaaagaucagaugguuguagaugugugguguuauuuccaaggucucuguucuguuccauuggucuauauaucuguuuugguaccaguacccugcuguuuuugguuacuguagccucguauaguuugaagucagguagugugaugccuccagcuuuguucgauuugcuuaggauugucuuggcuauaugggcucuuuuuugguuccacguuaaauuuaaaguagcuuuucuaauucugugaagaaagucaaugguagcuugauggggauagcauugaaucuauaaauuacuuugggcaguauggccauuuucacgauacugauucuucuauccaugagcauggauuuuuuuuccauuuguuuguguccucucuuauuuccuugagcaguuguuuguaguucuccuugaagagguccuucacgucccuuguaaguuguauuccuagguauuuuauucucuuuguagcaauugugaaugggaguucacucaugauuuggcucucugcuugucgauuauugguauauaggaaugcucaugauuuuuguacauugauuuuguauccugagacuuugcugaaguugcuuaucagcuuaaggagcuuuggggccgagaugaugggguuuucuaaauauacagucaugucauaugcaaauagaaacuauuugacuuccucucuccuauucgaauacccaucauuucuuucucuugccugauugcccuggccagaauuuccaauacuguguugaauaggaguggugagagagggcauccuugucuugugccaguuuucaaagggaaugcuucuagcuuuuuuuugccgagagugaaauuuucaaguccucuucauaguucugucauuuugcuugcuuuaggccuuuugaaccuauguuauuaagaacgauauggcugggcaugggggcucacaccuguaaucccagcacuuugggaggccaaaaaggagcauugcuugagcuuggucguuugagaccagcuuggacaacauagcaagacccugucucuacuaaaaauaaaaauaaaaauucaacuggguaugguggcauguaccugugguuccaguuacucuggaggcugaggugagaggaucauugagccugggagaucagggcugcagugagcagugauuacaccacuaugcuccaaccugggugacagagcaagacccugucucaaaagaaaaaaaaaaaaacccacaaugaaaguuaauauagguuuuuugagaggucauaaaaaauuaauauguguuuaauuaauuaagguaauaugaacaguaacagucccugccuucauggagcuuauagucuaguagggcauuccaacagcuacuaaauacuuucucuguugaugguggcaggaagcacauugugcccaaagcaaagguacugaccccaguccugagagauggagaaaggcuucccagaaaagggaucacugcaccuaccauuuccaagccuuguauuagaaaacaauauugaauuuacuagaugucuguaaaaucccuguuaucaguuauuccuuuuuaacuuuuuaccacguaugauguucuuuguguaacccuauauaguuuuucaaacuuguucacaguaauucccaguugauuuuaaucuaaaauacagacagacuauaugauguuucaccaugugguaugugaauaacucagacacaugucuucuaaaauguuguaauuuuauggaguuucaccaguuccaacugacuccaauaugcaauucuguuuguacuaauuuuauggcagcauuuguuuagucugcaauauagauauguauuuuuuuccuuuuaucuuuaguuggacacuuaauaauugcacauauuuaugagauauagucugauauuuccaaacguguauacaauguguugaaauguauauuuuuuaauaguuuccaugugauuaaaauaagauuuccaaauauuuguaaaauguauuaaaacuauauuuuaauuuuguuaguuugguacaaggauauuuaugauagauggaauaaaagaaagcaucuccaggcauauguucuuaaugggaaacucaaggcagcuuccuuuuccuccuccucaccugucuauuuucuggaugaguccucucucaacuccuucaccugcagagagcaauguauuauugccuagugauuuauuauuguuggaaucauucuugguaagcucagagaguucgaaaaaugcacaaacaaguacacaugguaccucuucaucauguggcuguguaaacguaauucuugggcaccuuguuaacguucuugugcuauauuuuacucgucuauaaaacagggcuaauguauaguacuuacuuucacagaaaauugggagagcaaaauaaaguguuucaugugccuuagcauugugccuggccuacagaaagccugcaacacaugucagaacgacuguuagaaacuaggaggcagaauguguaaugguuaaguguauggacauuggauguagacugacugccaaauauuuuuuaaccacugucuuguauuauguguaugugagauaagaguauauauuguugcuuuaauguguuuuguaguuuuguuucuaaagcaccugccaaagggcagagacgugacaauuaauaaacacuuguugauggacaugugcagaauugaugcauuagacgaguguuuugggauucggaggaggaagagaugaaucugcuuuugaguagacaauaaaccuugcuucaggguggugggauuuaagcugcuuugacagaucuguggauuaugcaucaaagaagagugaggugcucugcaggagugagaccagcagagaccugucgguaggaauaggcaagacagcuuuggaauuuuagacaauccuaacuagagcacagggugccaaauggggagccaggaaagaggauguuggaagagucaccuggagggaaggucuugaaagucuuuaaaugcaagguuaaggguuuaggccauuuuuaccauuuucuauagaguaauagugaaguguuuuuuuuuuuuuuuuaagagagagagguuaauguauauuuucugaaauaaauuucaugugagaauauaagaauggauaggguuacuguguucauggaagaaauaaaagggggaagagacauucacauuacuuuagauuuuguggucucucuuuuaauuggcagaaagaaguaguaucacaggucaaaaaccaccacccugucaacagaaacauguaaaauugugagauucaagguccugccccuuaaaacuaggaagaaauaggagaugucguugcugauuggcucuuagguacagacacaaaugugauucuuuuccugcuuuucuagugcaguaagacacaguggggacaaugcaugguuauuucuucuggcuuuuugauucacaauaaggagaaugcuguucaaaccuccgaaugcccacuauaaaccaaaauaauguuuuagagccagaagcaaccuuggagcucaugucauuccauccucauucugcagaugaggaaaguagggcugagaguaguaaaagaaguuuuccgcaaugaccuaguggguuagugacucugaacuaggacuagagcacaguucccagcuguccaguuuugugucuuuccugcuacuuccuacagcgguuaacagugccagccagcacaggcaggauugccuuuugagugguucugaaauuucugaggucucuucugagguuuucaggaguaaacacaaugauuuuacgguaauuuuuaaacgccugcuuggccuggcaauaaaccagcaucauggguguaggaugaugccuuaccaugcugucugggaauuauugcagagauguggcuuugcaaugaugccuccagggccaccaaaauaaguugccuagaagaugcccccaugcugacauuuucuauagcugagccaguguagauuuggccaucuugaagggccagacuucaugccuggagcuguguucauguacauggacccagacaaccucggggacacugcaaaagaaagcagaguuaggacagugaugucaaugaggaaacaaaggaauugugguugcaacuuaaugggcucacuaauucccuucuuaggauuauuguuuuccugaaugucuuaauauauagauuauucuuagacugguaaauuuuuugacauugccauaaagugggcaugaguagucugagaaacugaauguggcuaaagauuuaauuuauuuucaguauguggcauaaacauucuggaaaaaucugauacaaaugcaauuguaaaaauccauuuaaaacuuaaucacuuuauauucuggacuuuuggguaugacacaacguuguugcguacccaugagguauggacuuuaagcugacaaaggaaaacacauuuugcaugucgcaucaaaaaggaaaaugcuuguaaagugccgagcauggugacuggcacauaguaaguguuggauguacacgagguauuauuuuaucugggcauuuacuguuacaauaaaaccuucauugguguaauccaaugguggauuucuugacaguaucauaaauuacucagugguuauaggguugauauguguuucuggcugacaugggaaacuuugaacaacucucaagggaauuauaauuggguggaaacuuugauuuguccuuucuaaaccaagcuaaguagugaaauggacuuuuaagaagcagugaguggugaauugaaagaaauggcuuuaaaaacaaggcccaauuugaagucuggggaugcggguggcagggguggaggggagcggcucuuucauguuucugguuaaucugauuggaucagcaccacaggugccaucagagcaccuacagcuguuuccaagaaaagaaaagcuggcauugguuuauacuauggcugucacauuuauacacaucuagacagaugaggaaaagaugggugacaugauacacaguaagccuagacuagucagacgagcucagggggcuagcuuucuuuuuuuuuuuuuguaggguugccuuugguaugugaguaaaugaugaagcaaguuggcccugggcuguguguuagcagcugucucucuuagaauaggaagaggaaggaacuucgguaucgacuggggcuggaggaggaggaaagcgcugaagugaaggagcuguacaagaaggcagcuuccaacuccuccacuguaggggcccugggguguuuuguucucugugcucucuucugugccaguugugcagggugccuagaauagcgguaucaucgucugccuccucccuuauaucucuuuugcuauuuauugagggggaaaauccggaaaauaugguuuuuauuuuuauuuacauugggauagacuagguucuuauuacugaaacaauauggaaaucaugagcagcuucuauuccuuuugugccuuuauaaauauucuuuucccuaucugcuuuaucagauccugcuuuuaaaaaaaaaagaaagaaaaaaccuuauuuguuuacucagggaauauuuuauguagcuacuaugagauaaacacugaguaaauucugggaaugcagaaaugaaaaacaaagauaagucguugcuuccauggucuagagcucauuauaacauguaauaagaauauauagacaggauaugaaaagagcuccauggagcucaaucaaugagauaauuuuuaaugugaauaauaauaaaaaaccacugacuucgguguugauaucuggaaauugccuaauuccaaaagcugaaguaaaaauacauuucaauaaaaagcaacauuuacagagaacagugacauucagucauuuggaauugcaaauuccacuguucagucauuuggaauugcaaguaagggcaaaauaugaagacuccaauccaugaaaaaagccggcuggaugcuuucuuaugaaaggucuacuguucgcgggcuggacugcuagcccuucucacgugcuuuccucagaggucuccauuuccuuccugaacagggcuaauaggucagauaaauauccaggcucacaagcaguuuaugucauuuccacucugaaaggauccaucccuaggaagauauuaugggagcaaacuugcggaagugcuauuguguuaaccaagccagcugguggguuugcuuuaucuguuauggaauuuuuaccaacuuagguguuaggaugaauauccugaccugguagaguguuuauuucccccuucuuugacccuugacacagcuguuuagagcucagucacucuugguugacauggucagauucaaagccaagaagagugaaaugggcaggcuuuuagacucacacacugaguauggccugugugagugagucugaaagaucuaggagacauggggaagccguaugcacuucacuuaaggagcuuggagggagaugcuauuuuugccucuggauugcugauuuaagcucuagagggucccagcaaacaagggccucacuuauuuauaguguccagcuuguuaacugguuccaguagcucuuucauucuaaauacccugacuugaucauuacagauucuaugcauguaacaaaauaucacauguaccccauaaauauguacaaauauuauguaucaauaaaacguucaucugauaacauauuaggcaaggccauagggcugcuuccauaccucuagaaaacugccucguaggucagggcugagugguaguacaggaagguggaguaaucugucaagaugcugcuuuaaguuguuuugagaugugguucaaggguguuuguugaucaaacaccaagagcuagcuauuaccaagaauaauaacuagcauuuguaaaucuccagauugacaguuugcaaagcacuuucaaguauuauuugauccuuggaacaaccacguaucuccugcaaaaauaugggaaugauaauaccugcucauuagggaucuugggaggauuaaaugagauaauauagguccaagugucuagccuagcauuuagugggugggagcagcuggguaaauaggaaccaucuuuaacaaugcagaacaugaggccauggaaaauucaaaagcauaacuguagucagaugacuacguuuuggagcucagacccagggaccccauuuugcccuugacuaaucgucaccuaugauuaaagcagaaacaacuaugguccaaacauaccacccuuaaaaaauuagcgagaaagaaagagagagaguuugaguauggagagagcaaguauuuuugccuucacuuuugacacacaggcucccuggacugagcaaagaaguucccuuugaaguggugacuaugauugaggaugagcuaguuuccacucuaauauaaauaaagaaguaaaaauacaaaguugaaauauggaaauccauauggaaucauuuuauuuacuuacagcaauauugaauuauccaauacucaauaguuucucuguaccuaaguguuaacauaaaugaaugaaucucugaugaucccuaaaaucauuucaucacuugaaaugugauuauuuacuuacccuggcuaaaaauguaaauuuauagucuuggucuaugaguucaacauuucaaauuucuuaagagaccaaaacgaguuaauauucauauuuaguuauucaugccaaagcguggauacauauaaaaaugaucaccauguguuagucaauaauaaaacuuuuugaucuguuauccauuccucuuucuaggaucgcuaaucagucagaauuguagauuuaaauugguuucuaaaacaaagauaucucaaacaugguugugcacaaagccacucaggguucauacguauauauauguguguguguauacauauauauauauauuuuuuuuauuucuuuuuuuuuuuuuagauagagucucgcugcauagcccaggcuggaguccaguggcgugaucucggcucacugcaaccuccaccuccugcauucaagcaauucuccugccucaggcucccgaguagcugggauuacaggcaugcgccaccacgcccggcuaauuuuuguauuuuuaguagagacgggguuucgccagguuggccaggcugaucucgaacuccugacaucaggugaucugcccgccuaggccuccaaaaguacugggauuacaucaugagccaccauuuauaagauucagcagaucugagacagguuuagagucugauuucaacuuguguccuggcguugccauuuuagaauugugcgaacuuaagggaaaaaaaacaaaacuaacuuuucaagccucaauuccucaucaguaaaacagagguaauaauucaguaauaacuccauaaugcuuguccccuaggaagcccuggacaaaggauagugguuccucuuuccaucacuauuguuauuccuugaaugccucuaucuuuaccccguuauucuaaauuuuaagccuuuucuguaguuauauggacaaugcaguuggcccuccauauuuguggguucugcaucugaggauucaaccaaucguaaaucaaaaauauuugaaaaaaaaacaauuaaaaaagauaaaaacacaaauaaaaaaguauaacgacuauuuauuguauuauuaauuauuaauaauuauuguauuauuauaaguaaccuagagaugauuuaaaguauugcaggauauggguagguuauaugcaaauauuauaccauuuuauaucagagaguugagcauccauggauuuuugguaucuguaggagggucuugaaaccaauccccuguagauauugaggaaugacuguauauguucuuauacaaagucaaacaauacaguuuauguaagugaauccucaguccuuccagcucuuccucuaccaacucuugauuauucuuaaaggaucaacucaaaucucauggaggacuacucuaauuuaacuuuuaauaaaauuaucugaucuccgacauucccuauuuuuuuuuuuuuuaccacuccuucauaauugcaugcuguuuguguauuauuucauauucuuugggccggauucacaaaggauaggauaaaguaauaccauguacaguggcuuacguuuguaaucccagaacuuugggaggcugaggcaggagaaucgcuugagcccaggaguucaacaccagccugggcaacauagugaaaccuugucucuacaaaaaaauaaaaauaaaaaaaaauuccaggcaugauggcacacgccuauggucccaguuacucuggaagcugaagcaggaggauugcuugagcccagaguuggaggcuacagugagccgugaucacaccacuacacuccagccugaaugacagagaaagacccugucucuaaaacguuaaaaauguaaaaauaaaccuacuuugggcauaagucuucccuccccaauaguguuucaauuucucaagcccaguggcuguauuuuguguucuuuuauaucugauuacucauuuuucaacaauaagagcauucugaaaagcuacaagguauuuuaucaguaguaaauaguuguugaaaccaguugaaaaaggcuguaaugauuuaauuagauuacagucuguauuguguagguagaaguugcccaucagauuaaaaaaaaaggaaaauccuagcccaccagccauucuuucaaauuuuaaauacauagucaagcaaaauaaugccuuucaggucucugcacaccuuucugaaucuacaaguuucuucucaaugauuucuuucaagaaagucuuauaaagagaccauuugaauuuuuaaaacuuuaauucaggcagcagugaucaaauauuugugauucacaaaggauaggauaaaauaauaccauguacauauacaaucggcccuccguaucuguggauuucacaucuguguauucuaccacccgaggacugaaaauauucaaaaacaauaaaugguuacauuuguuuguacugaacauguauagacuuuuaaaaaaucucuaaacaauacaauguaacaacuauuuacuaagcuuuuacauuguauuagguauuauaauuaaucuagagauaaaguauaugggaggauauacauagguuauaugcaaauacuaugccauuuuauauaagggaccugagcaucuguggauuuugguauucauagggguccuggaacgaauccccuacagguaccucgggacgacuguauauauuuuguguguguguauuuucuucccuauugccucagaauagaguuuaauuccacuuugagacaggaugguaagguaucaugaggaccauaggguaaacuuagcaauauacaauugcuuaguuuucgaaacuugggagaggaaggggcugccacuggcgcacaaugggucaaggccacggaugcugcuaaacauccugaaugcacagaacagccccccagacagauagucauccagccccaaaugucauuggugccaaagcggagauacccugagucgaagcaaagcaucuuuguuaaugacauaagagaaaugcucaguuuuacucuuacagacauuuacuuguuugugugaccccuaaaccaaaucuacuuugagauguagagagcugagacauugcagaacuccccucccgccaucugcagaugcccugaguggcagccuggcagccuggcagccuggaagcagccccagaguucuuugcacagcgggcuucucucacccaugcccccagcccaacucugagcagucugggcccgcacaugccagccuucaggcuguuucaacaguauuuaaaccuccaaaggcuuaugaaauauucuuuaaucccuucccaaaacaugauuuagguguauuugauauuaucugcuauccccuagauuuccuaguguuugcagcuuauuuucaggacuaccuuccagguguagccgucugugucagagacaggagagccugaggcuuuccuccaaguggggagucugcagagaacaggcuggcagcugagacuuucgcccaaauggcuuauauuugauguauaauaguuuuaauugugauauuauuaaaagugaauuauuuccauagaucaaaaguuaacucauuaaaucuguuagucuauuuuaaguuggucuuccaaaggaaccauuuauauuuauauagcauugcgucuuuauccuugcaaaacuguggauucuaaacuccucaagucagagacuuggaauagcauaaaucagaugugagucuucauugcugaggcugaauuuauucagucauaauuuccaagcauuuguuccugcuggaagguacuacuuauuucacaagaaguucaugucaugaaagcgcugagcucgaagggccaucacgcauaucuaguccagugguucucaaccuggcugcacagggauuaccuugggcagaagcccagcccaaugggacaagaucuucuggggugcagcucaggcauugggguuuccccaaaacuaccccaagugauucuaaugugcaaacuugguggaaaaaguuuauucuuuuccaauuccucaguuacaaugaguaaacugagggucagauuaauucauaaaggcagaagucagcaaacaccguaaaggacuagcuacuaaaucuuucuggcauugcaggccauaugguuucugugggaacugcucaaaagcagccauaggcaauucagaaacaaauggauguggcaggcugccaaugaagcucuauaaaaauaggugacuggccggauuuggcccaugggccauaguuugccaaccucugguuuagaucucacaguugguuaguagaaacccauaugcuaggccacagauagacuaaccuucaacaagugaucuuccuucuacuagaugcaguuuuccuguuugaagcagugucuauaacauacccaacuucuguagagguuaaauaauaauuaucuuuauguaaguuaaggcaaauaucuuagcauagguacucauagucuagagcgcagaaauuuucauuaucugugucuuuaugagaggucugcauuuugaugguauuuaccaaauuuaaaguaauaaucacaguauauguguuuuacuaaaguaauaacccagacaauaauauuccuauccaagaaauuuuuucagcuagaaagucagaaaaugagacagcgugaucagaccaccaaagcaagcaagaaaaaaaaaucagcuaagaaaaauggagaucugauuuucuuuucacccaguaaaggaaucaguugaaaaucucuuaauucuuccuuacugugcugaugacucauggggagauacuuuaucucagauuucuuuugaauacaucugaguaaauuugaauaugaauuauaucuaauagcuagagaugcuuccuacgaguccuugggaaacagcauggacuaaggcugaagaaguggaaagaaagccaucacaauuaauguggagaguuauguguuugguacuuaugaaacuuuggguauuuuucacuguuuguauagccuuucuuccaaaguacacucauaaaaauaggguuccugaaauguuaaaaagccacuggaucuggucauuuuccuuggagauuaauuuaucucuauuuggcaauuacuucguaucuauguuuuucagagaaagucacucuaccucuucccuuuuuuaucuaaauaacacauucaauaaaagugcuucauguccugaaaaaacaaaacugucuuauuuacgauuauaaaaugguguucaaucaaugauuucccugaggggauaaacacuagagauggaaaaacaaaaucaauuuguuuuucacaaauugacaucccucuguaugaugccaucauugaacugaaguuauugaaaggggccuuauagagagggcaccauagagggaaaucauagagaauaacaucauagagagggguaucauagagauaauaacugcauggagaggagccucauggagagggagcuuugagaggggacauggaacacacagugguagauuaaaauaauccaguaaucaauuuggccacauaaauaauagugaucauaauuuaugagggcuucccauacuaauuaaaauaugcauaauaacaacaguucauuuucauaauuguacacuuaagucaugcuauuuuuucucuuuuugccuaguucuaugguaugugugaucauggccuuacaacuuuuagaagguacuggcaaaugugguugcagugaacuguuuuucucugaagcuuucugcaguaauccuccuggcauuauuaagguuuccuuaaucauacuugguuagaggugauuugcgguccuaccaaccuuaauuugaauuuucucucugccucagauaagcuugacucuggggagguuucugaacaucuuuaaauuugaguucccaaauuauaaaguggguucagcaaugacugcuuuucauggcuuauuugagaauauaugagauugugcuuuaaaggauugaguagaaugccugguuuguucauuaguuuuuucuuuucuuuucuuuucuuuuuucuuuucuuuuuuucuuuucuuuucucuuuccuuccuucuuucuuucucuuccuuucuuuacccucccuucuuuccuuccuuuuuuuuuuuuuuuuuuuuuugagacagagucucacucuuguuucccaggcuggagugcaaugaugugaucucggcucaccgcaaccucugcuuccuggguucaagugaucuccugucucagccuucccgaguagcuaggauuacaggcacgugccaccaugccuggcuaauuuuguauuuuuaguagagacaggguuucuccauguuggucaggcuggucucaaacucccgaccucaggugauccgcccgccuuggccucccaaagcgcugggauuacaggcauaagccacugugcccggccuccuucuuucuuuuuugagacaacaucuugcucugucucccaggcuagagugcaguagugcaaucauggcucacugcagccucgaccuccccggcucagccuccagaguagcuggaacuacaggcaugugccaccaugcccagcugauuuuuguauuuuuuuguagagaugggguuuuugccgucuugccugggcugaucucaaacuucugggcucaagcgaucuucccacuucaaccucccaaagugcugggauuauaggcgugaaccacugcaccuggcccccaaaacuuucaaugaugacaaauuauucccuguaguaccauuacuauuauucuacccuuuggcauaacauagccuaggcugcauguucugucuucuucaaggaagugucuaugauuaggagaaaugcaagagggaggaacauacuggaggaugauuuuaucucucgcacauaugugaggacagcaacaccuaaguuugcucacuccacccuaguaaaacuucacuacuggcuuaauccuugauucuugagucucaguggggagucauuuucuaguacuguugagaguuauauagcccuaagggauuuuaugaaauaaaguguucccaaggaguguucuagaagaugagugauaugaguuaauaccaaggguuucuucugacagggaguguuaggugauaagacaacugcugaagauugaacugaucuuuauccagggaaguucugcacuugagauugucuuuauaggacaggcaacaggcauaaaaaaaaagugcuauaaaaauagguuuguuuguuucacaguaucauugagaaaacagcuauaaagaagauauauaaaaauauauaaaucuaucauguggucauuaaaugccagcgacuuauugaacgaugauuuauaaauggcugaaauucaaagaauuuucauggaaccaaaccaaagcauuucagaacaucuuucguucuuucaaaauugaaucaacuguucuucauuuuacagcuucuaaauauuguuuguguguguuuuugcuguuguugcacaggaaauaauuuuuaccuuaaaauauuaaaaacuuuuuuuucuaaauaauaaacuccaugcaguaaaaggcaacaaucagagaguguaaugcuagaacauuucaggcaugcccaaaaugcccauggcaggaugaaggaggcaaccucauggggcccagccauuugucuuguaaagucuuaaacuaccauaggaaaucccuguaggauguucuauuguguaagaguuccauuuaaaauacauuggcaauauccuaaaaaaaaaagcagugaaaaucuaaacuaugucuuguagcuuauucaaaucuauuauucaucuacugcagcagccaacacugcugcauagagcuaaaggagaaaaaaaacgaagauaaaauaagcaagagaaucaugacuacuaugaacugauaaauaaaaguguuaaaaaagcaauaaaacaaaccaccagcuuguuauugggcuuucaaauagguauguuuccgccuccuccuccuccuccugcuccuucuccuucuccuucauucagaagcaaucaucauaccacaagcaaacaaaccauuuugaagguguuuaccaggaauguuucccucccuuuuaauuuucugaccugaguauugguacaauuuuuucuuucauccuuuuugcaggcaaagggguuacuggaugugcuaaaggaaaguaugauuguagagugggaaaagggugaagaacaauguuuuaucuucuuaugucaauuaggcaggacaaaagacacaggcucccaaaaauaccuucagaguuugucauccuggaucaugauaaccuucaauauguugaaagucucguucaucuggguucaagaucccacacuuaacgaaagaaaggccgaaauuucccguaauguucuuuacuuuggguuuuacaaaaacacuucuauccagguauuuuuucuuguugaaauucugaaguaacucaagguguacacauguaauuuaaaacuuagcuuugaagccgggugugguggcucaugccuguaaucucagcacuuugggaggccaaggugggcgaaucaccugaggucaggaguucgagaccagccuggucaacguggggaaaccucgucucuacuaaaaauacaaaaauuacccagcauggugguaugugccugugccuguagucccagcuacuagguaggcugagacaggagaaucacuugaaccugguagguggagguugcagugagccgagaucacaccacugcacuucagccuaggugagacagcgagacucagucucaggaaaaacaaaacaaaacaaacaaacaaacaaaaaacacuuagcuuugaaaggaaauagccuauguuuccacaaauuagaguucauaauuauguugcauuucuacuauauaggacagcaacauuuucaccugaucugagcucaucuauuagccuuuccuuacaaauuugaaucaaaacuuucgccaggcuauaaaucucccuauaauugguagagagcuagauaagaauuaucccauaauaagaguuugggagaaccuugugguauuaaagggaugcugacauggaauacuguauauauuucuacuguuaaauuagaugcaguccuaauacuguuugugaaacuaaauuaggucaaugacucagagcugguuuuauuuagagugagcuauauauuaaaauguagcaauauuucccuucuucugaaaagccuucugguaaggauuucaauucauuguagaaaaacauuucccaaauuaagguauuuuaauuaaguccugguaagaaauuccaagcaugcuuuuuuuuccccuccucaaaagaggccuuccacauugugcauuuaguguuuacuaagauuucaaaucucuuugguucuaaccaguaucacuuagauaacacauuucacuuuuuuuuuucucccuuaaguguaaccugggaaaucccaacuuucccuuugaugcacuaagucuuuggcaucucaaucuguuaaaccagugcaacaaucauaacaggcauuuucuggagauguuacaagggaugaaaaaaaaaaugaaugaaaugaguugacuuuuuaaagaacgaugccauaagaagcaagacauaaauuugcuccagaagucaaaugguguguggggagaacaggcuuugaaaucaaauggaacugguuuggaguuccagcgcuggcaucacuagucguguaacccugggaaacagccugaguacauuuuguuuguuuguuuguauuuuugagacagaaucucacucuguugcccaggcuggagugcaguggcacgaucucagcucacugcaaccuccaccuccuggguucaagcgauucuccugccucagccucccuaguagcugggauuacaggugcaugccaacacaccuggcuaauuuuuuuuuuuaaaaaaacagagucucgcucugucacccaggcuggagugcaauggcauaaucucagcucacugcagccuuugcuucccggguuccagugauucuccugcuucagccucccaaguggcugggauuacagaugcacaccaccacgcccagcuaauuuuuauauuuuuaguagagaccgcguuucaccauguuggccaggcuggucucaaacuccugauuucaggugauccacccgccucagccccccaaagugcuuggauuacaggugugagccaccacacccagcucugaguucaucucuccaucacuagaaaucaggguaaucauacauuccuuaucacauuauuaagaggacuagagauagaauaugcagaauacugggcauguaguauguguucaauaaaugguagcugcuauuguuacugcuacuacuacagcugcugcuacuacuaaacugcugcuauucucauuguuacuauuaugacuccuacuauuauuucuacugccaaacaaggaggacuguggaaaaagaagccacuuuauccagcucuaaacaaaugaguuguuaccucacuguagcccaccuuucuagcaggaauaggagaaugaccaaguguuuuggaaucagauaaacccaagaguaacuuaaggagaaugauaggaccaucguugauaggagagccugaguacauucccagugcuguacuuguguggcugugaaaauuauuguuccaaaguugaauauugucaaggguguugagauuuaucucauggucaauauuugaucuuucaaagcugaccuauaccuaacacacuucaaauugguucaguguauguagcccuuguuacguggauauuauugugagcacuuauauaccagggaaugugucaugaggaagaauuauuauguguuugguauguagucauugaauuaagacuuccacauaaugaacuggaauggaauugcauuagaaauucuuuuuuucauccaaaauaaaaguaaacucaaauauaauuaugauguugccuucuaaugugaccugauugccauaucuuuguaauguuccguuacuccugccaaccuaaugucaguguguacuccaauucaauucagcaaacauuuauugauccuagucagggaugggaagacacuaagauuagcacaaagauaccuuugucauuaguaaguuacuacccaguaaaucuggcuaguauauuaaaucuauggucauuuuuuacauuuugcuuuucauucuaaacauguaaaaugauaauaaaaaaagaaaguauuuagaacaguaaagguucaaguccaccccuuuuuucuucaccuuuuuguuuagacacuauuucugacguuaauuaccacauuaauugggucuuaaguuccccuuccaguccucauuaugacuuccacauuucuuacaacuggcagaccuugcuaagucgugaacuauaaguuuuuuuuaaagguucagagcauuuaguccagcaacacaaauuacccuauggagacacuauauacacuaguagcaaugagcaaauguuucuuuuauuuuuauaauuguuuuggaaaaucauaugauugccaaagacagccuacacauggucaaguuggauucaucccagccuuaaaaagucugcgaaacacauuaauacuugugauguauagaguugagggauguuuuguuuuguuuuaacaugcuucuuauauguacauugguaauguuuaauuuagguuaaaauucuaugaaugauuuaauugauauuauccagguuuguuaaccauuuuaaauggccguugauuuugccaaauuccauucuaugccauuagaacgcuguccacacuaaguuccguuaauggggguaaaacucccaucauuugacucuuaaguaugguaaaauagcugucuagaaauaaaugaaccagaguccuggaaaauccaguggagaugccuagcaauggggguccccaaagacuucagcguaaggugcuuaucccuugaagcccccacccucccacccuuccucuauuuguuucuuaauugcacauuguuguucagaaaauucacacuugggauuuuuauauuuugugauuugaacucauuuuugcaauuuccuuuuuacauuucuagagagcugcuugaaauggaugcuaaacuacaauuccagccuuauguguuaggaaauacuuuuucucuacuacaaagugcaaagaacuggaaacuacuuuaguagaguuuucauuuaaaaaaccucuaucguacuucaguacuggaggaaagaaaaugcuugucaaucaacagccuuguguuuuucagucuugauauauguaauugauauaugauauaucaauuauauguaauaucaaaagagauggugugcacaaagccugccucggaguacauugaauaauauuuuauucagauauucauuuuaaaguuagugauuucagauauggagaaguuguagucaccagcugugauuuacugggggguggugggagggcagggggaccuauuacuggcaccugaacuggugauuucuguuuaccuguaauccaaaaauaaguaagugucugcuaauuucaccugcuaacaugugacagcaucuuuccaggcaaagaguagagguagcccugagagugaggccuuucuuuucggcucauguaugggagagaauuguguuuuuuagcagagaaggagauagcuuagaccuauugcauuugguaccuuccguagaaugucaguaugacaaguaacuggacucuuccagacagaucucaagagaaccugagugcccauucaagagaacuggaaaaacuuucaacucccaggcagcacccgcauagcucugaaauuugagagcacucugcacucucaauucauucccaggauuugaaaccaaagugccaaauuguuuucucaaacucuguaggaaccguuauccaccuacucacccaucuaccugcccauuucuuuagcaaauauuuguugagacuacuaugcagcaaauacuguguucggugcuuugaauccaauggggagggagagcaaccugggucuuguccuaaggaugcuuuccuuuuaagggaauucaugagucuuuucugcccuaaauugucuaacuguaagaagaggcagggagaaccucaguauguguuacuagagaacauuggcacuagucgauuuaauuuucaccaaauugacuauuuggaugagauccucauuaugcacagugcacauccaacuuagauggaaccaucuaaauuggaauaauagaccuuugugaucugugacuccacggaugaaauauugggucucagacaaucaaagacagacugacucucacuuugaagcaaugcaucaggcuuuauaauuaaacuaguuuagucgcaaacuucuuacuaugaaccucaggacguucugcagguaacaacuagaauuauuuguguggaauacuaacagcccaggaaacagauuaaagucacaggcagaauucuuuagccuuguuaaguacuugguguuaggaagaauauggaaauuucccagaucuugaaacauuguaaaggcccugggauauacuaucuaaaggccugcaggcaguauccagaagucuuccacgauccuuuuuucuuuuucuuuuuugagauggagucucacugugucacccagucuggagugcaguagcacaaucuuggcucacugcaaccucugccuccaagguucaagcgauucuugugccucagccuccugaguagcugggaucacaggcaugugcaaccacagccagcuaacuuuuauauuuuuaguagagaugggguuucaccauguuggccaggcuggucuugaacuccugaccucaagccaucugcccgccuaggcuaggauuacaggugugaaacaccgcaccgagcccaggugucuuccacaaaaauuagccaggcaugguggcaccuaccuguggucccagcuacucaggaggcugagguggaaggaucacuugagccagggagguggaggcugcagugaacuguaaccacaccacuguacuccagccuggcugacagagugagacucugucucaaagaacagaaagaaaagaaaagagaagagaggguuugauuuuuuuuuggcuauugaggaaacuguagcuguaaauaguguuaauucucagaaaaccaguuaaaugguaaaauucaggagaucauuauaaucaacuuuaaucaugaagagauaguuacauauguggcucaguuucuuuuuuuguuuguuugguuuuguucuuguuguuuugaauucagaagcagcuuuauuuuaagaaucucaauuuauagugaagucucaaucucuuuagucaucauuauguaaaauagaauaacauugcaaagaaaaaucaaauaaaagauuaaaaauccuagggcuagcacaugauugaagcaauauugaaggucacagauaguauaaauucucugauuauuaacagaggugagcuuuguuauagggagauggaucauuauuaagucaucugucugaucuagagccagccgcacgaucuaaugauuucauucuuggauuauuuuuaauauguagaauuagagauguuugggaaguguuugcuauuaucuugauaguacaguuuccuccuaaauuacuuuuguaaaguaaaauaauguuacauuggaagaaaguguguauuucuuaguaaugcuucacaauuccucauccuacauuucaauaaaucaucuuauaccugucagcacauguagucuaagauuuauugcaugguccauugugaagcagauagcuccuuggccagagagcaauuucugaaacuaauuuaaucaaaauguuuuuauaauacagugaacuauggcuugaugucuuaaauaugcauugaugucuucagaaccauaugauuaaacucuauccaauuuugaaauggaauuaagauuuggcuucauaugacuucuguuauagucaggaaaucuuugguugcauuaauauuauuuauguacuguuauugagcaaacauucaucagugccucuauuugcacagccaacccgcuagauguuaagauguugugggggaacaacaacaaaauacuaguuuaguagaaagacguaacugagagcuuggaaggagcaguagacauggcacaauuuauuggccaaaaaggaauccaguuuugcugaaguugaauguucauuuugcaggguggugguaauuauagcugccuucuacugggaaaguuuuaaaccuauaguuuugaugaguuugcacgccaacucaggaguuugaacuucauccuuuaagaguugaaaaauuuuggaguuuugagagugauguaagcuuacuggaaagauuacguugacggccauguguggacccaacuggacaaaaauuagaggaaugaaaaccagugauucauggaagauuguuagaauggaaaccuugggaagaaaagggaaaacugaagucaaggagucuuuuaaaaaaacaacuccccaaaaucuuuagagagugauuagauagaagacaugaagagcauaguaauaucuuuuguaaagaucgaggccgggcaugguggcucaugccuguaauccuagcacuuugggaggccaagguggguggauugcuugagcccaggaguucaagaccagccugggcaacauggcgaaaccucgucucuaccaaaaaugcaaaaaucagacuggcgugguggcacaugccuauagucccagcuacuuggggaggcugaggcaggaggauuucuugaaccugggaggucaaggcugcagugagcugagaucacaccgcaguacuccagccugggugacaaagugagacacugucucaauaaaaauaaauaaauaaauaaauaaagggaagguggggagaaauuucaaaggaacagaugaugcauuuaagacaguugaguuuaaaauaacaggggaccagcaaagcugaaaguugguauugaacugauagugagagacuaaagcuuaggucagaguugagaucugagaucaaaaucugaaucgugucaggacagaggauggaguuaaagcugugaaaaagaaugccauugcugauggaauauguacauaugaagccacuguuuuauuauaauuguuuggauagaacauguucuggugggaaacucacuugcagucaaaauugcacagugcuaaagucugccuuuaauuauaguaaaugcauucgauuugagaauuuguucauuaccuguaucagugacacuuuauucaaauaaaaacagcacacuggagaaagauaacaguuguggaaggccaaaaguccucuuugugauuuacuaucaccauuuaauuauuaagcugucugaugucaugugacacugccuccccagaguguccuaucacagugauagacgaaggucacagacauuuggaaaucaaauuauaaaagucacacuaaaaaguccugagagcaaaguuuaacauguuuguuuucagcuuuauauauuuucugucaagcugaauuuugaauuuugaagagguacacugaguccaaccaaugguugggggggcauuauuuuuucaucauaaacagaugagucuggauccucugcuggcugguugcccucucccccuuucaauaccacuuaauuuuuuuuuuuaagaacgacguuuauaaguaaucaagaauacacugggagcaacuucagcaugacuguuuuuuugcgugugagagagggcacguugugaacaucugaguucuaucuucauuuuuauuagaaaaagcaauuuagaacugccagucagauggguuaaaaagcacagcugaucgaggugcagcauccaugccugaaccuucuguguggcaugacauuggcucauaacccccuuacaccuucucuagcucucucuucaguucugcuuccuguuccgcaguagagacugaaggaacucgggaaaggcccaagaaugggaccugauuacaaagccuuaguaaguaauaagauaacaaaauguccacaagaaagggaaaguggggagagaagcagagcaauugcuuacuuccuacuuagcuuuuccucucuuucuguuuucccaggggaaggugcccaacaauuuguauuuuuaaccggcuccccaggugacugcugugguugggccaagcuacauuuugagaacuccuggucuaccuucuagauucuacagaaaagaugagacuuugcaauuuguaauuguuauaacuggcaagucuccuuccacuucugaguauuggacaguuuucucucacuggauuaaaagcaaauggcuugguuuuuaaaaguuuuugaaaguaacauuuauuauuugacuuccgcuuuagcaacacguuguauauguaaacucaaauauaguucagggaacugagagcuaguucacuuccaaaauacagugacccauaaauugucuuuagucauguauaaacaaaugaaugcuauugggaaaaugccuuaguaaauauuuuuuguaaaacacagcaaauuaaaucacuuucuagaaaaucuauuuuuuuuuuccccaggcaaguggccaucaaucaaagaagcagaauacuaggugugguuuucuuuguuuuuguuuuguuuuguuugaggcagugucucccucuguugcccaggcuggagugcaguggcacgaucauggcucacugcagccucgaccuccugaacucaggcgauccuccugccucauccuccggaguugcugggacuauaggugcaugccaccacgcccagcuaauuuuuaauuuuuuuuuuuuuuugagacagggucucccuauguugcccaggcuggucucaaacuccuggauucaagugauccuccagccuuggccucccaaagugcugggacaggugugugucaccaugcccagccucagaauacuuuaucacuuugguuuccaaauauugggaauauuuugcaauuuaccuuuuagacuacacaaggcuucagggcaaugcucuugccugaguugacguuugaaagugaauagagcuguaaaucuauucuuuugucgucagaauuuuuuuaauguuuuuccuaaauauuuaaguuaaauguguuaaaauauuguugaaugauaaacaucuguaguacacuucuguuguguuucuggugaaaguaacuacuguuaaggucaacagaccaaauuuguauacaaaugcuuuggcaaauuagaaauugaggugaccauucaguagcucuuuuuaggcauugggaauacucgaaugcaagaaagcauucccuuauauuuucaaguauaaaaaguccucuaaauuccuuaacagcaacaaucaguguuuccccgcuaagcacuguuuuaauaaaguugcugggauuuucuaugauaaaaucacauaaauuuauacuucuacauacaucuauauauaauuuuauuccuguacuuguuauauacauauaagcugcauuacaaauauauuuuuauucugaauaaauccuaaaguauaaaaguaguaaauugaauaaauuauugauuuuccuucacuguaucacagaaccuguuucuccauuuugagcaaugguucucgaacuuggaugcacauuggaaucuccuggguagcuuucacaaauccugcucccuggaccucacucaggcgaaguuauuuauacucuccgguugggaagggaggauagauccaggugauugccauguguaggccagaaugggaacuacuccccuaguagacacuccucaucuucuuuccuuccaugauuuccacauuucuuucaacucagucgaaaucaucuugaauagacaaaggcagugucgguccuacuaaagguugaggaaauggcugaguaaagaugaugaagucagggacaaaggaugcaaugaauuuuaagaauuugagauucaaacuucaaaacuuaggcaagggucuguuuuugaagguucagagcugaaaaacaauggcaugcuuucauauucuucuuugauucuguaggaugucccaaauggggaauucucuuacauaauauugauuuuguaaauuccugacagaucguacccacuuuggauggaauggaauuuuaaucuauuuuuuugagccaaagagugugaccucccuuggccuuaaauauuuuuuuguaccacacauguggggauaugaguauugugaaagcuacgaaccuuuccuuugaaugccacaauucaagaacaaagcugaucauguauugaauuuuaauaaucauuuucagcagcugguccagaaaagggcauuuuccucuaaaaccuaaaaaauucagaagauaaauuccuauagaaaaaaaggaaaucauacuuaucuauucaaaauuauuagaucaaagacuuucaacuauuuuagcuucaaauauguuuaauauauugaguuuaacugacaugaaguaccugcaggaugcguggugcuggcuuagaaaaagauuugguuuuccuacaguaucugaaaaacaaaaauguauuuucauccauccaaggcuaagcauccacuaugagacuaauuugacauucaggucugguaaaaauguuugaugguaucaguuaaaacccuguugaaguaggaagaccagaacauguucauuagugaguaucuggcaauguuaucaucuacuuaagauggaagaaaggggauaagaucaaaauuauucaaucccugagugauggaggaaguaaagcuugaaggggccuauacagacaacauguaugacauccaucaguaucaggggauuuuauagacauuaauuaucuagugcucuacacccucccugccugccuuuuaagguguauuuuaugauugaggaaaaaaaaaaagaccaggauaauagaauugaggaagauagcaaucaaugaguaauuccuuauccagucggcacuuaaaacucaaugcuuuauauauuuauuugcagagugguaggaacuaacuaauccucaugcugugccuuccuuacucacuuuugaccauguuuuugcuauagcaaccuugauacaauugaagauugucauuucuuacucuuccucaguuugaagcuccugcuuuccuggacaaaagacacaaauaaaacaggaauuuauucaaucauugcauuuuauccauaauuuaagacaucuuaucuauaauuuuuuucugaguuaaaauuuauuuuggugguuaacaaaaagagucuuuagaauuuugaguaccugaaggauuggaauuugaggcauccuccuacacucccauaguagguguugaaaauguuaaguuaauugaauuauauugaaauuuuaaaauggcuuggagcaacagaaaaaaaauguuauguauaaauuaauuaaaaacuacauggacuguuuuuuuuuuuuuaccauccacauggauaccagggauuucuuuucuuucucuuucuuucuuucuuucuuucuuucuuucuuucuuucuuucuuuucuuucuuucuuuuucuuucuuucuuucuuucuuucuuucuuucuuucuuucuuucuuucuuuccuuucuuucuuucuuucuuggauuauuaaaaagagaagguuguuuuuuaaauaaggaaaacaauuuucugcaaauggccagauagcagauauuuuggucuuuguagguacaaguccucaacuuucucauuguacugugaaagcaacaguaaacaauacuuuauggcuacagaaaugugaguuuuguauacuuuucaugugucauaaaauguuauucuuuucauuuuaaaaaaaauuauuuaaaaaugcaaaaaugagggcgggcacgguggcucacaccuguaaucccagcacuuugggaggcugaggcggguggaucaccugagguugggaauucgagaccagccugagcaacauggagaaaccccuucucugcuaaaaaauacgaaaauuagcugggcauggugguggcacaugccuguaaucccagcuacucgggaggcugaggcaggagaaucgcuugaacccaggaagcggagguugcagugagcugagaucgccccauugcacuccagccugggcaauaagagugaaacucugucucaaaaaaaaaaaaaccauucuuagcuaacaagccacacaaaaacaggcggcacgcaagguuugaccaguggaccaaccauaguuugccaaccucugguuuaggacauugaauaucuccugauuugaaaguuuucacuugaacaaaaauaauuaacuacuauuagucuguucuacaauauccuccucaccauguaauucuuaacuggcaaguagauugccucuuuuguuuuauuuauuuauuuauuuuaaaagacagggccucuuucugucccccaggcuggaguccaguggugcaaucauaacucacugaaguguugaacucccaggcucaagcaauccucccuccucagccuccugaguaacugggauuacagauguguaccagcuguagucuacaaauuugaccuguacccaauccuuggcuuaauauuaauuuuuaauuuuuaaaaaaguuuuuguagagaugggggucucacuauguugcccaggcuggucuugaacuccugguuuaaagcaauccucccgccuuggcaucccaaaguguugggauuacaggcaugaaccacagugcccugccuguggccucuuuugauauugcuauggcagcccagaguacuguguugagaaggauucagaaguugaacaagggcaaaugagcagagagggcugccagagaguugcccaauuggaccauccacagcucuucuagcuguguuauagucuuacaaaaugcuuccuuuauguccugcugauaaaaguuauagacuuauucuuagaagcauuuuucugcaggcauaaauuuugcaacugagaucauuguuuuuaaguuagagaauuugaaaggauucuaguaauauagcuucaugugauauccauucucaaaaccaacaaauguauuuauuggucauuugcucaccucucuuauuauaggcagaaauggggcuggggaggaggagugaauaaaaaaggccauucacaucucuaauaccuggaaauaacuagucgucauuggaucugcuaaaauuauaacuaaaugaauagaacuauacuaagauaccuauuuaucuccauuaaaauaaaagcucuucuagaccauacacaguauuuaaaaguuguucucuguauguuauugacuaccagguuagaaaaauaaacacugaacuccuaaugauggaauuuauaaauauauggaacagauucugugguguuaauauagaaauuucaaauaaaaccugacaagguaaacacuguaucacauaucaaaaugacuuaaauuguaguccauggaauacuagacuuaaauuuauaugcagauuguauuuuauuagguuuuugaaguucccucggcggccugucuugccagggcauuuggaaaugguagcuauuauaaccaaugaaaaaaaugcauuaaaaaauuaaaacaaccuaaauuacauguauuugcggucugucgagucaaaccugaagauagucucagccuccugcagugcaauuaaaacaucuuuaaaauuuaguuacauauaaagaauuuaugcuuuuauacaaguggcauguguuaauauggguguguuuucauauuaacuauugugauuaaaguuucuuagaagaaaauauaugggucguggcacuugacguguccauauccugaucacgcuggaguggugguguugggugccagggcuccgaauacaguugcugaaugucacucugaauauuauggaaugaaacaagccagaucuguguuugccuugaaagguauccagaccuaauauuguacuuuaaagacauucugaaguauugacuucggaauaagagcaagcauucuuuaaguccugggcaaacccaaaaggaauuacugaaaucuccuguuucaagcauacauuuuaauaguagugcucaaugacaagucauuaauucccugcaaccugacucuuagguucaggucuccaaaggcuaaaauuaggggcauuugucugcuucccuugcuauuugauuggguaucacuguauguagaaguacaaagcucaucuguuaaguuggauuuacuauucucugcuggugucccuauccaugccuaaaggcucauauugagauugguguaaaaucagcugucccaacaugaauuguucaauuaucagcucaaauaagccuuacuaaaaacuaccuaacaugaaggagguugacuguggcucugugaagaugcauccaaaaugugugcauuaaaaauaaaaauuauaagaaaaauuaaucacccuuuuugcauaaaguauguaaggaagccucauucuuuaagcaacacauguuuuauaacuuugccuuccacaaauuugaccuauacccaauccuuggcuuaauauuaagaaacuaaaucugcccacagguauccuugccuuuuauaaggaccauuuugaauuauuuguauuucuuuucuuuggugguaguggugggaggguaguauugaaugccaccaagucguaaaccucacagaauaagagcacuaugaaaaaaucacuuggggaaaagguaaugaauuaaggcugggagcaacuugacuuuggguuuagauggaacuugaaguugauguguuagugauaauugcuauagcaucucucuauuuuuauaaaucccgguuuggaaaaauuuguuugauaauguuauauuugccuucacaggaauccugugcucuggacaguguuauauaacauuccucaaaaauucuucuaaacucucaaggcccucuucuuggggucagacucaacgguaccaaugagaaaagccugaaagcauggaagacuucuguuguuuagcaaagcugagagaagacauugucuuaacuaucuacacuaguuguuaaauuaacuaaucaguugauuuacuacauuggauuucagaaggguuguccggugaauauucaguuuuccaugcuaauuggaaauaucauugcauauuuaaggguguacggugggaagggacuaagcaaugauggguauacagcaaguacucaauacauccuguggcuuuauuauacucucuuuuugcugguagaauuuucugcuacacacaugcauuccaggcaaagggaagagacugcgcccaugcucagacccagaaacaagccuggauccauaaaacagcuuguucacaauggcaggagcacagcacaggaguggggaaaguagaggaaaagagguaugaguaauacugaccacgaaaggaaagggaguugcccauucaaacuaacagaugagaagggcuucauggacgagaugacaacaaauaguagcauuagcauucauugagauuuaggacauugcacaacauuuuagaaauauguacacuuagucuaaaacagggacccgcaguccagaugggaauucugacaauaaucacaucaugagaaagcugagcaaauaggauucaguguuuuuggaaaauguaaucuuagggggaaauauauucuuguagcuauguacuacuaaauugaaaaucuacagaacaaaucauuuaugaaaugugugggcaugcuuuuaauuugguggugguuuaaauauuuuauuaacuguaugggcaugcuuuuaauuugguugugguauaaguguuacaaauuaagcuuuuuuuaaaaaucagucuaaacucgaaacuugaaaaacaaguuuuuuauuuuauuuaacaagcaccgauacaacacaucgugagccagguacucuuccuagggcuuccauguaucuccuccucuaaucaucuugacagccccaugaggaaacugaggcacagagguuaagaacuuguugaaggucucagagcuaggacuucaaaccaggcagacuggcaccagguucuguguacuuaaccauuaugcuccuuaaauuagaauaucuacgagucaaaaugcuguuuaauuuucuucagauuauuguggguucugucaagcuaagcuuucugcccauaagugaaagugcucuuagcaucuuguacagaaagaauucuuccuagagguucauugaguggcaucuauuucagacuuacacaaaaaguuugggacaaauguuaguguuuaacagaagcagauguuuaucaguggcccagacaauauuaucauuuugaguuuuaccuucuaggcugggggcguggcaaacaacaguugugggucaaaucucacucaccacuuguuuugguaaauaaaguuucauugaacacaguccuauccacucguuuacauguuaucuauggcugcuuucaugcuaaaacagcagcagaauugagucauuguguccaagaacauauggccaauaaagccugaaauauuuacuacacgaucuuuuauagcaaguuugccacccccuguucuagaccagugagguagccaccagccagauguagcucccaaguguuugaaauggggcugguuugaguugagaugugucauaaguguaaaacauaucagauuccaaagacuuaguaaaaagaaagaacaaaauauaaaauaucucaucaguuuucaaauauugauugcagguggaaaugacaauuuuauuaaaauuaacuuuucuugguucuauuuuuuuuaaugugacuacuagaaaaauuugaaaugugacucacauuuguggcucacauuagguuucuauugauacugcugaucuacagccuggaauuuggaggauaugugaccucuaggaaaagcagaaagaggaaagauggggaaagagagaaaaccucuuguauuugcaaaugucuuucuaaagcaauaaaauauuuucugauuuggcucuuccucacagaaaggcauacgcaaaaauggguuagguggucuauggagaugaucguagaugaguucucccagaagcagacucugacucagaauuugaauugggaggugauccaggaagcaccuggagggagaggggaugcaaacagggaagagauugaagaggaaagaggguuaaugagcagguuguugcuguggacccaugugcugccucccaauugcgcccugugggagauuuuguagacagaggcucagagugguuccacccaggaggugaaaaagcugggcugcauauccaccaauugccaguaauugccacuugagggcugcuccuaggaacaucagcuucuucuuacucuccccagcaccugccuugccugaagccagguaaggcccuggggugaaaaggcacaggugcuugcaggaaaaagccaugagcaagcuggagaauggugccucccagaggcacaggguugggcccuucuagugucuggaacuguguccaaacuaaauguuccaucuucuaauucauaauuucaacagacauucauguaguucucuggugaauguguucauuuucucauuugaucuuaacaauaguauagauagguagauuuaucauuauccauacauuauggaugggaaaacugagcccaagacacauccagucauuugccgaagagaguccagcugggaugguagucccggucuccucccucuucauauguggucacugacuccuuggauuucuacaaaacuugccuugaguaaggagaugucaauauauugauguuuucaaggugagaacaggaaacuaaaaccaauuuuucuugugcucuguagaauuuuuuuagauauccauagggcaguauagaaacugauaucuacuuaaucccaugacuuuuauauggaaaaguaugaucucuguuuugcacaagucacaaucaaaaucaagagauuauggagacugcugaccacuaccacacaggauguuagugauagaguuaauuuccagaaaaucuucagagaagucccuguaguggaagcuuaugggugcauggcucauuaaggacuggauuuuguuaucuucccauuacccagguucccuucaaagguguugucagccccuuugguaccacuuggaaacaagucucucucccagcuuaauuucccuuuauuaugcuucuaacugacucgguaauucuuugcagacuucaguaacacuuguacuauuuaaauuugaauaaccccaaaggaucuggauaggucaauguguuuaaaccacaggcuuuagucuauguauuaguugauuaaaaacagauuugaugcaugauguauacuuaauaaagggagggggaagcaagcagauguuuguaaaaucucaauguguuggauugcauuucuuuggcccucuuuugcugacuaacuuuagaaaagucauacuuaugacaauugaacuguaaacaguuagaugauguauuucccuagaaauuuccugcugugaagggucagccaaaaagaaaaguauccccuaguauuaacauaccaaaaaaguugacaaauauacguuauaaugguuaugucuauaucaaggacauugaagaaugggaugcuucaaaaucauccucuagucucugaccauaaagugauuagcaguugcgauucauuuaauccaaacaauaaaaaaaaaaaacuuuggcuuuuguuguuguuguuguuguuguuaaaagcaaguuuuucuuugaugcaagcauaagaucaaguuguacauaaaucacugugucuaguucauucucugacucuucagccucuuguaucccauucuuuaagugaaaaaguuauucuuccccuuuaaaauugucauauuugaaauguuuugagugauuccaagacagaauugaagguuucuuguugguuuuccaguccagaugaaaugugcacaaagccuuccucugaaguuugaacacaugagaauuacagauaaaauauuuuaaaauguauuuuagugaauacauaaccaagcauaaacauauguggaaagccuccaaggaccggaaaugaaagaaaguguagaguggugagagaagacugacacugggcuacucccaagaaguggagaugacauggggcaauggugacuucaguggacacauagggaagugaacaucacauguggcaagagccuuguacaccuggaggccaagacccccaugcauagacuggacucaaagggaaccugacaucuucucuggaauugaagccagacacagaacucucauggaaggaagcagaggcacugagucaaacuaggaucugugccucuguugcacacgagugccuugugggagcgucuucuuugggaaaagaaccucacgcccuaaccucagaauaugcuucuuaucuggcugggcuaugucaauccccaaaucacagcacagggaacaaaguuuacaucguaugagcugucagacaaaaauuacaagacaaagauaaaaucagauccuugagaaauagucaacaagcacagggaaauacagaauugccuuuucucaaaagagcuuaagaauaaguaaguuuaguuguuuugagauuauggagaagagaaucguguuuuuguaauaggaacagagagaaauucaauaagaaaagggagaugugauaaagaaccuacuagaaaugaaaaugcauucauuaaaaaauuuuaaaaucagucaauaggauaaacaccagauuaauaaguuuaacuuguuuuaaaaauaaccagaaaguucugcuuuugacauaugcauuuuaagccuuagaugaaagugguucuuuuccuuaauauacuuuucuaaauaaaaaauuuagggaaguagaaugagcuaaaauuuucauaaauaaauuuuacagcauaaugaaauuaacaccuuuaugaacuuguuaguuuucaaaaucccucaaacucuuucuaaauccucuuucuuggauggcauuauaaauuugaggucuguuuucuuuuccaugaaauuuccuguuguuccguaucuuugccauacuuguggaacugucuauaugcuaaaacacaguuucccuaaucuuuugcccucucaaccucucugauguuggcauacgacauuguucuauucccugcccauggaagauucuuccacaugcucacuucuuucuuuccaagaaguuuccacuguugugcaacaaaaaaccccuggacauccuucaagccucagcugcaagacuuggcccucuuggaaaccuuuaaccagcagccaucaacucuuucccuucucuuguuugcagcaucuuucucccaguuuguacagucauccauuuccuuguggacagggaauagauauuaauauuuuuauuugauuuccccacugucucuuucagagucuggcauauuguagaagcuuaauaaguacuuguuguaugaacacauaaguaaaugaaugaaugguaggaacacauaaguaaaugaaugaaugguguaaaucaagcuuguccaacacguggccugcaaggccaccugcagcccagaagcgcuuugaaugcagcccaacacaaauucauaaacuuucuuaaaacauuaugagauuguuuugugauuuuuuuuuuuagcucaucagcugucauuaguguuaguuauuuuauguguggcccaagacaguucuucuuccagcauggcccagggaagccaaaagauuggacaccccuggcaaucaagagcaugugaaugagaaggaacagagaaaucuuagugagucuuacccagaacagagagcuauuguguuugaaaauaggauuaaauagucauuccagagaacuuuaaguuugaugcucuaaaggaauagggaauaauucuagagucuuaugcaggauaaugagugguaaauacaguguucaaagaaauuugaucuggcauugauggacaaagaauagaagcaugaacaauaaaauguacaauuguuuguugguauccauaaaggauuaauuucagggucucucauagauacuaaaaucauggaugcucaagucccugauauaaaauggccuguuauuugcauauaaccuaaucacauccuccugcauaccuuaaauucucucuagauaacuuauauuacuuauuacaauguaaauacuauguaaauaguaguuauauucuaugguuuagggaauaaugaggagaaaaaagucuguacauguucaguacagaugcagucauccauuuuuuuccaaauauuuuugaucugcaguugguugaauccagguauguggaacccaguggauacagagucaacuccacuacaacugaccaaaugugugugugaugaggacuuaucauaaaugucuauaaaugaccuuauugucagcaagagcuaaacaauucaaaccuuccuccaagggauuagccucagccugcccauaaaaggauaaaucugaaaaauccaaugguaguugauuugaugugggaauauauuccuuauguuauugccagcucugauucaaguaaagggauagaaauccaauuaccuccuuucuuccuaggucgugaccuagagauaaccuauaacuaauuauucuguuaaguaucccugaguuagugcaagaagcaggaacaaaaagaauaaagucugagcgugucuaaaagguucuuuuaaaugcaacuuuugaaaauccaguuuaaaucuauaaauacuugaaauuaugucgauuucacuaagguuucugaaaaauguaucaguuuuuccugagaaugaguaauuuuguguaucugaaguauaaaaguaugcagaauaauauuuuuccucuuuuuuuuuuuuuuuugaacagcaaaacuuagagaguaaccucaccaaccuuauuaagaggaacacagaacuggagacccuuuuggcuaaacucauccaaaccugucaacauguugaagugaguaucucuguauuucuguaugguauguuucauaugaaaacugccagaucaagguuuugauauccucaugcuuuauaauuuuaaaacaagaaucuuucuuaaaauuaaauauuuugcaaaagccaaaauaaaagauggaggaaauuaaaaggaauuagaacuucagagagucuuucccauccagggcugcuucccauucccauuauagcucuuccugaucuagcauuacauagcaguccuaauguuggagauuuuaauugcccuuacaaagaacagucaaaaaagguauuguaggccgggcgugguggcucacgccuguaaccccagcacuuugggaggccgaggcaggcagaucacgaggucaggagaucgagaccauccuggcuaacacagugaaaccccgucucuacuaaaaauacaaaaaauuagcugggcgugguggcaugcaccuguagucccagcuacuccagaggcggaggcaggagaauggcaugaacccgggaggcggagcuugcagugagcugagaucgcaccacugcacuccagucugggcaacagagggagacuccgucucaaaaaaaagguauuguauuaguguacuauggcuaccauaacaaauuaccacaaacugggaaaguaugaaacaagacuaauuuauucucucaguuuuggagacuagaagucugaaaucaagauuuuggcagggccaugcucccuacaaagguucuaggggaggauccuuccuugccucuucccauuuucugguaguugcaggcaauucuuggaguuccuuggcuuucagcuacagcgcucuaaacccuuccuccguuaucacauucuccuggugugucucugaauauguguccaaauuuccuuauuguuauaaagagcccacccuacuccagccuuaccucacuuuaacuugauuacaucugcgaagacucuauuuucaggccaggcaugguggcucacacccuguaaucccagcacuuugggaggcuaaggcaggaggaucgcuugagcucaggagaccagccugggcaacauggcaaaaacccaucucuauuaaaaaauacaaaaaauuagccaggcgugggagcacacaccuguggucccaguuacuugggaggcugaggugggaggaucacccaagccugggaaaucgaggcugcagugagcugagauugcaccacugcacuccagccuaggcgacagagugagaccuugucucaaaaaagaaaaaacaaagauucuguuuucaaauaaggucccauuuacagguaccaaggguuaggacuugaacauaccuuuuugcggacacaguuuaaugcacugcagguguauauuaaugcaucuuaguugucagauauguuuccaugaaauaaaccacaauugcaacaacagcagaaccugcaaugacuacacugaauaaggaaaaaauagaugccacuuccuuuaugugauuuucaaauuccucuuccaucuucucccaaacugucuuuuuuaccaccccaccccaugaacugaaacuaaacaauuaucauucauuacacuuuuaagccuucuggcccuuaaccaagcaguucccucugacugguaggcccauuccucuaacccaugucuauuugucagaaugcuucuuguguauccuccaaguccuaagucaaggggcacuucaguugugaacguuucucugguucccuggaccagagucaucgcuccuuucucugaaucacguaacauuuuaugauaccguguaugugauucagagaaaggagagauguccccgccccaaucucaugucgaauuguaauccccaaugcuggagguggggcuuggugggagguguuugggucaugggggcagaucccucauggcuuggugcugauuccaugauaaugagugaguucucacaagaucugguuguuuaaaaguguaugacacuccucccccaccgcccgccccccucccauacacacucuuucucuugcuccuaauuucgccaugugacgugccaguucuggcuuugccuucuaccauguguaaaagcuuccugaggccucaucagaagccgagcacaugccuggugccaugcuuccuguguagcccugcagcacccgugaaccaauuaaaccccuuuucuuuguaaauuacccaguaucagguauuucuuuauagcaaugcaagaauaguaauaaucuucucauggcuuuaucauucuuucauguaccaguuccauuuuuccaaccagaaugugaggucuuagaggaugggaaucaaaucuaauucgucuuuguaucucacagacucugaugcaaugauuuucacacaguaggagcucagggaauuuguuuuagaugaauuugcaugaugacucuccaaauggcaaauuuugaacacuauuugaaugccugcaaguucagcuccccuaaaauaucuaaaguuggagaagcaaauuauuuugagcaggcauuuaaaaauuuugacaguaacuccauuuuugcaauaagaauuccuucaagucccuuugaucgucuacgcaguaauuauaaguuuauagccuccuaugugccuauaacugucaguagaugcacaauguagcaaauaauaauaaagauuacaauauguuagagaacaguguacacacauauaacaacauauuuaaagaacaguagaguagccaaucaggugcucagcuaguagaauauugcauuuauggauucuaagauuagcauuuuuuugaagacuaauauugcugaaauugagcugcaacuuaaaugaauggugagacaguuuaaugggcaacauuuguuuguuccuacuggcacacaaaauauagaugagacaguugcugguaucuuagauuagauggaguaugguuugagaaggggggauuaaaagagaaaaaaaugcgaauacaauuuuucugaagcuuuguggaagagucaggacuugagccaguucuuauagauuucacaacuauuauuuuucaguacccuaaguauugaggugucagcuuauuuaugcaacacaaugauguuugucagugauacauuccucagcauagcagaaauuagcaaagauugcuuucagaaagauccuaucaguguaaaagcaugucuacuaugcaaauacuggugcuuugguggaaggcuuaaaauacuuuguguuuguaaagucugugcuuuuacuuacaagugcuccccuugugaucagaaauguaaaacugguuacuaagagaaacacaugaguuagcaacuuuuuccaacuccaaauuuguuguguuuuccaaggauaauauccagggagacagaaauuagggauguucucaucuccuaccuaagccaucuacuccagcuguucaucauuugaggugcugauggagguuaugauagguggaagagggaaaggcauacaaaaggaaagaaagggaggaaucagaguaaaacauaggugagagagcagauuaggauuguccagugagcuuauugguucacuuaguagacccucuugcuuuaaaagcuacaugauugucaggguagaaucaguguuucaucauguugagaugaaguugagagugugaaggcagcaguguguugcagaauccagaccuuuugaacccucugcuuagacuggauucucuuuuggcaagccucuugccagggaacauguugagccuuguugauuaaacaacauuggaaauaauagugaacaagcauaauguuuucauuauuauaggguaaaguuaauauguauuauaugaauaaauggaugaacaaaauggaauaaucugugugccauauuuuauuuuuaugaugugauggcauuugauguuuaggauaguaagaaagaauuauuucucuucaguuaaaaaaaaaauuaccugagcuuuaugguaaaucuuauaaaugcuuuauggauugggugauuaugucauucaauuucagcuaguuacuccuuaaagcauuaaugucugguuuccauuaugaccuguugugauuucagaacaaaugcauugcuucuaaugcaauauuauuauggcuugaauuuacaagacgcuauucauccuaacaugauguaaaauuacauucuaagauguucaguaauuucaaaugauagauaaauugaagaaauuuacagggagauuuuaguuuuauuuuaauagaucagauaugauuuuaguugcaauacaggcuuuucaaauaaagcuauuacugaauugauuguaguggacuugcauuuacaaggaauaaagaauauucauucuuuucucuguuguuuuuguauaaauccuugggaauggaagcacauguuuaugggugaguaaauuugguauuugggaaauuuauucuagauaaaaauuaaagaaaauuaugaguacaaaaauaaugauacuuacaguacuuauuuuuacguuuguuuuuauuccuaauuauuaguauucugaaaguauaauuuucaaaaguugaacacccaauucuccuauaaugaaugaauuaguccacaucaaagauuuuuuuaacuucuuaaugaaggaaccagcaagaugauaaagcugcuuccaaggaggaugccagaaacggauacauauaaauguggggaaggggguaguagggggaaaagaaugccagacuagcauagcuaauuuggauacaaaacugguuagugaccuacagggcaauaaaccugaaacauuuggacaaaauaaguugcauauuacuggguuucucuaaguuaacaucuaacuucgcagagucuaagcccuaaccacuaguaaauagaaagucagacucuguuacaucccagucuggagagucagaugacccugacuuaggcugacuucauggaauaugcucucgugggacuuuggaagggcucacagucuucucuuucucuuuuuuccauguuuuggauaauuuugcuuaacaugacuuucuguucuagagacuguuggucuaggagcaguguuugcuaaacaaauauuucugggaggggauguacauuuuugccuguggacaguuacuuuaauuuguuacagugucuugcuaguuuguucauuuugguagugcgguuggaguacccacuguguguguguugcacuguguuaggugccaaaggacccugcccacaggaaguuuacuaucuucacuaagacagaagagcacuuauaacacaaaauaaaguagaaagccauaauuaccaugaagaagguguggauuaucuacuucaaacuuucagagaaacaagaaauuauuucuagcuggggacuggggaagcagcgcaagaucugagccugccuucaaggguagguaacauuugaguuuauggaagcagcacugcuugccaggcaaauaaaggcauggggauagaaagacgaggaauguauguacacaaagcaaguaguucauucuggagaaauggaaagcauggaagaaggaaggaucuguaggaacuaguuugggagaguugagagcuggaaaggcuuucguguugcaucugaauuugaacuuugguuuugaagguuuagugaggguucaaggaacacauagaccugugugaguuucacagugacaacuggcauuuccaacucuuuucaggaaaugacauuuuugguuauugagaaaauaauauggauauugucaugcaaaacaaucucauguccaagggaaaccuucacagcacuaggaaacuccaaaaaggccauggaguuuguuaggcaccagcaugcuauucuuuuaaaucagugcaguggaaaagaauuuccugguccacauccuugguuccuagaugguacuucuuccuuuuccucuuccugaagguguccuuguauuuggguaugagcauuccccgggaaaauaauucccaugccagcuggagcuaaaaaaaacucacagcacagaggcaccuccuaauuguuguaaauuaaaucaaugaauuccuucccacgacccaugaggaaaugccacauccuuauaaguccacaucucuucccagggauuuaccucugcuuuucuucagaauggaaaacaguuugaagguuccccuucagccacccaacucuccccaccccugccacauuguuuucauaacuuguuuuuuaaaugaggguaagcaaaugaauggcuuuuugauuguaagugccaaacauuuuuaaaacgguggauaacagagaauggcaugcuguggcucaugccuguaaucccagcauacuuugggcggccaaggcaggaggauuacuugagcccaaggauucaauaacagccugggcaauacagugagaccucgucucuacaaaaaauaaaaaaacuagacaggcgugguggugugcgccuguaaucccaguaacaaaggaggccaagacuggaggauugcuugagccugggaggucgaggcuacagugacccauggagugcaacugcucuccagccugggugacagagugagacccugucucuuaaaacacacgcgugcgcgcgcgcacacacacacacacacacacacacacacacacacacacacacacacacaagagcagaguaugaaggccaagacaguuugggacucaggaggcagagacauugaaagagcaacuucaggccaggugcgguggcucacgccuguaaucccagcacuuugggaggcccagguggguggaucacgaggucaggagaucgagaccauccuggcuaacacggugaaacccugucucuacuaaaaauacaaaaaauuagccgggcaugguggcgggcgccuguagucccagcuacucgggaggcugaggcaggagaauggcgugaacccgggaggcagagcuugcagugagcugagaucacacugcugcacuccagccugggggacagagcgagacuccgucucaaaaaaaaaaaaaaaaaaaaaaaagagcaacuucagguagacuccuaagaaauguuugucuaggauuguaaaaacuaauggguuuucaaccacucuauuuuguuuucuucaggagagaaauaagguagaauggaugaguuuguaguuacacuagacaaguuuggaguuaauuauauauguagugaaagacaagcuuaugagaaaugaucaaaauuugggucaccuguagaacuuaacuuuucuaggucagauaaggacuguaucucuucaucacauuucucuuuccauuuucuuugaaaaaucagaagacacaguuuauuagcuaagcaaacacuuggaaucacugauauguaccaaauuuucugcacauuccaauaaucaaguucuuuuacagcaaauacaacaccuugacacuuaauagauguucguuuuggaaaugauaggugccagugacucuaaagaugauggccaagaacaacugggaaaggguggccaauugccauaaugguuucaagaggauaaaggcucagcaguccuuaccauucuugcucaaggucauccuagaagggcauuuucuaauccaacaucacuucaaaguuccagcauuggccccuuugguuuaucuugccuuguuuguaaucacuucuuaaaauucuuuuugccauuauuuuucucacuaaguuuuuaaucuaucuuuguuguuguuuuauuuuaauggaaaguuugcucucauacggcuuucucugaguuucuccagugcuaguugucauguaaagugacaagguucuuguggaggaauuaaggcuguuuaauuagauuucugcucagaugaugaguuuuguaaauugaaaaggaugagagugagguguuacuugggugauauguaccuuguaagaaauuguagaaaaucacuuggcaaaacagaugggagucuguagaagacuuuuccaguaauucaccaagcccuaaaagcauucauuuguaaacuuugaaauaaugaaaaaucacuggguuaaaaagaaagaugaaccauuuguuuaauuuuguugugcaguuuuguaaugccaaagcauucucucuccguagaaaacuuggcaauggcuucauccggagucauuggaugaagaccagcaugcaaacaccaaacgagcuauuugugucuugugaacgugugucugaucuuggaugaaguauauccugcugggggccgacaugaauguccaaaguuauaauccauuuucacuugcagaugagggucagauucccacccgaucugacccccugugagaaugcuuucaagguauaauuagagucagauucugggccucauuaaaccacaucauacaacccacagucagcucuggcucuccauguaauaggcucuagaauuaugauaaugugauagugcaaauaugguggcuuucagaaacuggauuaugacgagccacuauaauaaugguugauuucccaaguucacgucuuaggauucccaugacaaaggagaaaagaacuguuggucugcacagaaauuuaucaucucuggagaagauuuguuuuuacuauugcauuugaauaaugucuauucauaugcaauaguaagacaguugaaacaguuuacucuaccaaguuuacuaaaauugacaacucaugaagcaaauguaguuuuucuugguagagguuaaauuuaauuauuaaaguaucuaacacauacuugaaugucucccuuuggauucagugcccuugacuuagaaaaauuugauucauaacaggcauuggauccuguuucuuucuugggcauauucauaaggaguaaugagaagauaucagcaaaaaucuuugaguauuuuggaaugagauuaaucuuaugaauaaaugaauauaaggcuuaguaagcugguauuacuuuuagaaugacauucccaaguuucaguuuugaaacuuuauauaaaacauuauccaaaccuuucaucgucugcaaaucuuucuaguuugggugguaugaccuauugcaucauauacagaauccuaccuaguggcucagauuggaguaugaacacuuguacgugccucugaagacaaacccucuaauguuugaauuugguagugcagauuuccaagguuaauacuuaaaugugaagcaauaggccuuaauuggaggcccaaaggcugagcauuagaaaguuagagagaaagugugcuuuuuucugauauaucuuauugugcucccucccuccacacaauacaagaauuccuuauccugucuccauuacaguauuccacacacaaccuucuuuaccuggaaauauuuacuugcgugauugacuagagcagcagagauguuucuggcaugauauaaagaauaauaggaacagguagugauacauuuuuuaaaauagccauuguuggccaggcacaguggcucacgccuguaaucccagcacuuugggaggccaaaguggguggaucaccugaggucaggaguucgagaccagcccggccaacaugguaaaaccccaucucuauuuaaaauacaaaaauuagcuggguaugguggcaggcgccuguaaucccagcugcucgagaggcugaggcaggagaauugcuugaaccugggaggcagagguugcagugagcugagaucacgccauugcacuccagacugggcaauagagccagacucugucucaaauaaaguaaaauaaaauaaaauggccauuguuauuucuaacucaacuuuuauaugagauggucuuagcuggaugguuucaggugaaagagucagaggggaauggaaugauugcaggugagaagguaacucucaaguaaaagcuuugguucacuuauugcucccauucaugacauucagaaacaagaauaauccuaacaaucaauccaccauuuuguuacugaaccaaccuuuuacuucugggucuaauaucuaguuuaaauuauuuuucucaauaaaugaacauaaaauugucuuccaaugacaaucaaguugaaauuaucucuguguauaaaauaauuacagauuaugaaagaagccagacauaucauuuuuuaccugauucgguugacuucuauuuuuaauuugcuaaauuaaauguuguaggaaaaaaugaagagcuuuguucuaauuuugaaauuccacagcaaaauaauugagucaugcauauaaaauguccguuaacaagaagacaauuguaguacugguuauuuuuguuugaaauagaaauaugaaauuuuaaauucagcuauuuaaaaugcccgaggcuaccauggaauguacaaggcucucagugaggagcaacacaaagauuuuuacaaccaagugagguaacuucuuggccuaggaauuuaugauagagcuuuuacuaugcuuuuaaaaguauuuucccuagauauaacaucaaguucauauauguaaagucgugaaaacuauauaguggucuaauucucugacaaggcaagcuugguauugagaugucauaaguucauucaaggaagccuucugucaauuuccauaggauugggaagguggugccuuguccaucuuugcagguguuggaaggggagcauuauugcauagaucuguuccaguuucacagcaacacauagacuguaguguaaagaaagaaaaagugauaggacuuauguagauaugcacuacaagcaguuaugaccaugaccagcucuuacugucacuuccugauuuaauuaucccaacagucuuuugacauaaacaucauucaaauaaccacagauacguggccugaagccagauauaacaagaaucagccaguaaagaaauagguugaauuuaaccaaguaauaaguaacuggaguuguuacugaacccaaaccaggugauuagaaaguuagauucccaggggaauucucauuacaagaaccaucuuaucagauagguaauuggaaacccuguuaaacccaccauaacaaaggcucagcaaguguacaucugcagugccaguacaaucagugagucuucaguucuuaugaacguucugaaaucuuuuauuauuaaccauugacccucuaaccucaacuucuuugagaugauaaauuuguuuccuuuaguaaauaaguaaauuccuuuuuuuccuccuucccaggaaguuugagauucauguauaaagaugaagaacuaaauaauacuggcugagccacccuaauuugaaaauccaaaauccgaaaugcucuaaaauccaaaacuuuuucagcacugacaugacgcgagaagaggaaaauuccacacacaaguacuuaacacaaacuuuguuucaugcacaaaauuauugaaaauauugcauaaaauuaccuucaagcuuauguguauaagguguauguggaauguaagugaauuuaguggucagacuuggguccuauccccaagauaucucauuauguaugugcaaauauuccaaaauccaaaacacuucugguucuaagcauuuaggauaagggauacucaaccuguagcauaaaaucaauauuuuggguuaugacugggugcagugacucacaccuguaaucucagcacuuugggaggccaaggugggaggauuguuugaggccaagaguuuagaaccaaccugggcaacauagcaagacccugucucuacuaaauaauuaauuaauuaaccaacugugaguggagguucuugccuguaguccuagcuacucaggagucugaagcaggaggaucacuagaacccagaagaaguuggagauuacagugaucuaugauuguaccacuggacuccagccugagugacagagacagagacccugaacuuaaaaauauauauauauuacaacuugggacugaaauauuuguuuguauguuaauaguucauagcauuuaagauaauaugacauauuacagaaauuugacagauuugcuuugaaaugcuaauuugaaacacguaauuuuuuuuuuuuuuuuugagauggagucuugcucugucacccaggcuggagugcacuggugucaucucggcucacugcaaccucuaccuccugggguucaagugauucuccugucucagccuccugaguggcugggaucacaggcacccaccaccaugcccagcuaauuuuuguaucuuuaguagagaugggguuucaccauguuggccagccuggucacgaacuccugaccucaagugaucugcccgccuuggccucccaaagugcugggauuacaggcaugagcgaccacgcccagccuaacauguaauuucuuuuagaacuguuauuuuaaguuggaucuguaagauaguuuagguuucaaagcaauauugcaauguucaaaaaaccuuagguuucagcauuuucuuuuuuuuuuuuuuuuuuuuuuuugagacagagucuugcucuguugccaggcuggagugcgguggcgugaucucggcucacugcaaccucugccuccuggguucaagcaauucuccugucucagccucccaaguagcugggauuacaagugugcaccaccaugcccagcuaguuuuuguauuuuuaguagagaccgggauuucgccaaguuggccaggauggucucgaucuccugaccucgugaucugcccaccuuggccucccaaagugcugggauuacaggcgugagccaccacgcccggccuggguuucagcauauuuuuuaaguuuaguuuauuagauuuauaagagcuacuuaaggacuugggaagguauaacguguuaggauuuuaauuuuauccuguuagcauuugaagugcuuauaaaguaaaucaaauguguuaaauugauaaaugcaguuuaaaguguuacaggaguaaucugaacagugauuccucauaggggugaggauugaccugaagagcggcucgaggguacuuucuagggugauagaaauguuuuaugucuugauugagcugucgguuaucaaaauccauuaaacugucccuuaagaucuaugcauuuccuugcauguaaauuuuaccgcaauuuaaaaauauguguguaggaacuuaaucagcuaauguauagacagaauugauuguuuaauggaguugagucuauucaacuugaguuaaucaaacauugauucaaggacucccgagagugauuauucuugguuucauaaaauuuauuagauguaugaauagaauaaugagaucauaauuugaacuuaaaagcuuaagggaaacuacauagugaauuguugacauagaugcaguucuugaacaaaaaucuugauggucuguaagucugugucuauuccuucuccuaguugguuggacuccuggguaaauaggacagucuuccuaguaugcugcguuuagcaugcagcacuugacuauugaugagugaauggaacaccucuagaggccaacuacaucauccuucuguccuccuuguagcacuagcucauuugcauagaucagcauguccgauaagcucacaccuugaagggcagaaaggacccuucuugagaagacuguacacagcacuguguuuuuaugacagcaaaccucaguagccacaaaucccuggaggaucaguaaugcuagugcacacaaggagcucccucccagccugagggcucugccacccagguagggcuaagaggauggaguugacaaagggaagucaaaaaugagagagcuguccaucaggaguguugcugagcccugaauagagaucgaucgaggugggucuuuccuucccccuuauuauaaaccuguaccuuuccuuuuauucucuaggauaccuucucuaucuuuucugguuugcaaaagaaaaaaauaguuagauagucacuuugaaucaggcuugggaaaacacuuauaaauaauaauuccacacauguaagauggcuaaucaaccuaggucugaaaaugacuuaacaggaaaacauuuucaauaucagucucucaugauucccaaacacacacacacacucacaaacucaccacaacuucaaaauuagcaaccaaaagacaucuaaaugcugugaucuuuccuuuucucuuccagaucagauuagcuuugcucuucacuguccuuuugucaaagccccuauuguacagcucuccaguguccuuccugccugcccuucuacugccauuguaacuuuuaccagccccacuaccauuucagaagaaaacuccaggaaagcaaguaagcauggauagcuuuaaagaucaaugcugaaggcccacuaagaccaggauacaaagggagucaauuagaaaaaggugggggucaaggaagaacuccccacucccaaguuaaacuccucaauuugcuguuuuguuuuagccagacucuauggagcucagucauggcuagcucucugcaaauggcccccaaaaggcuuuucacaaggggcaguaagauauaacuggcuucgguauuucugucuccccauucccagauaaccaauucaagaugcaugcccacuguacccugcauguuguugaaacagaauuuuaauuuccucugucuugcaaaaauguucuuuugccucucuucccuggugccuuuucucaucuuccucaccccuggguuuccuaacucugucuugccuacucugaucuccaaagaccagucucuccuucauauuuggcaugaaaccuuccucagcuacucacacaguaauugccucauuucucaaacucuccagagucacaucauccaaucaaaguacuguguaaugugagccacauauguaauugaaaaauuuucaaguaaucacauuuuuuaaguaaaaauaaucagguaaaauuaauuguacuaauacauuuuauuugaccccgauauauuuaaaauguuaucaugucaacauguaaucaauguaaaaaugauuaauguaugcauuucauauucacagcacaucucaauucagacuaaccauauuucaagugcucaaaaccacaaguggcuagugguggccauauuggaccacacagcucuagaacuucuguagcccaugguuuagcaguuaauuaugugugcacuuggcauguucgcugcuuguucucuagugaagucauucuuucuagcaggccaaguucuguuucuaccacagguccuagcauggugcuuugcacauugugggcacucaacaaaucccuaagauuugcuucauagaugaucccuguacauugauagcaucuuccucauucauggaauaacaagaaugaccucaucuccucucacuuucauuccuuagcuacuaacacuguugcaaagaucucuggaaaccggaaacuuuggucaccuauacuuuaaauggagagagaaguaaaacuugcugcugagaagcaaggacugcauagaagguuuaguuugcugguagaaucaaaauaagcacugaaugaagaugugugugguucccaguuuuauaaauagguuuugcaagaggagaguguuugcuucuuuguuuuuggugcgaaacauuucuucuuuuagcauguuaucugaaaguauugcugccaaagggaugauuugccagagaaagaugguuucuguccaguuccuucauaugucaggcauaaccuccaauuaaucugaaugaaagagugggugcccaugcagacaaugccaacaaaugccccuguagagaggacacauacagaugccaaccugaaaucagacacuggcuacugaaacaaaggauugcuuuaauuuuugcagaauaaacuauuuuuuucuucugcuuuucacgaaguggcccuaaagaauuccucuuguuuguggucucgaaaaaauuagaacuaugccaaugaggccugccuuuaaggguucuauuaaacaauaagaaggcuuuguucuuggcaauaaaauuaaagcaagcaguguuuccauuaccuggcaggcugcccucucccuucccacaacccugaccccgauccugacaaaccucaacagaccauucuguuucccagguaggaagguuagaugguaacaucugucagguuuguuuauagaaauauaguugaccuuaaugauaauguauaaagagggagagaugggggcggaggggggaggaaaaaaaggggguagggagagagagggacacuucuccaaauaauccuuaacucaagcuuuaaaaaagucaaguuuacugcagaggcuucaaguucucaaaccauuguuccagaaagacaauaauaauuucacaaugaguugaaaugauggaaguuaggagucacuagaugaggaaauauacauuuuggucugacacgcuagaugucacguguuuucuuuuucagggaacuuugccuaccauugcucaaacuuagacccacuuacagucaguugcaaaugagugcuuguagguagauugugacccugaagucaggaaugaccaaggccaguacagaaagcacuguccgaugcaaauucuguuuagccccacaguuagucacaagucauuggaacugaaaaauuggaugacugugaugccagcucucucuguccuccaugagagcucaaaaugguuauauuguagucuccucuaguguaagagcuccugccuacagcugucaaggccauacccauauugcacucacagguccuaucucccuggccugggaacuuuuucugccccucccaggaccaacuaauuccaaagggaaguuaaugccuaccuucccccaacagcuuucaaccagcuccugaugggagauguuacauaaauacucugcuucuucccuauuagcuggaauguucuguacuguuucccagaguugcccaaugggguuaaucuccaguugcccaagguggucuugguaagucacacuuuacuggcuucguaguugucccuguuucacuuccuacccaguacugguguuuucuggcaacaauuugaccauccauucuugucucauauccuucuuggggaggauacaacugccaaccaugucuaaaaugaaaugauagcacaagucucuuuuucuagucauggcuauagcucacauguucaauuucucuaaacucaagucucuuucauuguguuugaauaaacguacaugugaaucacuggacaucaaagauauuuaaaaaucaaucuacucacuucuccugauauucuagaaugacaacaacagggcaagauauuucauagauaucacuugugggugcgucaugaaggcagaacaaagcuuaacauuuuccaguuguaccucccaguuaaguucuaucagugacguaaucacguguauuucacucacuguacggaauaccaaagagcagaaacccaauguucauuuuccagaacuuugcagaagcagauggcuucuauaccugaguaacugaaacccaaaaagggguccaacucaguauuuuuccaguacaucacuuuucaggaaucauggcacaacaacuaaaaggaaugucacuuaaugagaaauaacauguaagauugaaagugauuaagguaaagucauagaguagagguuuccucuuuccauuagaaauaacuucccuucccuuaaacacgucaccuccaucuuuccuggcacuccauuaauggucaucugcuaaaaguuauuguuuacccucugaccacaacaucaaaugccaaacacauuuguugaaaauuauuuaauagaaaucgcuacuuuucagaaacuuuaugaaaaagacgugauagagacaaacacccauggcagguuaaguagauuucuuuucauucagugugcccagcccaaacggaagggugugaagcauuuguuuuauaaaguguguaauuaauaagagaaaggaagggaggaguuuauuguuuuucaaugaauuaugagcaaccccuuccauucugcuucuucauuuuggaacugcuucuaacaaaguuaccauuaaacacaaaaagaaaaggcugugauauugaugccaagaauauaagauugaagucaguugaguguagccuaggaaaaacauuacagaaggaguaacauuuauuauaauugugacagaagucagcaggacaucauggggaaagugaaaaccauaccgcaaguauguugucauuuucaaauugaaauuccauuaauucaguacuuguagcuauucaugccuuaaaagaagaaaacuaauauuuauugagcaucuacuauguaccagauuguuuacagauauuuucaucaaaaguaugcaaaugaggaaacauucucacagaaauucaaauauuuuucauaccugcaguccucugaauauaaaguccaugauuuuuccuuuaugccagaggucagcaaacugugacgcucaugcuaaaucugacuguuuuuguaaguaaaguuuuauuugaacacagccacguccauuugcauccguauugucuauggcugcuuucacacuacaauagcagaguugagaagcugcagcagagaccgucuggcccacaaugcuaaaauaauuacuaucuaggccuuuacaaaaaaaaaaagucccccaacuccugcucuguaccacggaagaauguucucuacccuucuucuucccccauccaaaauugcaucaggaggcagccuucaaggaacccaguuaggauuuaaaaguagcuucaaaaauucuggaguuaagccucauguuauagcuuccaaagcuauuauuuugaugauguagaugcaucaaaguuuugauucaugcuagaaaguccucagguaaccagcacaggcugacugguccuagaaccucuaguuuuaauuaucuauggacauuccagauaaaaagaguuuguuagcaauagugaucguucacauuuauguaguaauuauuacaugccaagcauuugucaagggcuuuucauguuuucacucauuuaguucucaccacagucuaacccagggguucucaaucuugacacuagugggauuuggggauggaccuuucacuguugugggggcugucuaauguguuguaggauguuuagcagcaucgcaccuggucugccagguaacaaauguuauuuuccucauuaugcagguagggaacuugagauguagauaguugaaguaaaugcccaauaacauacaacuaguaagcaauaaaaaccugguguuucaaucccgggaagacuuccucaagucccugaaccccaaaccacugccuccauuagcccuugcucccucuaaauuauuuuaccuguuugaagauuuugcuuuacugaaaaacuaacagcgacaucaacaacaucgugaauggccauguucuguaugcuacuauuggaaguaaaacuccuuuaugugaaguuucaaaguuuuaggcauuagcaauggcauuuuuugcuaggcaguuuuauugccuuauuacaguuguauuucauucauaagaaagaauuuaauugcucuacucaccacaguguguugccauuuuugauagugucuugcuuccuuguccagcacucaagcuucauaaucuuagaaaccucaagaaaagaggauuuaucaugagguuccucggagcuauuuuuuuagucccauagcaaauucccaucuggauaaucaauauguagaauugaucuccucugguccaaauaauuuuccacuacgucacuaugcuaaagcaggauuacauguagcuucuaguuguaucacuauaucacugcuauuacuucccaccaaaagcacuuuaugaaaggauuccauuuuuaauuuuucugaaaagccuuucuuggaguuuaaaaagauuugaucaaaaauguuaaauauuaaauuaacacauuaaacauuaaaaauauugucccguacucugguuuguccuccaaagacagagaccucaggagccaggccauucucucucucucucauucacuugagccagguccacaaguauuugacuuuggugugaaagaguuucagagugaagauuacauauaaacauaucagaugaauuacgguaauauugucugcuguuccucaauucuccuuggcucaguuuuauauacagacugaaguauuagaaucccuuucauuguuccucuggcagcucugucuaacuuuugccccagagucuggaauguucaucacagcugucuuuggcaauaaaacccaaagcacccucauaucaucauauuucuuuuugcaccuggucagugguacacagcgggguguagagcccacuugcauacaguuuucucccuguacccucauccacaggccaaauaucagcuuauauaaagcucuguuuuguuucaguuacuucagccuugggcaaauuggaauuaacuccuccaauguuuuuccuuuggagugagaugggaugguuaugccacauuauguaguaccacuaaccccuucgaauuuggaugcagacucaaaauuacauauucuuaguuauagagaaaaguccuuuugagucuaaacaauaacaagaacaucaaccuagcaucauguauaaaaauguuucagccuuucucaagaucaccuuaauuugugaccuuggaauggaaggucacauuuauucaccguggcaugaaacagcuuuuguuuuugccaugaggccgaaucuaggcaaacuuguaaaguagacauuugucuuuuaaacucccaacuccuugguaaugguuucaaagauggcaagguucagaaucuuaaacuaaaggguucacaguuugauggugcaauuucaagagugcaguaauggugggccggggugagagaggcacaacucaaggggucuaccauucuugcggaauucaaagugaauaguagccuccggauuugugcagugcagcaacccucuucucaacacccagaaauagaauauccugucuccaacacguugggguuauccugucccaagcuuacuucaguguuuccgucuguguacgaauaagaagugauauaucaagucagugugucauuuucacaagaggaauuauaaggcuguauucugaaagucuauggauggcuaacuuauuucaauaaagcacugcaaagugagaaaaugagaguuucuaaaaugcaugcuagaucaauuucaccugugaaaacuggccagauauuuuuuuuccuucacucaugcuccauccuaagaguuccaaauauuucuaaagauuuuaagcccacacaugucugaaaucuaaugauguuuauacucugcacugaacaucucauuuugcaguugaauacaagucaaauuaaaagagccagguuuuagaaauaauacuuaaaaaccacuuacagacugcuaaagaacauuucacagacaccuaguccaauuucuaguauauguauguaacuaaaucccuuuaauguuuauacauauaugacaaggaaaaaauauuuguccucuuuaccccacccauuccucaaaacacuguaacacuauuacaccauaaaacuuagcagggagacuuugggcguugcuaaccaagugcccucgagaaaauagcuaauccauuuaugucaucauuaacuaaucuggggaaugauuacgcguaacugcauuucuagaaagggaagguaaaccgugcacccaguagcaacuuacaugggacugcaacugauuauugguggcagauaugagcauuaaugaagccgagugacccucaaugcugaauuccaucucaggacuaggcaggccagauaugauuguugugcuucuacauucacaucauuauucaauuuuguaauaucucuuucaucagacuguaaaggaucagaaagucauuggcagagagaagcagcaguauuacccuaggaauaggagaaagugggucagcaacucccuacaggcaagacugauggggagaagaugcauuucaagacgcgaaagaaaacugacucuagauguagagaagguaugugcugagcagaugggugaggucaaaaaugagaugaggugaaagugacugaguuucucauacuggugggcuaaugugauauuugcucaugaguguacuugaggugagaaaaaaccauaguauugaggagccuagccugagaucucggcucacuguaaccuccgacuccuggguucaagcgauucuccugccucugccucccgauuagcugggauuauaggcaugcgccaccacacccagcuaauuucuguauuuuuaguagagacaggguuucaucauguuggccaggaugguuucaaucuccugaccucgugacccgccugccucggccucccaaagugcugggauuacaggcgugagccaccgcgcccggccaggaaggccuaauuuuaagcuguauuucauccugagaagucaagugccccauuuccagugugguccaaaggcaggagacaguaauuacccaccacuggacaucauuccuaauuaucuucaucucacucuugccguuaguuuaggggccaaggaggagacugauggcacaaaaguggaaagaagaguuugaacuuguuuucugcauccuuagauuggcccuccucagagcacuuccaucagccacaaugauuucugaaucaaaagaugugaaucagaaaugaaagcaaaaaucauaaccaggagcugcuagcuuccaaaccaaaccugggaacuagaaacaccagaacauaacugcaaguaaccaauaaacccugccauauuugaacuaauagaaauuaaugagaaaguccaaucaaaucguuaauucuuuguuuaagugacacaugaaacagcaaaacuguggaaaacuucuuuguaguagaaaaaauucugaaauauagaauaguauuuaacuuguuuuauuguaucuuuuggaauauaagaauacuagaguuacaagaauuuggaaauucaucaaaguagaaaacaagauucaacuucccugguuucaaaaggaaagcuaaaucuguauucucugaaagaucuaggaaaaauacuuggccuaaaaugaauagauccuguucccaaauuucuaggaauuuacauauuggggugauggugauugugauaccaguuuucucaaaacacauuugccucaacaaggaagauuucagcccacuuuuuugguaaagcaaacauauccauucuguaaaucaaauagucaaaauuuggauuaaauugagccccauauuacaauggcaacugggauacuuuuucuaccaugcaguaacucaacucccaaugauugugagagugaauggacccuaaacuaaaucauaaucuguuuacaaaaucccuucucaaugcagacaacaguaccucagauuugucaauggcuucauaaguuuagguguuucuucauauauuauuucauguauucaccacaauaauuccacacggcuaagagagcagauauuauucagcucauuuuacaaaauaggaaaacucauaaauggagauagccuaagauuuuccuaaugucaccauguggguauauuacacaccacauuucauuucacagcccguacucuagaauuagcaguggguucucacuggacuuagucaaagccagaagagcuugaaguguggaauauguuagugacaacauuaaaacuugaggaccucacaauguggucaauugauuuuugacaaagguucucagacacuucagugaaagaaagaauagucuuucaaaaaauugugcugagacaacuggcuauccauauaaaguuagaagccuacccucacaccauacacaaaacugaccucaaaauggcucauagaccuaaauauaaaauauaaaacuuauagaggaaaacagaacaguaagucuccaugaccuugggauaggcaaugguuucuuagguacgacaacaaaagcacaaguaacaauagaaaaguagauaaauuaacuucauuaaaauuuaaaaauguuuugugcuuuaaaggguaucauaaagaaaaugcaaagauaacccacaaaacaggaggcaauauuugcaaaucacauauuugauaagggacuuguauucugaauauguaaagaaauaauacauucuauuaauuaaaagacaaugacccaauuacaaaaggagcaaaagauccgaauagucauaucuccaacauagauacacagauguccaguaaguucacgaaaaagauggucaacaucauuagccaucaggaaaauguaagucaaaaccacaaugaaauaccacuucacacccacuaaaaauaaaauaaaauuaaaaagacauacgauaacaagcauuaacaaggauguggagaaauuggaacccucauguauuucugaugggaauauaaaauaaugcagccacuuugaacaauagcuuggcaguuccuuaaaacauuaaacacaguuaugugacccagcaauuccaccccuauaucaaagaaaaaugaauauauaugggcacacaaaaacuuguacaugaauguucauaucaauauuauuuauagugaacaaaaacuagaaacaucagugugcaucuauuaaagaagagauaaaaaguggccuguucauacaaugaaauauuauuuggcauagaaaggaaugaaguacugauaaaugcuaccacacagaugaaccuugaaaacauuaugcuaagugaaagaagccaaacaaaagauuauguauuauuugauuccauuuauaugaaacguccagaacaggcaaauccauaaagagacagaaaguagacuagugguugccucgggcuggagcuagggcagguagggaaaauguggagugacugcacacauuauggguuucuuuucugggcacugaaaauguucuaggcuuagauugugaugacgauugcacaugaaaucaucugugaauacacgaaaacccacaaaacugcacauuuuaaauggacaaauuuuaugauaugugaaauauauuccaauaaggcaguuuuaaaaaaucaauuccuggccaggugcaguggcacacucuuguaaucccagcaguuuuaagaggccaagguaggaggaccacuugagcccgggaguuugagacuagccugggcaacauagcaagaccucgucucuacaaaaaaauacauuuuaaaaaaauuuagccgggagucauggcauaugccuguagucccagcuacucaggagacugaagggggaggauugcuugagccugagaggucgaggaugcagugagccguuauggcaccagugcacuccagccugagugauagagcaagagcaagacccugucucaaaaaaaaucaacucccuuccucccucccccucaaauaaaacaauccuuaggucauaauuuugugucuacacaguccuuggaaaccaauccauuaccugcauguugagugauuacuagugauaacuacuugcuccauuacauuuuugcccugucucuucuuggaaggucauuuucccuauuuauuuauucaacaaauauuuuuugaaugccuauuuugugccagacauggcaccaggugcuuggaauagauaccuuauuuaauacaacagcugaagaucccugcccauauggagcuuacauucuaucagauuuaacucguauucucaaguacaacuuagcucuucggguuuauucuaguagauacuuuucaaguguggggucugucaaagaaaaacuagagcuggacaguaguuaaagcuguaaaaacauuuuauucaggacuauuguaauaaggggaaagagaccucaguauagaaugggacucaacucccaaugucacguggaccaguggggauuuacagccaaggagcagggugaugauaaguggauggaaaauuacuaagaggaaacaucagggguaagggagauucugguuaaacugaccuaaaaggauucuugcugaagguaggccaaguugaucagacauccucuggggcauggugaaggaugaagaacccaaucagauacugagagugaucagauauggagauggaggauucuggcuaaaccaacucagcaggguucuugcuaaaacugguuuacaagaaagugcgcagaagggcccaggagaaaguucaacacuaaaguuuggucgagcaaagaagcuucgucagugcuacuuucuagaaauuuuacuuccuccaucauaaugugcucauguuaucaauauggucccauccuuuucauaacucaguuguagucaguuauuaaauucaguuugaggucaaaaggaaacagaagaaauuuacugaguguaaguuucaaguaaauaugucaauagcuaaauuuauuugagaaaccucaaggggagcuagaaaugaugacauaaaaauaacaauaagagaaaugaagccuaaugauuauccuccuugaaauauuagccugaguuccacauuuguacuucucagucaaugcauuuuuaauuuuucucuuuguucauuaaacaaauacuuagcaaauaacucugucugcuaaacugauguaggacauaaucucaugguuuacugcaaauggccaaugacuaucaucuucucaauaagaugucuugaguagucucuauguuaugucugaacaaugaucaggaauaaaauucaaggaauccugggccucuggaaacaggacaugguuucugugaacagccaucaguggauuuuuaucuugaacucaugacccuacuuccaguuuaucucauucauagagaaugaaauuacuccaauuaaagccuuccaaaucaaaaaggcuagggacugggccaugucuccucccugagauaugcuagaauaaucaaugccauugucauucuuuguaacauugcaacuucuccuguggcuguguuaaaauaauaaaccucaugccugcuaucuccaucucucacagcugugguuucuggguuucuguuugugaauaagcauuucagaauugccaugagauggaggaaauagcaugugcagaguauuucccaggccuaguugccaagaaugagcuaauuguaagccucccuugaaugcaagucacaaaaacuucaaauacaagccacucuaaugauccaccuuuccacaugaauguuaugcuuucguuguagaaccuugaucuuucagaaguauacuaggaguauaauuuuaaauuaugucauaagauuaauaaacuauugaaccaucuuuuugugcuuuuuauguuuuauagugauuagauacaaaauugauguuuguauuuaagagaaaugucaaaugugauacaggcuugcuacauugcuuacggaaaauuugucuaaaagagauugauaguaaucuguccuccauaaaagaauaauauugauuuuuuuuaacuuacuuuuuuuauguuuaacagggcaaauuugauacuuuuuaaaaauauaaaaguaggaauugcaaauauauuucacaugacacaucauuuuccaacuaauugguaauggcuauguacauguuauguuaaagauucugcagcugagucuggcuuaguagaaaagacugcugucauuggauaauaauguuuuccaaggaugcaaauuaggaaguggccauguaaguccuauauuugcaauccuugcguaaucggacaaagaguuaacauuuaaaauaucuuuucagagauuacuagaaacauccuaguauacauuaaaaauagcacuuaacugaaaaacaaaggccaaauuaacacuuaccauuguacuuauccuguaggucaaugcaucacgucaagaagccaaauugacagaggagugugaucuucucauugagaucauucagcaaagacgacagauuauuggaaccaagaucaaagaagggaagguaugauuucuagggcagaagauuucauauucucuaccuggagaaaauaaauccuaauacacuccagggacuuuggaaauguugagaacccucuuuuucuauacauucuauaauucccucuuaagucuuuaagacuuaguuaaaaggccuuugcuuggcaguuuuuucuccauccuuuucuuuguacuauggucuccugugaagaccugugauacaagggcugcuccauugcccagcgccaggagguagcauaaaggucuugucuaucauggccauuguuuucuaucucacuugucuaugagaagguggguucuguggaggcagaguuuauuuuguauucauugugauauccuagaaacuagcauagcauuacauaaauuaaaaaugaaucugacuuuauuuauagaaauuaugaaguacuuucccauguuuuugaggaaauguauacagguauaacuucauggucccaaaaccccugggguuucacuauaucauauacuccuuuguggauauaguaauaauacuucuuuucuaauguucuaauguuucuauguuuuaauuuccuauuguuuuacagcaaacuauauuuuuaagauaaauugacauacauucuuuauagcugcuuucuuauuuauucaaaauucauucacaaacuguuggucacuuuauaauccaucaguuuauucuauuuuaaaauuagucauguuuuuauugaaauacuuaugauccuuuuaauuuuacccaauucucugccacauucagggauaauuuuucuuucuuuuuucuucuucuuuuuuuuuuuuuuuuuuuuugagacagucuuuaucugucacccaggcuggagugcaguggcacgaucauggcucacugcaacugccgccucccgggcucagacaauccuccugccuuagccuccugaguagcugggacuacaggcaugggccaccacaccuggcuaauuuuuauauuuuuuguagagacaggguuucaccauguugucuaggcuggucucgaaguccugggcucaagcaagucaccugccucugccucugccuccuaaaaugcugggaugacaggcacgagcuacuaugccuggccaaggauaauuuuucuauggauuuuuaaaaauagaagcguuuauuuaugauccaauaaauucauccauuucuauuauuauuguucauaguuguacuuuaaaacaaaauauauauaauuaaaacauacuagcaaguuuuaagugaaacacagagauaaccguggcuaauguaugugguuuucuguguuuuccacaaaauuuaacagguaccuucuaauauuguacaauguuuuagauuacucugucuauauagauuacaaaauauuuauacacauaaauuauuaaaaugaucuaaaaaauagugaaaucaaauaguuauugaugcugguauaguagauuaacagauuaacaugaaauuauucccuggccaaggacucacaugugccgaaaagcuacuuuuccccacauacgaauuguccaauuuagaagagcacugaguguccaucuggaauccuuacaggauauauuucaucuuccaucaucaucgugcaucauaggugcacaucucuuaauucuggaaguauuccagguucucagacacauggccaccugaaguacagucacaauuaauuauucauaugcauacagaagguaauuugcuaucuuuacaugguugcaugcagagauuagcucucaguacacauauuaguuuauuuucauuuuuaauuuuaaauugacaaacauuuauauuuauggagugcaaagugauguuauaauuuauggaugaaauauggaauaacuaaaucaagcuaauuaacauauccaucaucucaaagccuuuucuuguggugagaacauuugaaauuuacuugcuuagugauuuugaacuguauaauacguuauuauuuauuugcuguuuucaccaugccaugcaauagaucucaaaguaaaaaauaaauaaauaaauaauuuuuuugaaaaagcacuuccucuuccucucuaauugagguuuugcaccuuacucuuacuaguuucuuauugcugcaauaacaaauuaccuuaaacuugguggcuugagacaacauagauuuauuaucucagugugcugaaauucggaaauccaaaaaucgaucucacuggguuaaacaaaaucgacagucaagguuuuggcagugcuguuucuuucuggaagcuuuaggggaaaauccauuuuuucuugccuuuucuagcucuuacagguagccugcauucuuuggcucauggucucuuugcaucaaucugaccucucuucccauccucacgucuucucugacacaggccuuccugccuuucucuuauaacgacccuugugacuacauugggauuaccuggauaauucaggguaacauccccaucucgugauccuuaaucaugucuguaaagucccuuuugccaugugaguaacauauucaaagauuccugagauuaggaugugggcagcauugagagcccuuauucagccugcaagggcacuccaccacaacuuccuggcuagcuugccuucccuucucuuacuuagcuuggacuucccaccaccaggguuucucucaugagcuagaucagaguagugcagguguccccaaguuccagccauagugaugcauggaguuuaugcuucggugcacucguucuaccccaaauacaugucaguaauaaagaacuuaauaaaaugcaaaagcaaagacauauagcugaaccaaaaacaagauaaacaucuccacaggccagaaaugagacaaaacugaaaagccaugacuguggcugaggauacaggcuacugggauuuggucuggaagaggccaaaguagcuuuggcuuuagcuccuguggauaaauaguucuugaagcuuuggggaaaggaccuagaagugcuccagaugggauggggaauggaaaucaggcucauuauuuaaugccaugggcuauagaaggcuucaugcuucagucaaaaauuauugccaaccuuucccucauaucauagcuuuuagcaaagucacauuguuagcuugaagccuguguucacacuguuucugauacccacacagaacaggagcacagagauaaggaugggauuccugaauaaugaccucaagggccaggugaaggcaacuggaaaacuaucagagcaggguaggcugagcaaggagggugagagaggaaagaauuauaaauuacuucccuuuaaaacugaaacucuaaguuuaauuucaaaguauauaaagaaaucuuaaauuucuaaacauacagccagcaaaaucagcagacaacauuaucuuaccccagauaaaauuaauuuuauaggaaaauaagaaaaagacuuuaaaagaaguagucuuaagauguucaaagaaagaaaugaaggaauaacuucucuuucaaaagagcaaaaaaagugaagccacaaaagaaggaaaugaaauaaaaaaauagauaggaaagcaacaaauuagcaguuuuggagggaaaaauauagauauugaaauuagaaagaaaacucagcugcaguggaaauuuggaaacugaguuuuggucaccaccuugggaaugccauaaaacgcauucuuuuacgucugagugacauuaaaguuugacaaaugccgacugaguuugaacucaaaagauaggaaaguauauaggaaaaccuacacauggggcauuuuuaaaauaauaaucaugcacuugguugaaagcaaguauuucagcaaauuucaaaaacugaauaccauagaacccugccucuaagaccacacacuguaucucauuagauauuaucaacaauaaaauaauaguuucuauaguuuuuugacacuaaaaucuauucauauauaaauauaucuucacaguaauauuuuuuaaauguagaaguaaaccacaguaaaagaacuauaauauaucauaaguaguaagcagcaaaaaaguaucugaaggcaaacuuacaggcuuuaauucuuuugaaaaagaggcugggcaugguagcucacaccuguagucccaacgcuuugggaggccgaggcaggaggauugcuugaguccaggaguucaagaccagccugggcaacacggcaagacccuguccccccacccccaaaaaagguaauacuaaaaguaaaaaauuagcuuucaaauaaagcuagaaaaagcacaacaggauaaacccagugaaagcagaggaaagaaauaaaggaagaaaaguaaaugaaagaaaaacaggaaacaaacaagaacagcugucagcaaagaacaacucgcagccuaauuuugaaacaucugugaauaaaaaaagugccuuuucccccauuuuuaaaagguuguuaaaaaaaauaaagaaaaacaauauaugugugacagagacaguauguggucuucaaagccuaaaauauugacuaucugguccucuacaggaaaaguuugccagcccuuaaucaggaggaguuuuacuuguaaaaaauaauuuaaaagaccaaucuguaguuaagguugaugaaggaaaaaagaguguggggccccauaaacaaauauaccauaaauacaguagagacuuuuuuaaacauaagaaaauuguguaaaugucuucaugccaauaauuugaaaacuuacauaaagaaguagcggaaaaccugaauaaaccaaaaauuuaaaagcagaagacauuuaauaagucauugaaaauguccaucaacuugcauuucugccccaaaauggcaccagccucccacaguucuauagcuuacuuuaacagaaguuccaggaacuaauaaucucauucucauauaaacuacuucagaaaauagaaaaaagacauuuuauguagaguguaugaucuugauaccaaauacauacaacauuaaaaaaucuagagugagagaauaucacccaugaauauagacacaaaaauuuuuuuuaauaugagaaaauguaauccaucaguguuuuauuaaacacaucaaaauagccuuuauucuuauaauacaaggauggcucaacuacagaauaucuguuaacagaaccacauuaacagaaaacauacauaugaucccagaguaggagggauuuuucuuuuuagaccaaacaauuuuaaaaaaacaaccauaaagcaaagacugaaacaucugacauagaauaagaucacaauacaaaagccaauuucauuucaauauauuaguaacaauugaaaauugaaauuuaaaaaaagaaauuccauuuaaaacagccucacaaauaugaaauacuuagugauaaaucuaacaaaagaugggugagacuugaaagaccuugaaaacuacaaaauauugcugagagaaauuaaagacgacuaaaaaaugaagccauguaucauguuaugggguaaagacucagaaaaguuaugauuucuguucuuuccacaucaaccuguagauucaacauaaucucaaugaaaauuccagcagguuauuuugcagaaauugacaagccgauucuaaaguucauauuagaaugcaaaggauauagcauaaucauuuaaaacuuugaaaaauagaccgggugcgguggcucacaccuauaaucccagcacuuugggaagccgaggcgggcggaucacgaggucaggagaucgagaccauccuggcuaacacggugaaaccccgucucuacuaaaaauacaaaaaauaagccagacaugguggcaggagccuguagucccagcuacucaggaggcugaggcaggagaauggcgugaauccgggaggcggaguuugcagugagccgagauugcgccacugcacuccggcccgggcgacagagagagacucugucucaaaaaaaaaaaaaaaaacuuugaaaauaauaacaaaguuggagaacuaacaucagcugauuucaagauuuauuauaaggcuucagaaaucaauauaaggugguauuuguauaaagauagacaaauagaucaaaggaucagcaaaaagacuugagaaguagauucauacauauauggacaagugauuuucaacaaagaugcaaaggcaauuucaguggagaaaggauugucuuuuuaguaacuggugcuggagcaauuggauaucuguauguaagaauaugaaguuugauccauacuucacauuauauacaagacuuuacucaaaauugauuauauaucuaaauguaaaagguaaaagcuguaaaacuccuagaagaaaacguggaggagaucuugaccuuggguuaggcaaagauucuuuacauacagaugacaaaagcauuauccauaaaagaaaauauuuauauguuggguuucaucaaaauuaaaaaccucuucagaaugcacuguuaagagacugaaaagaccaaccacaaacuaggcgaaaauauuuacaaauuauuuauuuuaauaaaggauuguauccagaauauauaacaaauucucaaaacucauuaauaagaaaacaagccuuucaccaaaaugcauaaaagauuugaaaacuuuaccaaagaagagguguggaugauguauuacuuaggguucucuagagcgacagaacuaauaggauauauauauauagagagagaggaguuuauuaaguauuaacuuacacaaucacaaagucccacaauaggccgucugcaagcuagcagggagagccaguccgacucucaaaacugaagaacuuggaguccgauguucgagggcaggaagcauccagcaugggagaaagauguagacggggaggcuaagccagucuugccuuuucauguuuuucugccugcuuauauucgcuggcagcugauuagauggugcccacccaauuaagggugggucugccuuccccagcccacugacucaaguguuaauguccuuuggcaacacccucacagacacacccaggaucaauacuugcauccuucaauccaaucaaguuggcacucaguauuaaccaucacagaugguaaauaagcacgugaaaagaugguucaguaucauuagucauuaaugaaaugcaaaauaaauuucaaugagauacugcuuccuaccuacuagaauaauuaaaauucaaaagauggcgcauaccaaguguuggcaaaaaugugaaggaaccagagccucucacaaacugcuggaggugggaauuaaaguaguacaugcuggaaagcuggcaguuucuuaaguaagcauacacuuaccauaugauccagccauuuagguauuuaccaagagaaaggaaagcuauguccauacaaaacuuguaggugagacuggucacgguggcucacaccuguaaucccagcacuuugggaggccgaggcagguggauugcuuugagcucaggaguuugagaccagccuaggcaacauggugaaacccugucucuacaaaaaacacaaaaauuagccagguguugguggcucacuccuguaaucccagcuacacaggaggcugaggcuggagaaucgcuugagcccaagaagcagagguugcagugagcugaaaugaugccacuacacuccagcccgggugauagagugagacccuauccaaaaaaaaaaaaaaaaaagacuuguaggugaaauuucauguuaauuuuacuuguaauagccccaaacuagaaauggcccaaaguccaucaacagaugaauggguaaacaauuugugucauaaucacacaaugaaauacucuuuggcaauaaaaaggaauaaacuaguuacacuaguuauaaugcaacaacauggauggaucucaguauaauuaaggugcgugaaaggagucagacagaaaguaguauauucuguaugaguagauucauaugaaauucgagaaacggcacuuucuacuaaucuacagugacaaaaagcaaaucaaugauugcuuuuagggaugggaugacaggaaaggaugggcacaguuaauuacaaaggggcaggaguaaauuguggggcaugauauauauguuuauuaucuugacuguggugacuguuucaugggugcauacauauuugaaaaagugucaaauuugcacuuuaaguauguacuguuuaugauauguaaauucuaucucaauucagcuguuuauuagacauauaaauuguguauuauauaaugaaaaagucuucagaaauuaaaauuaaugaacuagggugauauguauuagcacggacaaaucacaaaaacagaagaaaguuauauaauuauuuguacaagcauuauauaaaauuuaauaaacuaccaaaaaaucccauacauuguuuagguauguguacauaaacauguuugggagugaucagcucuaaauuugagagggucuuuucuucuggagagagacaugagugagauuauaaagugccacacagaggcuuuaaugcuaucaauaauauuuuaccaccaggugugguggcucaugccuauaaucccagcacuuugggaggccaaggcgagaggaucacuugagcccaggaguuugagaccagccugggcaacauagugguuccccaucacuacaaaaaauaaaaauaaaaauaaaaauuagccggguguaguggcaugugccugugaucucagcuagucagguggcugaggcaggaggauugcuugagccuggaaggucaaagcugcagugauccguaaucaugcuacuacacuccagccugggugacagagcaagacccugucucaaaaaaaaaucuuuuuuacuuccuuuugaaaacucugaagcucauaugaugaaaauacugagauuuaguaaaccugguacuauguacaggacaguucauuauauucuuaaauuuuuuguauguauggaaugcuucacuuuuuaaaaaguauacauuugcucagcaacauuaucucagaaggcaaucuuagaaagcagauguuacuugggaaagaugagggccgcacuccuuuucucuugagcuaguacuuuggcacaugaccaaggacuaguucauuccaaacccugaaacucacagugacucaagucccuagccagggcauauugugucagaggccuguuuuuaagaggaagggugugaaugccaacccguggaaaucugaggugccagacagggagggcaaguguggacuugggguucacugggggacuugggucccugcaccccaggauggcaguggcaacugagggcauugagucuaaagaacggaugguggggccuucugacaagcaauuggaagugggcagguggagcaagaaccaggcagaauuguggagaucacaaaagugaguuucaucaacugccuuauuuugccccugucuaucucugacacuagucacucagcugucaaacucaccucaaauucugcaauugacgaggucaccaagcaggugauauuauuacacguuaguaccuacugaugauuccugcucuuggaccauuguacauucucugaaacaaauuaacucgacagccuuuauaggugggcggacuggagagucuuaagccaugaggcucccuggaaaagaauuuucuucuuuuuuucaguagucggggauaaguuucaugucaacacacaaagagcuaaauucagauugaguucauucauuuaauguucagacacagagaucuaugguagacuucugaaggccaaagcucaacaaaauaagggucccuuuucuucacugccuuuuauguacacuaaaucuuaaaaguuuaagaaaauuaacuuggacuaaauguugagcucuccauggccuuaaagagauggugagaacaggccucauuuucaguucagauacuugugugaauugaggaugcauuguuuggaccuaauuguuuuggguuguguauccuacauacauauaaaaagauuuauauaaaaauaaguguuuaaaacgcauuucaagcaaaauaaagcggcuuuuaaaagaauguguaagguauaauaaacagcaaauaaaaugauauaaacagcccugugucccugcuaaaaggagauuccagcaggcaaacuauuuccaugacuaguagagaguaaauuccaaaaguugcaaugugguaaucucacuucccaaaggaaaaaugaagaguugacuggaaaauauuucccuugcagcauuaaggcagacacauacagaaucuuuuuaugugucaguaucuaauuuuuuuaaacaucaaauuuuauucaccuugucaacuuuuaaaaauaauacauuaaaaaguguugucuaauagaaaacuaaguacuucgcuccaugcugggugucugaguuugaagugcugugacaaguaggacaguguuucagagugugcugcaaaucagggccaucugacuguaaucauuuaagccagggguuagccgacuuuucugucaagggccagauaacaaauauuuuaggcuuugccauacggucucuguugcagcaacucacuucugcacaacauuguagcaagaaagcagccauagauuauguguaaccaaugagugugguaguaugccaauaaagcuuuauuuacacaaacaggcuguaugcugauuuggcccacagaucacagccuaggaacaccuaacuuagagcaguguuuuucuuuuuucuuuuuuuuuuuacuguaacccgcaguaagaaauauauaugacaucacaauacagcgugcacgcaugcacacacacaaaagguuuuacaaaacccaacuugccuuuucuaccaggaaugcacucugcuauuugcuuuucuccucuucuauuugguuuuuuaaaggcuaguccugacuguccuaaugauucaucaccugcaggcuuaaaaacauuuguugcuuguugaaauggaaauuccuccugcucugcgaauuacaacuccuuaacucaaauauuggagcguagacccaaacaucuacuguuuuucuuucaaaaugaugcccagcugauucuuuuacacuagguuugcaaagcucaaaucagauguaucagaugaaauuguacacuaaccuauaacuaaaauuaugcccaaaauuguucucuguagaacauuccgauauuuucacaggcgacucucauuuugucuugcuuuaauuuuugcaugauuuagggcucuuuuauucuuuuuccuguuaugucacuuuuaauguucaauaucaugauagaaaaagaaaagaagaaacuggaguucaagcaucaucgcauuugaaauguguguggucuuuaauaggcauaucuaaaggauaaguaguugucaugaaguuauucuaaaggaauauuuugaccuuauuuucuuuugcuggaauuguauuaaacaucugcaauucggccauguaauuuaaaugauucuuuaugcugugugauuaaauauuccauucacuugguuuguccuguggacuguaaauuaguuuuccuucuggaauuuuccuuccucugacaguuucuuaugaacauguucuaauauccugcgcguacuggaugccuuccuuagcuuugccuccagauagaaugaugccagaggcuaaauucuauuugguguaaaauaaguguuauuuuauuccacuaaugaauacaauuaauccacuggggacaguaacuauaauuauaaugcauuaagucuuuuaccaggcucacgauccuauauuauuugcccuaaaguuuugacacuucauucucugacucuuucaggaauuuuuuucacccuugccugaaaucuugugccugcugcuucuaauucaguaugaauuuccuuuguuugcuuauaguacauacuuggaauuggauguuccuuagaggccucaaguucugacaucucuuuccuuccuuuucuuagauuagaguuauacagggaugguaaugacgacuuggagaaagaaagaauuucuuggaauuagcaggaauucuggagagagccuugggccagccuugucuguaagacagauugacuggucuccuccguacccuuucacccagggcuauuuuccauuccagaauuaucauaaagccgguugaaaccugucccugggugugugguugggggcaguaggcacacagcaauuccaauuagcugucuaauuuuaacuuggcuucuggcuagaggacuucaucucacagcacauuucaaacacaagagcgaacggucaaguggguuaccuuggacuuaucuuggccugccccggagguuauggucaauuauguuugagggacauuuucaagcgagacagaaucaggaauuggaauggagguugugaagcaaucaugcguuuuuaucccaacugggaaaugcuuaucaaaauaguuccuaguuaucaaguaagcacaaagugccuggaaaugacguucccagugaggggaaauggcccagcugugcuuuuuuuggcuuucucucaucugcucaacaggaaaaauauuaaucaaugggaaaaaugcucccuuucuguuaauuuaacacaugaguuuuagguagugugggaaauaguaacacuuaaugcuuuccauucucgauuuuauuacaugaauuacaaaaaacacuuuuuagaaaaugguuuucauuuaaaccauagauucaccaccuauaaagauguuuuaucuucuugaugaaaagaagauaaaccugagauagagaaaguuccaggguucccuacagucuugcagucauuguguggaauaguccagggaagacgucuggugacccuuuguaaguugccacugggcaacaccuuuuuuucccaucaacagggaagcaauucacaauucaguguuuccucguaaaacgaauuagcaaugcuucuccaaugagauaaggaauaucuaaaccagagucccauaacggagcuuuccauauuuugauauaucucuaugccuacuuuuugaacuuuuauggaaggauaacacaacaaaaugaaggauccagccugaugccuuuucauuaagcaagaccacccauguaaccaucucucuccaugccucuuuuguucaaggugaugaggcuucgcaaacuggcucagcagauugcaaacugcaaacagugcauugagcggucagcaucacucaucucccaagcggaacacucucugaaggagaaugaucaugcgcguuuccuacagacugcuaagaauaucaccgagaggugagugcaggggccccugggaauuucucggcugcugggcucuuguaucugcgcugugauugguuggucuugcccucgccuugcuuuuauuuucauuuucaaggcucaguaccagagagaauagaggcuuugagcuguuuuguuccagcuaaagaugcuuccuuuugacaugugaaagcccuuucaguaacagccuggagucuggaguucaaggccuuugaaacaagaguccaccaguuagaaagaauaaaaucaaccugcuuuuggacgaggggggagcuuaugauggcacaaaaacagcauuuauugugacucucagaugugauguuaucguacacuugauaacaaagagucaaaaugaaggcaaaaacauuaaagggaauauuuucuuccaucacagggcucaucuauuuuuuuuuaaaaucacacagguguuguucucuguuaggcccauuuucauuugguugaggagcuuggccucaccugaaaaggucaaggccaacucacgcaggagagaaaggaccaaacugucaaccucauacgggcuucuuuuaaaauacucuuuauucucagguagggagcuuuaaugugauguuaucugaaugguuggcucagcaguaaaacuggcaaagauaaguauuuuuucggcacacauacuugguugguauaaaaauugcucaucuucacugacacaaacaccuauagcaauucuaguggauccaaagaaaagcacuagccgggcacgguggcucacgccuguaaucccagcacuuugggaggccaaggcggguggaucaccugaggucaggaguucgagaccagccugacuaacauggugaaaccuggucccugcuaaaaaaaaaaauacaaaaauuagcuaggcgugguggcaggcgccuguaaucccagcuacuugggaggcugaggcaggagaauugcuugaaccugggaggcggagguugcagugagccgagaucgugccacugcacuucagccugggcaacagagcgagacucuuucuccaaaaaaaauaaauaaaugaaaaaacaaagagaagcacuaggcugggccagguacagccaaugccacauaaaugacaucucuaacucaggcuaauggccuugacuucauucauucuaauuuucagagucaacugcccuuuauccaaagcaauaauagaauccuaucucuagaagaccccagagagcucaugcaugcugaucuucauccuagagcagagaucagcagacuuuuucuauaaaggaucaucaaguaaauauuuuuccgcuuugcagguuguaaggucuuggucacagcuacucaacucugccauuguagcuagcucuaaagcggccauagauaauauagaaacaaauggguguggcugugugccaauaaaaccauuacaaaaacaggcaguagaccauacuuugccaaccccuggccuaggaaaaaaaauacucgccaucuuaugacucaaauuuauucaaagaaagagaaaggaaacuaacauuuauugagugcuugcuuguuucggaaacuugugcuaauucucaaaauaucgcauagaggaggagugauugacaucuccauuuucacucuucuuaaagaguaauguaucguguuuuuacaacucuggucuacuguccaaucggcuugacuguauuauuucuuauauuugaggaaaauuccuuuuguagcugauuagauacuuaucucuucuaaaaggcauggauaacagcuggcuaucaucccuguuauguacuuaagaugcucuccuccuuacucugagaggcccauuucuuuccuccugauuccuugguuccaaauguuuauuuucccugggccauauccaguugcucaauauucacccuaaaguuaaaaacugcaaauagcacuaauacuccaguguaccuaggacacuaauagauagcguuuacacuuaggucacgguuuccaaccggaauccaggaguacuuuucuccaucuaugaacuuugagauguccagaugaaauggcuauuaugaacugcauuccucaucaaucccugaagauucaaccaagugucacaugaauaaauucuuaccuagugaccagggaugaugugaccccauaacaguuauugcugaaagaagauaugcaucugaaguauagcacaggugugggaaugcccacauacaaucucccucaguuccagugggacguaucugcucccauucagcucucucuauaacaagcccaacucaucaagagcaggaacaugacuuugauuucucuuucuacaaagaaugugcuucugucaaguuugaauucacagagccuguaaaaauuugccaagagccuugucucuguuucugcaguccccucuccucccaucacuauuugucaauccucuuggcuaauuccugagccuuucuauccuuccagcagcuaggauauagaaaaaggacacugggcuuagacuagaaguuggcagaccuggguuccaguccuagcacugccacuuuuuaacuaugggucuuugagcuauuuucuacuuagaaaauuggguucaggaacaguuuggagguuccucaaaaauccaaaaauuaagcuaucauauaauccagcaauccuacugcuagguacauacccaaaagaaacgaaaucaguauauagaagagauauccucacuccuguguuugcugcagcacuuuuacaauagcuaagauuuggaagcaaccuaaguguccaucaacagaugaaugaauaaagaaaaugugguacauauauacaauggaguacuagucaaccauaaaaaaggaugagaucuaguuauuugcaacaacauggauggaacugcagaucauuaagugaacuaagccaggcacagaaagacaaacauugcaugcugucacuuauuuguggaaucuaaaaaucaaaacgauugaacucacggacauagagaguagaaggaugguuaccagaggcugggaaguauaguagggaguugugggaguggggguggguagggaugguuaaugggaaaaaagaaagaaugaauaagaccuacuauuugguagcacaauagggugacuauagucaauaauaacuuaaucguauguuuaaaaaaaaacuuaaaaauguaacuggauuguuuguaacccaaaggauaaaugcuugaggggauugauaacuuauucucugugaugugcuuauuucacauugcaugccuguaucaaaauaucucauguacuccauaaauauaaacaccuacuauauacccacaaaagaauuguuuuuacuaauaaaaaaauuauuuaaaaaaauugguuucagaauagcugucacuguugugaugacauugcuuuaaguuccuaagaacaggucauuagcauuauagcuacuccaugaguguuaguuggaucucuguuuucacguuucaacaugucagucuagcccgccuugugugucuuuuuuccaaugcuacucucugucuaccugccccuauucaucaaccugucacuuaacauucuucucuaggacaugacuucuuuuuucugucuccuauugugccugccuugggcuuuggcuccuguauacuuccaaacaaucuuuauucuucaauucagguguggagcccagaacaaacuuuuaaucccgcaggcauucuugaagugagacuuagaugagauuuucugcaucguuaagcgacuuaaaguggauauguccuccuacaagcugaaucaaaacuguaaauuuuucuuucauuucagaaacaucaaacaacuccaaaaggggagagagccucaagcuuuacauuguaggagaugcuuuugcuuuggaaccgguuguuuggcucugugcuaauugcuuaguaauuauagauagcauugaggcugcucauuaacauuggcuaauuuugcucauauacuccaaguaggcagguacccuagccaccuuguuuuuaccauuauagccccagcacauugcgagcugccugacaugagugaaugagugaaugaaugaauggauccauaaaucuguaagacgggacuaauuauuccuaccuaagaugguuauuguggggauaaaaugcaauaauguaguaaaaacauuagccuaguuucugucacaagaugaacaugcaacaaauacuaguucucuuccuucccacucacuagaugaaugcaaauguauaauguacuauauucucaagcuacacuaguagauaggucuuuggugugauuguauaugcaccuuuauagcauuauuuuaaauaagcaaagcuauucacuaaguccaggcauaagaaaguuggucugcuuaugaagaaucuagaauuaaaaucccuuauagcaguaacuuaucuguaucaagaaggugauaaaaagaaacuucccucugaauaguaccuauuguucaaagcaccuaggagguucucagacuccucaaggugauccuucuguuccucacuacaauaggcaguucaaggaucuuuuccagaauacaaagccaagaacuccaguugucaauucugaaaagauguugcuugguucaaagaauuagagcauaucugaucagugguuuuggaagugugucugcaggguguucauaggcauuaagauaacugcacguuuucaaggccaaauguguuugggaauuccugggcugaccaaaguaaaccuaucuuguuacugugaggccucacuggguuuuacuuuggugaugcacauuguuuggcagaagccuugugagcagcauagcuccagacacguccaccuucuggaaaacuggccccaugugucccagacauggcuguaaagcaagaaguugagaaaguggcauagcgcuaacagcccuaguggauuuggcaacuuauccaaaaggccagaagaugggcaauaaggauuugggaaauaaaaacauggccuaaaauguugaauuuggcagauuuccccuugccugucacuccaauuaggaauuugaaguuguagccaaagauaaguaucuuuccuuccaucaaaaaacaaauguguagguguuaaaagcugcaguaaucuccacugauucuugcugucagccuuuaccucccaggcuaggaacuuugauccuuuugguucccauguaacaaaguuccuaccaucaagaugguagacauuauuaacagugucacucaauuuaaaauguuuuauuuaauuguuuguagaccauggaaccaggagaaacuugggaacaaaaucuauuuuggaugagacugaauaaagagguuucugccagugggcagggaaacugcuaaagccagggaaaugcaauugcaaguuuggugcuuguuucccaguagcucagaacaguucucccugccagacauuaugauggagaauuaauuggcguuucacuuugcgauaucuuuuaaggguucaaauggcaccuuagcauuucuuuuaacuuuucugcaucgaaugcauauauucugggcucuuugguguguagcauaguuuaagggcuucauaaauauuuguugagaauaauccuaggaccucuaugaaguuuaaggacuuuuuguguucaugggucauaaggaaagcauuuuuaaaguauaacuugaccaucaaucaaaaaugccuagcaaccaucuccguauccaucagucuaaauuagcagcuguugguaacaauaauuagcccaauuccccagggugcaauauuuagucaacaaaagcacucaacucugcuauucacuacuucuuggugaaagggucaggagaugcaguuagauucucuacccucauucagacacuugaaacucguuuccagagcuuagaccucuucacuugcaucucucaaucccaguaucauuacauuuaugacauuguugauuaggcucucuccuucccuccuguacaacacugaaaaucugccagaaauacaacuauagaaacuguauuucuaugaauuuugagcauuuuacagguauauucuuuuuuagaugggugaaauuuacacaacauaaaauuaaccauuuuaaggcugggugugguggcucauaccuguaaucccagcacuuugggaggccaaggccucccaaagggugaucgcuugggcccaggaguucaagaccaaccugggcaacauagugagacucugcuucugaaugcacgauucaguggcauuuaggacauucacauuguuguguagccaccaccucuaucaaguuccaaaacacuuccaucauaccaaaaguaagccuuauacucauuaagcaguuacuccccaucuccccuccccucuuagccccuagcaaccaccaaucuacucccugucuuuaugaauuuuugccuuuuuuggacauuucauacaaauggaucauacaauauguggccuuuuugauggcuucuuucacagagcauaauguuuuuaggcuuuauccacaucguagcgugugucaguguuucaucccuuuuuauggcugaauaauauccuguuguauagauauauacccacagauguaauuuuuagagccaagauauauuacauuuguaaauccaaagcuuuaagagccauuaagagacucaaaaggacauauaacccuuggaguaacuggccugaaauuuuucuagaugaaacagaagaguacagaucugaaauucuccuccuugcugcugccagcuagcuuuguggccuuguauaaaugagcaucaauuuucuuaauuagaaaauaaguaacuagauuuaguacuaaauuguuucaagguuguuucuuugcucaaaaauucccagcauccuacgcaauacuccgcauauaauagcucuuaagaguguuguuuauggaacuuaacaaaauaccaaacucaacaagauuacuaguccagcaucauuugauaugcucagaaaugguaugcuucaugccacaauucucuuguuuuuaagagaagcacuugcauuuuugaaucaaaguguucauuauuaauaacugaaccuuccaaaugaaccugagaguacauagaaggagauugagacacaccagugccuugcuuuuuaguuuauacaugagaacucuaaccagaaaaccuaaaugaagaagagaaauagugcauccacuggggggauuugugagaaagcucaugaauauuuuccacagcaucugcugggaauauggugcaagaaaaugaauacaaagagaaagaaaaugagccagacaaaaaacucccuuuuuaauguuuauuuuagagagaggcuaguaauugauuaaacuaauccaauaucuggaaacauucuuuuuuaauauucacuuugccuuuuaugcaguuugaaauuuuggagacucuccuuugaaguggaucaggguugcgucugaaaggaacaaacaguuucccagacagaugugugaagaaaugccuagagcuacgcgcuucuugcugggguuagacgugaccgggccagacuguuaaauacacagcaacaugaaauaugaauauucuuuugcuuucgcagggaauuuuuuuuccugauaguaaaaaggaagagggcaagccauuuuguuguuuucuccaauuccuucacuuuuuuuuaaagcuugcauucauuuguuuuauguuacuguguugugacauuuugagaugccucuuaaaacucauguguaaaaaagcacuuuuuaagagauauuuauuuuccuuuucuuuuucauuucuaugcagugauguugaaagucaucuugacauuucugaaacauuguuuuguuugcauuacagagucuccauggcaacugcauccucccagguucuaauuccugaaaucaaccucaaugacacauuugacaccuuugccuuagauuuuucccgagagaagaaacugcuagaaugucuggauuaccuuacagguauugucuuuuauguucucuuuaauauugugcacacuuagugauauaaacacuuugccaccagaucaguuauuccccaauaaccagaggaaugggcuuuugaccuaggaauggcacugauauuuccauaaacaauuucugugcauugcccuuuguuuuuucaucaaaacaacacagcccauuacuaaacuggggacaggagaaaaaggagaaucucaaccauuaaaagcauacuuaccacuguuucccucacucucaaggugugggugcuaaaaauaguaucucucugugguauuuuucauaucauaguaguaagcaacucacaauacauuggcagagaaaaaauuggcagcuaacugauugguugucuguacugcuucaucuccuuguauuugugaucuuguuuuaauuugcacaacaucgaguugagguaaagcauuauaauccccauuuugcaaaugacagagaucagccgucuugcuggaaaucagguaacuagggaaugacagaauuagaauuuggcugggaccuguacaaacuccaaaaacuucugcucuuucuaguaaaagacugaauuuuaucuuggcaaaugucaccauggcaaaggucacaaauuuacauuggaauuccuagugcuguguuucagugugcuuccugguugguguuuuguuuuguuuuguuucucccuugguugagcuuaaaaaacaaaaacaacaacaaaacaacaaaaaccucaggccacuccuauuccuaagcaugcuucuaaacuuuucuuugcugucaacuucuaaaguaggaacugagaauauucacugguagaaccuggacuguuuagacaaccuuauucguguuagccaaagccaccagugccugcgacuucaggaaagcacaauguacacagugaagccagaugugcgcugcacuuaagacauacagccuucaagagaccacgucucuaacuuagcgugacaugagcuucucaauuccaauucuguguguacauguuugugagaaagcgauugaacaagguggagcaggagaaagggaacauugugugauguuuguuuuuacagucuguggauagaaggccagggguucuauauucagggagcauuguacccagaagaugagcauuuuuucuuugcgaggacccaaugugccguuuuuagccuuucugcauugucaagcaaggcaggcaggcauuccacaaacuucuuaucuuauguaacucucucuuucaaacauaccacuccuauuaaggaagaaagaaauugacuaaaaaagcauuuaccguauggaacuaaacuugguuucaaauauuuguguacauaaugcccuccuauuuaagcuuuuaacucugagauuuauuuaaacugacacuauccaauaaaacuuucuaugaugauagauauguucuauaucuguacuauccagcguuagcugccucccacauggggcuauugaaaacuugaaauguggcuagugaauuuuuacuuuuauuuaacuucaacuaaauuuaauugaaauuuaaaccaccacauguagcucguggcuauuguauugaacagugcaggucuagacuuucuccagcuaagcuguuuuucacaguggcauccuguuaaaaaucuccuuuuucuuauaucauuugcgaaugaguuuaguugcaagcaacaaaaaauccaacuagcagugaauaaaaccaucaaggaguguuuguauuacagucacagaagagaagccuguguuccagggcugggcagugguucagugacgaccucagaccccaggcucuuucuuuuuuccuccucugccgccuucauuguguugccuuuuugccacaugaucacaacaugacuacuccaccuccaaguguugugcucaagcucuaggcaaaaagaaagggguggaggggaaacgauggacaaaaugcucugccagugaaguuuguuuaucagaaaaacaaaaagcuugaucagaagacccgccuagcaaacuuccacuuaugucuggugggcuguaucuguguuacaaggucauguccagggacagaaaagacuggaaaauuaaguauuugccuaggcacauggccauucugcccagaaucagucuuauugacaagaaugugcccuugccauuucccaauaauuauuucauaguauuucaacaacauauacccauuuuaaucucuauaggaaugcaaaaguauugauuaaaggggaaauugugaaaguaguuuagacugaauuguaacauacaccauauuucaucccgauggcuguuuauuucaaacuaaaggccauaugggguaccugcuauuaugucuucugagcugucaaccccaaauacaaauucaguccauuucuagacauaacaucgauccugaccauaacauaugaugcuuggcugauacugccaaguccaaauaguuuaugacauuuguaagcaggaaaugaagucuuuguggaguauuagcccaccauuccuugggugguguuugugacagagacaagaaaauaacacuucugguacugauuccaugaguauugaaauuggcagcaugcugcuguucucauuuacacuaaauugaguauugacuucucaggacaaacucauuggguuuacagucaaaauaagguuagccugucucauuguaaaaacaagauuuuuuuuuuccuaugacaugccucuaagugguauaucaaguuaauaacccauagaggugacauuuccuuccugauuauggcuacuaccaugugucucacagcuacuugccuauuuugaacauacguuuucuuucuauuuaauuguauauugcaauacagaacaaaauuuuucuacaaugguugauggagaaauaauucaaugaacuguuuaaauugugagagaguaaguauuucuucacugguccaugcaggagugaucccacaccaacagggaccacacagacaauaauaagcacauuuuacgaugcagcuggaccuccuccguggaaugcauauccugauuggugucacugauucaugcacauccaagucauaccacaugacacuaaaucucacaugugaauacuucaggagacagauguacaaauacauauuccagaaagaaugcuuuaaagguuauguagaacccuucugucuuaaugcacaauuuaaugccaugccugucacguuggaggugcucaacaauguuucuggaauucagaaccaauagauaaagcuaagcuaauugacuuaauaccguagacuugcuucugugauacuuguccuagagguauauucaaaaagcaaagugaagacuacuaacgcagaguuuaaauuuacaguuuuuauaaacuuuucuuccucuuuggguuugcuuaggacucaucaauucuaaucauaauuuagagcaggaaauaacucugaaauaguacaagcaaagguugcuccuaguuuguagagugcagguauguuucuccuuuugaagugagauucuaguggguagaagaguggaaguaaaggcccuggaucaauucucuaaaccagaggucagcaaacuuugacugcaaaccaccagauaguagacacuuuaggcuuugcaguccauauggccacaacuacucaacuuugcuguugcuccaaagcagccauagacaauacauaaaugaaugaaucuggcuguguuccaauaaaacuuuauuuacaaaaacaggcagugggccagacuuggcccacagucacaguuugccaaccccucccucuaaaauauuauuuacaaugcaaagcacucauuuucucauauuuuccuugcucacauacucuucucauaaaaccaguuacugaaaucaauucaguagaagucauuuuaaacucauuauuuugguaggacuuagacuucucugcuccagaauguguuaaagaaauaaaacagcagccuucuacaaugauaaauuaaccaaaugccaaaaaaaaguuuuuuccuuggggaaggaaaauguaccuuuuagauaugauugacuaugaaucauggucuucugaauuugaaauaucgcaugaguugagaaaugagaagaaaauagggcuggacuaguaaguucuuuuuuuuauguaagucaucgaaacaucuaaugaaagaaaaauucaaacaauuauguggcugauuuuuuguaggauaacaaacauaaguauuuuuucaauugggugccuaaagauauaaguaucuggcaccacguauuaauaggucagggguuggugaacuuuggguuacagcccaaaucugacccucuaccuauauuuguaaauaaaguuuuauuggaaccuggccaugcccacauguauaaguugugacuguuuucaugcuacaauggcagaguugacuaguugcaacagagacuguauggcccacaaagcuggaaacauuuaccaucaaggccuuuacugaaaaaguuagccaaccucccaaagugaaugcagcuaugaaacuuuaucuuguuuacuuuuuauuugacaaguuuuccuucaugcacaagaaaguauuauuuguuuaaccucccaaacauauucucaugaucucaugauaaacacagaaaguccauacuggcugacucuagucacacuccuuauuaaaaacaaaagcaauaaccagccaaucagauauucuuuagauuggggucaccaucucuaggauaguaguccugauggaccuauugagaaggaccugcuuaacugucaaacaucuccucugaaaugguaucccaguugugugugcuuuuccacugauaagcauucuugacccccacagcucccaacccucccacaauuagagaagagcucugcacagcuucauaugacaccaucacugugcauuggaccuccgaugaugaguucagcguggucuccuacgagcuccaguacaccauauucaccggacaagccaacgucguuagugaguaucucauggccuauuuauuucugucuuugguggcuuucuucagauugauugcauuccugaauuuaaacuucaaaggaagacaaggaaggaaagaacacacaauauuuauugacuugucuuucuugaacaaaaaagugauagcacucacuuguacuacauuaguaaaaacagcuggcuaaauauugaugaaaauuaaugaccucuagcaaaccacauggauguuaagggaaagaagccagaaacaaauauauagagagaaacaaauauauagagagauacauagagagagaaacaaauauauauauauaguauuaauccacauauagguucauaacuuaaagaucaaaauaaacuauuuugcuuaaagaaacauucauagguguuaaaacuauaaacccugggcaaccuggugaaaccccaucucuacaaaaaauacaaaaaaaauacaaaaauuagcgggguguggugacacacaccuguagucccaacuacucaggaggcugaggcaggaggauggcuugagcccaagaagcagagguugcagugggcagagaucacacuacaguacuccagccggggcaacagugagaaugcugucucaaaaaaauaaaaauaaaaagucaggaugauggcuaccuccaggauuaaagggcaaguggcaccacuggaaagaaauauacagggguucuugggguuaauggcaauuucuaggugaaaguuacaugcuuuagucauuuuaucauacauuuaguuuuauguacuuuccugaguguuacuucacauauuuuaaaagaaaggauuuaauaaaauaaauagccaaagaaaguuaaauaccuggucccauucagaggagagagcugggcccaucacuuaaaauguuaguaacuggccccacccgggaagaauuuccaaccuuaccugaaacauuagaggugcccccucucacugaggccuauuugauaucuggcaucagagauaacuuggugauuucaaauagcaguaguagcaggccacagagaugauaacagaggaagcaguccuccaacccacagaguuauuuaaauugaacugggcaaauggcaauggaccagaagacauggcuuuucacgggagcaagcuugaaacuucuuuaacaaagaaaaauacaauaugucaaaauagaacagaauagaauagcagucauguuucaacaaagagauguuuugaauaaauucauaucaauuuaaugugcuuuuauuauauaaaccuuuucucucuuaacuacaaacugcucuuuccuagcacaaguaauucugagucauacgaugcuuaacauagaaauuugauuuaggauuaauuaaaagagugaugcagaaauacaccaaguucuaagggacuaaaguauaaaugacccauaccaacaaauggcucccccuaccuuccuuauauccacucuccccaacuucuccaacuuccucuccucaacucccucaccuucuacccuauaauuggccugccguggaagcuuuuauuaaaaucuugccauuuaccaagaauguguaauuuuuaaaugaaaguggagaaagucaugcaaugucaagaacagcucuggcaagcugccugagucaguagggaauauagaaaggucagaaauggugagugggacaaaaaugucuugggggaaguugugguuaaacuaagucuugaaaaaaagcgggugcauuuuagcaaguuaaggcuguaccggacagcuaugucaucauaagcaaaucuaucaagauguaacguagcagggcauagugggaggucuugccuaauuaagccuggcugguaagugaggaaagggagacagugagaaaugaagauagagaaauagaaccagggcucaaaccuauauuggccuagcuccaaaaagcacauguucuuaauccuuaauccucagucaccuaauccuaauucacaggcaagagcuagauugcagagggcuacccaggccauaccauguuuggauuuuacccugugggcuugagagucaugcaggacaguaauguaaucagagguauaacuagaaggugacucaggagcacuguggagaguggagaggaacagggcaggaccagaagcagagacaucagcugggaaguuucguaguaauucacugaggcagaaauagccaggaccugcaaauggcaccagcaucagagauggaaaggaaaagauaauuccaggaagacuucucugcgucuggcccauuuuccugggaaaaaaucaucaguguccucagauauuugaagugcuuuuuggggcaagucgcagaaggccuguauagcaaugguuuaguaacauuuugcucaccuucuaggauuuugaauucuucugguaucauuccucauuucugacucuauaugcccuacugcaaaucauaaagaaauacuaauucucuaaaauauuuuucuacaugugcauaucauacacaaugcuuuaccuuguuuuuuucaauaaauauuaugucugagauaucauuccauuucagcacaaauaaagaacugccucauuccuuuuugaggcaguaucauauccuauuuuaaagauaugcucuaauuuauuuaucccaucuucuauagauguuuauuuagcuuguuuccaaucuuuggcccuuacaaacaaugccccaguauccccaaggauguucaagauauccuugaauaucucuccuuccacacacggggaauuauaucuguaguauaaucucuugaggugcaauuucuaggaaaagauuauuugcauuuaauuuuacuugacauugccaaauugcccuucagagagaugacaugauuuuuaaaugcauuuuuccagcuguaugagcuuauuguauuucacugaucuuggcuacauauaccauaaacuuaacguggaauuaaagucuaguaaaauuuuaaaccuugauugugcuucaccauaaaccugaaacacaaguuaaucuaugaucacuaauaucauacuaaauagucacuccuucauauaagcagugauucucaacaagggcaguuuugcccccuaagggacauuugacaaugucucuagagacuuuugguucucaaaaccuaggaggagggugcuauuggcaucuaguggguagaagugaggaaagaugggaaaucucccacaaugcacaagaaaucccccaacaacagagaacuaucuggcccaaaaugucaguaaugucgaaguugagaaacccuaauuuaaaacaagguaaauguauaauaucuacaugauuacaugcuaaauacugagaccauaacacacugauccacacacacuacuauacuauguagcauggaaggaaaaacacaacaaaaaggggggaauauaauuaauguauuuugucuucacuuaaggaauuguuuucucaauauuuugugauuaauaucacuagcauauuugggauaaacugaaccagggauuguaucaaacuugaagaagaugaaauucaaaagaugaucagaaauuccaagguaagagaaaagaagcacgugaaggucugagaagagcagguagaaaauggagagaugauucauuguaaaacaccaaggaagguucucugaaaauacauagaggacugauagaaccaacgucuguugaugagugaauagucuaaccggaaaaagaaaacauuuggagucauuuuauaccaaaagagugguucuuggcccaugugagaaaugcuauauuucucucaaaucauuuucgucugauucaggaaaagugcuaacaguuuucuauugcugugaaacaaauuuccaaaaacuuagcaguuuaaaacaauacccacuuauuauuucaguuuccauggguuaggauucuggcauaguugagcugggucuucuucuuagggugucacagucugaaauuaagguguuggcugggcugcauucaucuggagacucaacuaaggaagaaucuacuucuuagcucccuccauuuguugacaaauuuguuucauugugguuguggaauucauggcagcuugcuucgucaaggccagcaagggagagagucugcuacuucaaaucugucaccuccaaaccugucuuuaaaggacucacuugacuaggucagacucacccagaauaaucugccauuugauuagcuccaaaucaaauaauuagggaccuuaauuauaucuguaaacucccuucgccuucgccuuugucauauaauguaauauaaaaacaggaguaauaaaagugauagaccuuuguccuuugccauauucuguugguuagaagcagaugacagguccuguuuacacuaaggagauaauauuacacaguuaugaauaccagggaguuggaauccuggggaccauccuagggcaugucuuccucagaugguuaugucucuccugaaauuucuuuugguuuucuuuuauucuuucauauauguauguguguguguguguguguguguguguguguguguguguguguguguauauauauauauauauauauauauauaaaauuucagacagucuugcucugcugcccaggcuggagugcagugucaugaucucggcucacuacaaccuccacccccagaguucaaaugauucuccugccucagccuccugaguagcugggauuacaaacaugugcuaccacgccuggcuaauuuuuguauuuuuaguagagaugggauuucgccauguuggccaggcuggucucaacuccuggccucaagugauccacccaccuuggccucccaaaguguugggauuacaggcaugagccacugcacccagcccucuccugaaauuucuuaaaucaaaucgucauggacacuuugggaguacauguagccuuggccuugacugaugggcucuguauccguuggcuuuugcugaauagccaacaaccacagggccuaaguagaauucauauugcuuaugcaucuggagucaacugagugucaacuaggaagcccugcugaucuuggcucccucacauggcagacugauaacuguggcaacccgacugcugcacaucugucucauccuccuacaauccagcucaagucugcucucacccugauugcagagaugaaggaguaaaggcaggaccaauuacacacauucuuuuuaagccccugucugugucacauuagcuaacaugagguuugucaaagacguccccugggugagcccagagugagaaugcaaagaccugcaaaauuacaaggaaggagcaaggaauuggggccaaaaggcccuaacucaauaccagagcuucaccucauccccaaaaugaaaggaagauauuuauugcuugaaacuuaggguuucucacuuggcuaaacugugaccaacuugauuucugugcuauuugcaucgaaaauaauaccaaacaugaugcauuaauagaauagaugaugcaaaaaggucaugcauaaaaaaacucaacaagagcaaaaccacucaguauaaugaacucagaacuuuauguugggugauuccagagauguuuuguucccagaaaccaguugccauaagaaaagaaaugcaaauggcuuagugaagauuaucagccuuuaacgcauagaugccagaaaggcccauucucccaggauggaagaaaaacagugaaacugcuggugcugaccaaacugggauacucucaccggguuguuuguaucaggauguguuccucccuugaugcccauuaaaccagaauagugaaguccuaaugccuacaggauccauuugcgacaaagaaagaauucauucagauaaaaagcuaaccgauaggcaaagauuuucaaauuauuuucuucuuaaauauuuuucacauuuguagugaccaaaggagaccuggauuucaaucuugacuuuggaccucacuagcucugcagucuugagcaaauuauuuaauguccuccgaauccguuuccucaucuguaagaagggauaguguuuuaacuucacaugguugagauaauaauaguaaacaccuuagucuuguguuugccacagugguagcacauagauauucaaaguuauuauuccuacaaaaauacggacuguacucaccccauaauugcauuuuaaaagaaagaccaguuuugcaauuuuccaggauuaucuacaugauagcuuuuuacacaaucaguaugugaaaggcuuuccuugaaugauguuaaauaaucuguccuauuauuuggagaaguauccuuugcagauguuguauugcgugacaaggucuaaugguaaaacucuacugaaaaugagaagauauaaugcucaaaaccuggcuguagcuccuuauaucacuagaaaaucuuuuacugucucuaggucaugguuccuucacucauccuaauaaauuguaguuaauugccuucaacuggcguuagugaaggagacuuagauaauaucuauggagcuuuuucaaucuuacgaaaaggcccucacuaaugaaauacauacauucaaaugcaaaaguaaugacauuaauuuuuauuuuuuauuuuuguuaauagaguuaugacuauagauguuaaugaauugcuuaucaauaacuagauauuuauuuaauuuuacaacguuugccacguuuucucuaaaacuacuuuugaugcuucauuuuaagucuuaaauuggguccuuuccccagcagccuauucuuauucuuagcagaaaucaaaagcugcauuuuuuucaagccuuaauggcuaaguaguuaucuguuuuuaauuuauuguagucacuuagaaaacauucaugaaaauuauuaaacauauacuauuuuuacagaggagaaggaaaggaauguucacuucuguccagucuguuggaagagacaaaggauguuagaaaccagugugcagccucuccuaagacuguccacaucaugugacauuuuuacacauaauuuuuuguggcaagaugacaguugccauacaaggcucugaaaucccagauguaauuaagaucuuauaaugagccacauuauguagggaaaugcuucuaacccauugugaaugaaaaaaaaaauguauaaaaucaaaaaacucaauuaauuagguuucauuguggacaaauuauuuuccaagcuccguuguuauuuuaaacugagucggaggaggugaauguuggaacacccucaaagaugacugaaaaugaguuuggagaaaagugaaguuucaaucaggaugguuguguggguguuucauaaagagaugaauaaagccuggucaagaguccuaacacaguggggugucaaggcagagaagucuugcuuaagcaaacucagugccauaugcaagaaguuagguggugcuggcguaagaccaacaccgguaauggugcacuccaagucaccccacuuacuccagcccccagaagaaaauugucaauguugcuuuccuggcauuuuuaaucaacuucucaauuauuaucuuggcaauaauaauaacauaaagguaaaccuaaacaguaauaguguuuguuaguauucaugaaaguagauugucccaguauaaagcuaaccaaugaaauuuuacuacuucauaaacauuuuguucuuuuaauuuucaaggaaaaaauagggaccucuucaaaauaaucaggauagucagagucccuuuuuguuuggaaaagguuucugaaacauaaaaucuuuguuggguuaagacuuuggauuuuaggccaaguuacaguuuucagcaauuucagacaucugcuuuaugauguuacugaaagcguucccccaccacauuaaacccagcuuuuggguuguacagugauguaaaguuuauugaaacauuuuuacacuugcuuucuuugaccacaauagucauuuuuuuguaacauauucaauuaaacaggaacaguauaaaggcagugaaauugauacgauucucauuugaaucuacugaaugccuuaauuguucucauucguggcugacugccauugacaaagaucuaggaauaugaguacacuauccuacauaauagaaaagcuaauuuuuuguuuuauuacuacuguaauaauauuaaguaccuaaagagaguuauaggccucuuggggcccagaacucagaguucaaaaugacccuucuuugauuggaucaaaaucuaauauuuggcuguggcauuauccagaaguauggaguuuauuauagcuauguucaaggaaaagguaaggugaaggaagaucagaagggauauauaguaaggagauucccauguuacuaaacuauuuguggauguuuuccugcaucauaugcaaaugagaauugguaggaaaacagagggcuaagaauuagagaaaauaaauuuggggaggagggauggauugugccucuuauugcucugcugaaucuccaaauauaaacacacacacacucaaacccuucuaugaguccuaaauuacauucuugcuucaagcuggcuuuuucaaaucuggcaguccacuggcgaaaauguuugcagguuagagaaaaaaaaaaaaaaaggcaacagaaaauucacaagaccaaauauguguguguguguguguguguguguguguaucuuuagauaucuuuagaugauauauacauacauacauauauauauauauauauuuaauucacugauguguacuugaaaauauuaugcacccaagauggaaaucauauaaggugaauuuuucaacugugacaauaccaugaauaauuuuuaacucaaaagauggaguaaguaaguauucaguaagauucaaagacaggcuucgggagccugugacuaccuugaaauucuaugcauauauuugugguuugguguguauaugcauuugugaauuucuuacuacagaaagguuuuauuagauuaucaaagaggugagaccaaaaaaagauuaagggacugcuucuugagaaucugguaaaguauaaguugccucaagaucaaaggaacuaacccuuugacuugcaaaucaauugaaagaggaguggggugguggcuuuggaguccucuggaaguggagggggcccagcccucucccagggaucagugaaggaaauucaacagagucaggaaacuucuugacagccuggucaccaaggguuuggaaaaagguucuauuggaguggagauugauggguggaaaaaggagagaggggaguuggaccugauaccaaagagauguuuucagccaucaaccagcugcaaaacaagaugggcuuccuuuuccuacauauucuuccaagcaucauaaauacucggucugcuccccaacccacauccugcaggaugcagccagagcaacagccccacuccacucugaaaccagucauccuagggaugaugaucauuucuuagcuucccuguuggaggucgguugggguuggcugaucgcugcuugguucacuccugcacuggcugggcguuggcugcaugguaaagcuguucccugucucauccuguugggauaaacagaguauccuaggcauauuuucuccagagcaguggcagacacaaagggucaacagaaacccucaagguuuugucaugccuacucuugcaacuagcacauugucauuucagccucaugcuauugaccaaagcaagucacuugaccaaauucaaagccacaugacagggaaauauauugcaccucuuuagaaggagcaccugcaaaguuauuugggccuggauauacagggcagggagaauuuuggaggcaaaaaugcaaucugccacaucuacguuagugaagucaguuuuucguacaugacuaccaagacaaagcacuucacuuaccaacucuauucaaauaaauggaaauuauucaaccuaaaauuaugcaaacauugcuccccuugugccaaagaacugcaccaugucugauuggcuuugcaggucuguguaauucggcugauagcuggaugauaguacccaacaucaagcagaaccacuacacggugcacggucugcagagcggcaccaaguacaucuucauggucaaggccaucaaccaggcgggcagccgcagcagugagccugggaaguugaagacaaacaguaagugcugugaacucaacagagcugucaugucuuaucugcucuucuuucagcugacucugucccccuuucuuuuccuuuucucugucuuggguaucauugacagccccccaaaacaaguaaaaagccaguguggaauaauggaauuugcaucagauaccucuagguuccaaaacugauucuauuccuucacagccgugaggccauuacucucucugcauuacucaauuuuaaaaaauugagucuucucauuuuuuaaauaaauauuccuggaggcauucuugugagaaguagaugauguauauguaagaccugacacacaguaggggcucuguaaaugguggauaguguuauuuuucauagcagaguagccaacuaaucacucuucagaaauucuuuuauucuagaaaacagucggagucugugguucucaaucagggacacuucuuccucccccuccaccccacccuaccaggacauuuaguaauaucuggaagagguuuuuaguugucacaucugagguggaugcuaccggcauguagugaguagaggccagggaugaugggaaacauccccaauccacaggacagugcgcaucacagagaauggucuggccuauaugugugucucaugauacugucaucucccucucucuguccacauguguuuuguuuuauccucucuucuuucuuuacauccuuuugaucuaggaauauuauguuauguaacaugguguuuauuugcauaagaccucccaagagaaagcaaauuggagugugucgguauggcgccauguugugagguugccaggcagucaacaggaacaauuaagugcuuuucaaggggaacccucauuuaaccuauauccuuguuucucaguacaaguguuguauccuagaggaauguguuggauccuagaggaagaacaagggauguaaagagagcacugaauuacgaaugagaagacuguggcuuucccacuugguacccauauagcuauauggcuaguuucuucauauuuuuaaauagauuuuuuauuuuggaauagcuguagauuuacaggaaauccauagauaauacagagaguucuguacacccuuaacccaguuugcccaaauauuaacaucuuauguaaccuugguacaguuaucauaacuaagaaauuaacauugaugaauuacucauaacuaaacuccagacuuuauucagauuuuaccagcuuuccacuaauguuccuuuccuauuccgggacccaauccaggaucccacaaugcauuuaguguuccuucaguuuuaaaaugggaauauuuuaacaacuugaggguuguuaugaguugucaaaaagacccucucaaaguaauucuaaaaguacauaagagaauauaacaugaugauauauuucuuuacagucauacaacaaauggcacaauaccuaugcacacuuagaucagcauuauuugauuugcauuugaacauguaaauauuuguuccuucaaaagauauguuugagcaccaaguguguuugggaugcugugcaagaugcuaaggauauuaugaguaucuucaacucccuaaggugugcuucucucucaaaaagguccuagacuauuggggaauaaagcacauuaauccuaauuaacauucaauaugugaaaucucugacuggaauaaccaugagagguucuaaguugacaaagccagggugccccagcacaaccuugagaggcuuuccaagguagguuaggagcaggggaugugaggacacaguguuccaugcagaaggaacagcaugggcaaaagcccagagacaaggagaauauauuuauggaacagaaaauugauccaugugguuaaagugugucuuagguugggaggauaggugagccaggaggcuggagacaagaacagaucgcgaaagccuccugggccacaccagggaguuucuuuguauaccaaugauugguggagagauugaagaguuuaaaucaaacaggcaggaugaaaauuuccaugaaauaaagcucucuugcacuaugauguggugaguggauuacaaggaaggaagacuggcugcugggcacaguaucaaaagauuauugaaagaguuguccauguaaguaaacaacggccugaauaagagucgugucccauacaaauauuauaaugaauugaauuauuuaguaaaguaagcuauuaaucucuuucuugaacuaauuugucuucacugaagcaaaagccuugaauuugggcagaguagguagugguuuauuugggaaacauaucugaggcaugggcagaauuugcucaccaagauugcaugauucugcuccacacaugcgugggugagggugugagccaaggcaggcaggauguuugaggcaguaugucaccaucacaaggccggucuuuccaauggcucugacauucugauauaucucaccggaaggaggccgagcagaacuuggccuucauuguaaaugaugggcgccauuaaggaauuucuuccugcucugcccauuaguauccuaucaaucauuuuuaauccauauucuaccuuccaccuuuaaaaauugaaauauuuuaagcaaaacugucuucauacucuucuugucuuaguucauaguuuaucucugauaguugcuagcaugaucauuccuaaggacuucuuuuuacaagucaaaauuuaaacuacacauguaauccaauagaucuuacggccucugagaauguccaaucccugcucagcccuugaggguuuucucugcucccccuuuaaagcuuuucuuuucuuuuuuauuguuauuuuuuugagacagugccucacucuguugcccaggcuggagcgcagcggcauggucuuggcucauugcaaccuccgccucccggguucaagugauacucguggcucagccucccaaguagcuggaauuacagguguccgccaccacacccagcuaauuuuuguauuuuuaguagagaugggguuuuaccauguuggccaagcuggucuugaacuccugaccucaggcaaucgagcugccuuggccucucaaagugcaggcauuacaggcaugagccaccagcccagccuaagcuuuucuuugauauguacagaaauagauuucuaaaacaaaagccagcuaacuauagcucaagggccaaaucuggcugccugauuuuguaaauaaaguuuuauuagcauauagccacacccauucauuuaccuauuguccuguccguggcugcccccucacuauagcagaagaguugaauagucacaaaagagaccacauggccuggccugcauagccaaaaauauuuacugucaggcccuuugcagaaaaaguaugcugguccgugaccuaaaaagaaaggauuuuagaggugcugguguuguguuguguuuguauccaaaaggcaacuggaaauccuuuggccuacccacaugugacaacacacacuguccuauacucacugggucaguuucucgcccagcaucguguauugccacaguugaauuuacuagaccuuuuccugugauugagagcuguauacugggcagaaggaaccugccaacugcaacagugacuguggaguuuggacaccauggcauuuguaucagguugcaaugcauuuccugccuuuaaacgccuuguacccaaugcaguguugaaugacaggcaguacuccaaaccaauauugaauugucaaagaagaaguaacaacuaugacaaaauguccaggugugacucugccaagauuuuuuuaauacuuaaaucuuuaagacacaaaugugaguaaugaaauagagaaggccuuauuauauauaaauaauuucaugaguagaaaacccaggcauugcuaucacauuuuuuccuaauuuuguggccugaaaauuguauucucauccuaaauuccuaagaguaaugcuuuaauuuuuaauaaucucagaauaauauaaaccucuagaauauucuauauguuaagacccaagaucuugauuuguuugguuucuggucugaagucuauugagcaugaaugcaucuuaugcuggauagaacacugcagugguugaaaauggagucuucauucauuccuccuuuucaggaugcuauccagccaguauguaccugugcugcuuguauacaccuggaauccgugaagcuagcucacccuauguuuucuggcuaagccuuauccaugcuguuguugaauaguuggcaugccaccacuggaucccuaucuuagaacugguagacugaaagcuuaugaagacaggaacauguucuuuuucacucuuacuguguacuguacuauacacagaguugcugcucucuauugucuuuugaauauuaugaaaacuuugcaagcaaaugucuuugaaaguugcuuauaauguuuaaauuacuauuaaaauauaagauaccacuuugugauaggaggcaugacucagggagggcuggcuuguuccugucuuuuaaaccugauuuugaaaauaugcuauugguuaugauaaaauaaacaauccucuuccucuuccuuuuucuguuuugugaauuuguuuucaggccaaccauuuaaacuggaucccaaaucugcucaucgaaaacugaaggugucccaugauaacuugacaguagaacgugaugagucaucauccaagaagagucacacaccugaacgcuucaccagccaggggagcuauggaguagcuggaaauguguuuauugauaguggccggcauuauugggaaguggucauaaguggaagcacaugguaagcaacuuauuucuauuguccugcaguuauaaaaaggcacaucucauucuguacuuagagagucaacccauacuguaaugcaucuuaaagaauaaaaugcagaaaaguuguauuagucagcucuugcuaggauaauacugcauaacaaacacccccaaacucagcagauucaaacaacaaccauauauuacuaauacccacaccuguggguucucuguucaagauuauagagcucugaucauuggaugagcuauaccauguuaacacugcucuuucaugccaugaaacauggguuggcaaaccacagcccaugagccaaaccuggccugcuaccugguuuuguaaauaaaguuuuaugggaauacagccagguccauuuuuuuacauauaguccauggcugccuuucagccacaacagcagaaucgaguaguuaagagagaaucauauggucuacgaagccaaaaauauuuacuuacuuucugguccuuuccagaaaaaguuugccauucccuacuuuuaaacaucacucuucaucauuacacaaaacuaauuucuguugccuuguauguuuuaugguucuagacuggaccaauuagugcaaauagcuaaggguugaauggugggggugaagcagugaucauaggcugggaauaauuucaaaaggccuguuagauccagcccagugacuuuagcccacugaguucucuaagaauaagggcaaaggucaggacacaauuacauuggaauuaguuaaccucacaaaguuaaccuugccuaauccacagccacaacugcaccccuuugaccgucugucucacaaaugccugcuugcuauugaucaaaaagggagcuauuuuauuuuuauuuaacaagcccucauaugguacaaguaugugccaggcacuggucuaagcauuuuacagaugucaacucauuuauucagccuuacagcccuacaaagguaggugcuaauauuauccacuuuacugaugaggugacugagguauaugcugaagaucacaggguuacaaagcucacagguggcagagucaguaagucugcagucaagggucaggcucuuaaccagcaguccacaaacauuaucuguaaagggccagagauucaauauuucugguuuugcaugccaaaugauuuuugucacuaauacucgacucuucuguuguagugggaaagcagccacagacaacaccuacacaaauggacauggcugcguuccaauaaaacuucauuuauaaaaacaggcagagggccagaguuggccccuggguaguaguuugcuguuccccgcucuuaaccaccaugguaugcugcuauucacaaaagggugguauauuuuugaaaugcuauaauuacucucuaggguuuaugacaguguacguaaugagugauagcugaauccuugcuuuaaaaaauaaaaucaacauucaaaauugcauagccugaagauggugaguauaacaguguuucuuucaauauaagcaugauaaaacacuuauuuauauauaaaaaaaccuuucaauucaaaccuaugcaaauaaugugacauggcugaguccuuuauauuguagguagaaauuagccaaaaaucuaagaagugaauuguaagcuucccaucucucccaauaaugguacauacuauauuggcugagcgaguagguuuuccuuuguugcuauccucauaauucucuuugccuagaagaguuuucuguuccaacauccugccagaggauggaggacaaauccuucaccccacuaggcucugggcuagauuggcauuugcaauuuuuagcugcaguggggcaaaauuaaagcacaaaggaaaacacaauggaugcagguacaaaaaaagcaaauguuucuaguuaauuaaugugcuguauuaaucugggauagaauccagggucuaaaugauuauuacucuauuaauaauuaauuaugauaaaugaaaccugaucauuaugaucucauugccauugaugaauaguuugcaaaauuccaucagaccacuucaguuauauaaacacacaucagcauuaccuugaaaacacccuccagaugucaaaacuaacucaugagggggaaaagaaauucuaaaauuaauugcuacacaauuaaucuuuacaaaccugacggugucaauuucagaaaaaucuucauguagaaagucacuuuacauuuccuugggggguauuagcaaggaaggggcacccccuacgauuaaaugccugugacaucuugacuugcaacagcuaaugacauauuugcuuaugaaauauaguccugacuuuaaauugauguguacauuaugaucugugcaauggggcacguuaacauugcuccgagagacauaauuuuuauacuuugaauucuccgugucucacugcguaacuuaauggaacauuacauucugccugcacauuucaagcucaauggaaauauguaccuaguuucacagauuaaugauacuauaaugguauuuuccuuugcuuaauggacuauacacuuaguauuuucuuacucucuaaugcuaaugugcacuugguguuuuaugaaaugguguuaacuaaaugaguaauaacggguucaugcaaagauuauuagaccagaaggggugggggcagcauacaacucuggauuuugcucccaauuuuaaucuucuguuucuacuugcuacauguagucagccauaccugccacagcuauuucauaggguucaguuaagguucaaaugggaaauaaacaucaaaguaauaaaaaauaaaaaugcugugccacaacaagaaggaaacaauacagauguggugauuuugugaugcagguuccaaauugucugaaaagcggaaauaguauucacugggguauacagaacauuuuuggggggugggagauacugacaauugcaaaaugaaaaccuuuccaaaauguauguauuagucuguuuucaugcugcugguaaagacauaaccaagaccaggcaauuugcaaaagagguuuauaauggacuuacuuacuuacaguucuauguggcugggaaagcccacaaucauggcagaaggcaaggaggaacaagucccgucuuacauggauggcagcaggcaaaaagagagcuugugcagggaaacucccccguuuuaaaaccaucagaucucaugagacuuauucacuaucacgagaacaacacugaaaggaccugcccccaugauucaauuuccuuccaccgggucccucccacaacaugugggaauucaagaugagauuuggguggggacacagccaaaccauaucaguguaucaaauaaacagaugacauuugagacccucgaugcaugccacagaagggagccagaagcuuacaggacccuggaagggcuggggcaugaagucagggagucugcugcucuaguucauggagucaugaugagcuguagcugcugcaaaguugcccacagcacaaggcagguguacucaggcgcucaucuagaagcuuccaccaaccgcacgucuacugucugccaucaggaaagcguguuuccccuccucuaagcacuucuggaucuugugcaaaggcaucacaauagcagagccugacccagacuccuacaggaaaggggauucugggaaaugcaacuuggauucuccucauaagcaggagaggauggacgggagggaagagaggaugcaacauugaugacagacaggccugcacacugggcuuggcagauuaucaauuccauccuucuuuuggauuuagugauggcauguuguguuaauuuucuuuuuaaacaaacacaccacucuuaaagugauuguauuuuaaguccagugugauuuuuuuuaaagaaugucauuuuauuaaagacccaugaaauuuuucucucugcauuggguaagguaccauauguuaauauccaauuagacugguuucugcuauaacauauuaaaaguucaacugugagucauuuacucuuuauaaagagugauggguuuuguuuaucuuaauaacugaaauacgaugaauauuacagaggcaugacucagagggguaaaaagagauuaagaugcuuagaacauuguagaaagcauucuuuggauuuuuuugagcagcaagagaacauuuagaauaaccagaagauccgucugcucaaacacguucagaauuuuuuuuccaguauaaucagaaaggcucuuggcagugaugaacugcacaauuucugguuacggauggcauuguagaauguaguucguguuuguggguuuugagucauccugaguucaaauucugauucugguacuuauuguuaauaugugccaucaggcaauaauaauaaaauaaauagcaguuacugaauauuacaugccagguccugugccugggacuuaacauguauucucuccuuuacuccuuaaaauaacacuguauauuucucaauauacaugagaaaauuggggcugaguaaugacaaaggauuuaucccugcaaaugggaaucaucuucugugcuugcccuuggcaaagugcauucagaaucagaaaaugacagacaugguguuaaaugaaaaauuauaagaaggucaaaaggagaagucuaggguugugcuguccaguaugguagcuaugagccacaggcagcuauuuaaaucauuuaacuuaaugaaaauuaaauaaauuuaaaguucaguuccucagucucaccagccgcagcuaaagugcccaguagccauauguggcuugugguuaccauaucgaggagagcagaacauuucagucauugaagaaaguucuuuuggucagcacuggucuagcgaauucauuguguagauuuuuauaagagugaaaaaaagcagcaaaacucaaaguucaaauucuccguaguguuugagcugaaaacagaaauguggguaaauacgacgcuucuuuccacccacuacuuuccacccacuuuccauguuugggagggaaggagaugaggaacacagauguugggguucuugccaagcuuucacuuaaagaaaaugaacagggacaacaaaugaucauguuuuuauaaccccugaggaccacagaacggauuuaacgugcaugugcaacauggcucauuguuuuuguuguugcuguuuuguuuccgcagguaugccauuggucuugcuuacaaaucagccccgaagcaugaauggauugggaagaacucugcuuccugggcgcucugccgcugcaacaauaacuggguggugagacacaauagcaaggaaauccccauugagccugccccccaccuccggcgcgugggcauccugcuggacuaugauaacggcucuaucgccuuuuaugaugcuuugaacuccauccaccucuacaccuucgacgucgcauuugcgcagccuguuugccccaccuucaccguguggaacaagugucugacgauuaucacugggcucccuaucccagaccauuuggacugcacagagcagcugccgugagcgucuggccacauggagcugcuuucuggggaacaguaagguucaggccacuauuuaggggacugagaaagcacaggcuucaugaguguaaugaaaucucaccagaagugucccgaaaucggcucagauagggcucaaaacaagagauuccucuccuuuuacugugucuuguauuaaguacgggcuuuaauaauuucuuuaauuuuuuuguauuuagaggaaaaucuauagauuauuuauaagagaaacauaaucaggauuacaacuuuuaggaauuacuugguuuugcacauuaagaggcccauaaguuuaucagcuauuuacaaccuucauuucaucacaaucugugggcuuacaaaaaaacaaaaacuuuuguaguuuuguauguuacucaucuucuuaccugauaucccaugaugaucccaugguaggucuucucaccucgauggugcauaacaggauguguuugaaccuaguaggggaggaaacaggcuuucuuacucugguuuaauuugaaguguuuuaauugugaugucaaaaaguuguaucagaucaacuaaaauggagagcaagacagagaaugaaaagaguugauuuuggaccucggaccuugccguggcuaaaucuuuaccuucucauagcugaugggauaauguuggaaagaaagguucugaauccuuuggccacauuuugcccugcuucucucaggguuaaggguucuggaagaacauuaagaaugagauugcaauugaaaauagucauuuugaauccuauugauuauucaaaaauucaggcugauuugucuuuuaucagagguaggauucuguuuuauaguauagaaucuacuuuauccuuccuuuuaauaguuccuuuagaccugugaaauuucuucacuacauuuaauaguucuccuauuucccgcucccccauaucaauuuuccuuuugucuccggggcugaguaaauaaacauguucugucacaaauagcagcaccacuuuggauugauuuugcucuccaggacaucagcacauggcccugaucagcacuaccacauccaaacauaagucacugaaaaacacuuaauauuuaugaguugguaaugacaagggacauuguauaaaguacuauuugcuagauucaugccucaaaaguuauuauaaacagaccuuuauuaaacacaucuugaaagauguagaagucccucuauagucuaguauaguuuacaauagaguuguaagaccaaaaaaaaaaaaaaaaaauucaaacucguuauucaggaaccugcuuauaaaaugucagcugggauucuuugcaugccaaucugaugcguuggaaugguccaugaauuaaggcuuucuugagcaguucuuggcccagaacucuggcauugguucuaguuugaugaagggcaugaccucuauaaaugguuucaauugcuaaaauauuuaccugggauacugggucagccauuuugacugagcagacuaguggauuuagacauuguuuuuaguuauuuuguuuuuaaccaaaucaaccaacugccucccugaaauaagucaaugaacucauuguuucagcaucacguggccaaaggucaugugauugcaaaucuggauuucaagggaggccaagccagcuuccuggguccuuccauccucuucccuagcagacacucuccuuuuucuuaacagauagauucuauauauuuacuauauuauuuauacccagaugaauauuuugauagauaccuaagacaauuucacaucuaaaagauggacgccucaauggaaaaaaaacaaucuuucucuggaaaccuuauagguuuuucuuuuuauuacaauauaaaagcaauguguguuugccuucucugaguaaacugaaaggguugucucaguaauuuuuacauacauuuuggguaacuggauaauggauauuuuaaugcacuuuguacacuaacagguucuaaauaaaagggucuaaaacucagcuucugaguuuuuaaaaucacggucuccagguaccaauaaaugcuacaguuugccuuaugauguuaacauaaaacacuuaguagaaggacaauauuuccaugaaaauaauguuuuucaauauuaagaaguuacuacucaaauuuucacaguaagccauuuaggguauguuuggcuauuuuuauaaggacaugagagauuaugucauaauuuuguuguggaagucucacucuuggcuaacuuaaaagcauuguggauaguagcaguuacuaguuccagguugucauauuuacaggaaaauauguauauggugaaaggccaccguguuuaauuacuauaaugauguagaaaagauucccgugugaauuuuuuuuuugaaagucuaaaaaauguaugcuguaaaaauuugcugcaguguaauuuugcauucucuuuaaacugauugaggucacaguauuuuauuauuugggguccucaccacaggaaacacugcgauacaggggcaaaagagauggcagugccaauuaaauuaauacaacaaaaucaaugcagcaccaaccaagacugccaggucuggugucauggguaugcccagagcccaggaguucagaagggcccuaagccugauuuaaugcucugcuguugaugucuugaaauucuuaacaauuuuugaacaaggggccugcguuuucacuucgcacugggccuugcaaauuacauagcgagugcucauaaaagaacucagaaacgugguaccucucuuccugguggauacaaauaaagaaaucuggauccaaaguugaaaguugcuggcgauaucauucaaguaggacucuaaauaguggauuaagaugagggugggccugggugaagauucuuuccagcuuuaaaagaaagugacuucaaaaacugacugcaaauauugacgaugguuucugcuggaggaaaagaaacagcuugaauacagacaggcuuuuuuauuacgguacugauauauugaccuuaaacuugcugaggaacugaacuaacguccuccagugaccguggaauuccaucucagcuccaggaacaugcagauaccugcaaagagacacgcauauaugcuggcauacaugugcauuugguguugggaaguugaccaucuggucuaucuuaauaaaaugguaaaaagcacaccaagacaaugaugggggcaggaggauguuuuugaaaacagcgcuucucaaccagugcucgauuuugccccccaggagacauuuggcaaugcaauggcaacuuuugguugucgcagccggggaagggaagcuaccagcaucuagugcguagaggucauggacgccguuaaacauccuacagugcaagcgcagcccccgaccacgaagaguugucuugcucaaauaucaacagugcugcaguguagaaacuugaucguugguuuucuuuuaaugcaaaacucucauaaaaaccuuucacuuuuccugucauugauuauaugcuugauacacccaaaaagaaaaggggaggggcaccaauucaccuacacuccaguggcuccaucaccuuuaaaaauauuuauaaaauaguuccaaaaaucugauaucugaaaagcaauccaagccuguguaaaugggaaucacugauaaguaucaucaucuguaucagcuuggcuuggacaugaaaaauugauucucuuuaugucacuccuugcaccuggacaaauucaauccccgguacuuaagucacacugccaagcccucggcccugacuauugucuugauugcuguuccuuucugguucaaaauaaaaucauuuuuguggcaccaagacccucugucucugccugucucuguugccuuuucaucauuuuguguuuuugcaguuaugauguugacaaauauuuauucaacaucuaccauuuauucauacuacuuuaugacauauaauucauuuucuuuuacugucucucauccacuauuugccuuucccuauucaaaauacaauucuuuugcaacacucaaaauauucuccagggaauuuuuaaaacacaauaaaagaaagccuauauagaagug

SEQ ID NO: 192873 - RNA, 175325 nt, Homo sapiens
cacuucuauauaggcuuucuuuuauuguguuuuaaaaauucccuggagaauauuuugaguguugcaaaagaauuguauuuugaauagggaaaggcaaauaguggaugagagacaguaaaagaaaaugaauuauaugucauaaaguaguaugaauaaaugguagauguugaauaaauauuugucaacaucauaacugcaaaaacacaaaaugaugaaaaggcaacagagacaggcagagacagagggucuuggugccacaaaaaugauuuuauuuugaaccagaaaggaacagcaaucaagacaauagucagggccgagggcuuggcagugugacuuaaguaccggggauugaauuuguccaggugcaaggagugacauaaagagaaucaauuuuucauguccaagccaagcugauacagaugaugauacuuaucagugauucccauuuacacaggcuuggauugcuuuucagauaucagauuuuuggaacuauuuuauaaauauuuuuaaaggugauggagccacuggaguguaggugaauuggugccccuccccuuuucuuuuuggguguaucaagcauauaaucaaugacaggaaaagugaaagguuuuuaugagaguuuugcauuaaaagaaaaccaacgaucaaguuucuacacugcagcacuguugauauuugagcaagacaacucuucguggucgggggcugcgcuugcacuguaggauguuuaacggcguccaugaccucuacgcacuagaugcugguagcuucccuuccccggcugcgacaaccaaaaguugccauugcauugccaaaugucuccuggggggcaaaaucgagcacugguugagaagcgcuguuuucaaaaacauccuccugcccccaucauugucuuggugugcuuuuuaccauuuuauuaagauagaccagauggucaacuucccaacaccaaaugcacauguaugccagcauauaugcgugucucuuugcagguaucugcauguuccuggagcugagauggaauuccacggucacuggaggacguuaguucaguuccucagcaaguuuaaggucaauauaucaguaccguaauaaaaaagccugucuguauucaagcuguuucuuuuccuccagcagaaaccaucgucaauauuugcagucaguuuuugaagucacuuucuuuuaaagcuggaaagaaucuucacccaggcccacccucaucuuaauccacuauuuagaguccuacuugaaugauaucgccagcaacuuucaacuuuggauccagauuucuuuauuuguauccaccaggaagagagguaccacguuucugaguucuuuuaugagcacucgcuauguaauuugcaaggcccagugcgaagugaaaacgcaggccccuuguucaaaaauuguuaagaauuucaagacaucaacagcagagcauuaaaucaggcuuagggcccuucugaacuccugggcucugggcauacccaugacaccagaccuggcagucuugguuggugcugcauugauuuuguuguauuaauuuaauuggcacugccaucucuuuugccccuguaucgcaguguuuccuguggugaggaccccaaauaauaaaauacugugaccucaaucaguuuaaagagaaugcaaaauuacacugcagcaaauuuuuacagcauacauuuuuuagacuuucaaaaaaaaaauucacacgggaaucuuuucuacaucauuauaguaauuaaacacgguggccuuucaccauauacauauuuuccuguaaauaugacaaccuggaacuaguaacugcuacuauccacaaugcuuuuaaguuagccaagagugagacuuccacaacaaaauuaugacauaaucucucauguccuuauaaaaauagccaaacauacccuaaauggcuuacugugaaaauuugaguaguaacuucuuaauauugaaaaacauuauuuucauggaaauauuguccuucuacuaaguguuuuauguuaacaucauaaggcaaacuguagcauuuauugguaccuggagaccgugauuuuaaaaacucagaagcugaguuuuagacccuuuuauuuagaaccuguuaguguacaaagugcauuaaaauauccauuauccaguuacccaaaauguauguaaaaauuacugagacaacccuuucaguuuacucagagaaggcaaacacacauugcuuuuauauuguaauaaaaagaaaaaccuauaagguuuccagagaaagauuguuuuuuuuccauugaggcguccaucuuuuagaugugaaauugucuuagguaucuaucaaaauauucaucuggguauaaauaauauaguaaauauauagaaucuaucuguuaagaaaaaggagagugucugcuagggaagaggauggaaggacccaggaagcuggcuuggccucccuugaaauccagauuugcaaucacaugaccuuuggccacgugaugcugaaacaaugaguucauugacuuauuucagggaggcaguugguugauuugguuaaaaacaaaauaacuaaaaacaaugucuaaauccacuagucugcucagucaaaauggcugacccaguaucccagguaaauauuuuagcaauugaaaccauuuauagaggucaugcccuucaucaaacuagaaccaaugccagaguucugggccaagaacugcucaagaaagccuuaauucauggaccauuccaacgcaucagauuggcaugcaaagaaucccagcugacauuuuauaagcagguuccugaauaacgaguuugaauuuuuuuuuuuuuuuuuuggucuuacaacucuauuguaaacuauacuagacuauagagggacuucuacaucuuucaagauguguuuaauaaaggucuguuuauaauaacuuuugaggcaugaaucuagcaaauaguacuuuauacaaugucccuugucauuaccaacucauaaauauuaaguguuuuucagugacuuauguuuggaugugguagugcugaucagggccaugugcugauguccuggagagcaaaaucaauccaaaguggugcugcuauuugugacagaacauguuuauuuacucagccccggagacaaaaggaaaauugauaugggggagcgggaaauaggagaacuauuaaauguagugaagaaauuucacaggucuaaaggaacuauuaaaaggaaggauaaaguagauucuauacuauaaaacagaauccuaccucugauaaaagacaaaucagccugaauuuuugaauaaucaauaggauucaaaaugacuauuuucaauugcaaucucauucuuaauguucuuccagaacccuuaacccugagagaagcagggcaaaauguggccaaaggauucagaaccuuucuuuccaacauuaucccaucagcuaugagaagguaaagauuuagccacggcaagguccgagguccaaaaucaacucuuuucauucucugucuugcucuccauuuuaguugaucugauacaacuuuuugacaucacaauuaaaacacuucaaauuaaaccagaguaagaaagccuguuuccuccccuacuagguucaaacacauccuguuaugcaccaucgaggugagaagaccuaccaugggaucaucaugggauaucagguaagaagaugaguaacauacaaaacuacaaaaguuuuuguuuuuuuguaagcccacagauugugaugaaaugaagguuguaaauagcugauaaacuuaugggccucuuaaugugcaaaaccaaguaauuccuaaaaguuguaauccugauuauguuucucuuauaaauaaucuauagauuuuccucuaaauacaaaaaaauuaaagaaauuauuaaagcccguacuuaauacaagacacaguaaaaggagaggaaucucuuguuuugagcccuaucugagccgauuucgggacacuucuggugagauuucauuacacucaugaagccugugcuuucucaguccccuaaauaguggccugaaccuuacuguuccccagaaagcagcuccauguggccagacgcucacggcagcugcucugugcaguccaaauggucugggauagggagcccagugauaaucgucagacacuuguuccacacggugaagguggggcaaacaggcugcgcaaaugcgacgucgaagguguagagguggauggaguucaaagcaucauaaaaggcgauagagccguuaucauaguccagcaggaugcccacgcgccggagguggggggcaggcucaauggggauuuccuugcuauugugucucaccacccaguuauuguugcagcggcagagcgcccaggaagcagaguucuucccaauccauucaugcuucggggcugauuuguaagcaagaccaauggcauaccugcggaaacaaaacagcaacaacaaaaacaaugagccauguugcacaugcacguuaaauccguucugugguccucagggguuauaaaaacaugaucauuuguugucccuguucauuuucuuuaagugaaagcuuggcaagaaccccaacaucuguguuccucaucuccuucccucccaaacauggaaaguggguggaaaguaguggguggaaagaagcgucguauuuacccacauuucuguuuucagcucaaacacuacggagaauuugaacuuugaguuuugcugcuuuuuuucacucuuauaaaaaucuacacaaugaauucgcuagaccagugcugaccaaaagaacuuucuucaaugacugaaauguucugcucuccucgauaugguaaccacaagccacauauggcuacugggcacuuuagcugcggcuggugagacugaggaacugaacuuuaaauuuauuuaauuuucauuaaguuaaaugauuuaaauagcugccuguggcucauagcuaccauacuggacagcacaacccuagacuucuccuuuugaccuucuuauaauuuuucauuuaacaccaugucugucauuuucugauucugaaugcacuuugccaagggcaagcacagaagaugauucccauuugcagggauaaauccuuugucauuacucagccccaauuuucucauguauauugagaaauauacaguguuauuuuaaggaguaaaggagagaauacauguuaagucccaggcacaggaccuggcauguaauauucaguaacugcuauuuauuuuauuauuauugccugauggcacauauuaacaauaaguaccagaaucagaauuugaacucaggaugacucaaaacccacaaacacgaacuacauucuacaaugccauccguaaccagaaauugugcaguucaucacugccaagagccuuucugauuauacuggaaaaaaaauucugaacguguuugagcagacggaucuucugguuauucuaaauguucucuugcugcucaaaaaaauccaaagaaugcuuucuacaauguucuaagcaucuuaaucucuuuuuaccccucugagucaugccucuguaauauucaucguauuucaguuauuaagauaaacaaaacccaucacucuuuauaaagaguaaaugacucacaguugaacuuuuaauauguuauagcagaaaccagucuaauuggauauuaacauaugguaccuuacccaaugcagagagaaaaauuucaugggucuuuaauaaaaugacauucuuuaaaaaaaaucacacuggacuuaaaauacaaucacuuuaagagugguguguuuguuuaaaaagaaaauuaacacaacaugccaucacuaaauccaaaagaaggauggaauugauaaucugccaagcccagugugcaggccugucugucaucaauguugcauccucucuucccucccguccauccucuccugcuuaugaggagaauccaaguugcauuucccagaauccccuuuccuguaggagucugggucaggcucugcuauugugaugccuuugcacaagauccagaagugcuuagaggaggggaaacacgcuuuccugauggcagacaguagacgugcgguugguggaagcuucuagaugagcgccugaguacaccugccuugugcugugggcaacuuugcagcagcuacagcucaucaugacuccaugaacuagagcagcagacucccugacuucaugccccagcccuuccaggguccuguaagcuucuggcucccuucuguggcaugcaucgagggucucaaaugucaucuguuuauuugauacacugauaugguuuggcuguguccccacccaaaucucaucuugaauucccacauguugugggagggacccgguggaaggaaauugaaucaugggggcagguccuuucaguguuguucucgugauagugaauaagucucaugagaucugaugguuuuaaaacgggggaguuucccugcacaagcucucuuuuugccugcugccauccauguaagacgggacuuguuccuccuugccuucugccaugauugugggcuuucccagccacauagaacuguaaguaaguaaguccauuauaaaccucuuuugcaaauugccuggucuugguuaugucuuuaccagcagcaugaaaacagacuaauacauacauuuuggaaagguuuucauuuugcaauugucaguaucucccaccccccaaaaauguucuguauaccccagugaauacuauuuccgcuuuucagacaauuuggaaccugcaucacaaaaucaccacaucuguauuguuuccuucuuguuguggcacagcauuuuuauuuuuuauuacuuugauguuuauuucccauuugaaccuuaacugaacccuaugaaauagcuguggcagguauggcugacuacauguagcaaguagaaacagaagauuaaaauugggagcaaaauccagaguuguaugcugcccccaccccuucuggucuaauaaucuuugcaugaacccguuauuacucauuuaguuaacaccauuucauaaaacaccaagugcacauuagcauuagagaguaagaaaauacuaaguguauaguccauuaagcaaaggaaaauaccauuauaguaucauuaaucugugaaacuagguacauauuuccauugagcuugaaaugugcaggcagaauguaauguuccauuaaguuacgcagugagacacggagaauucaaaguauaaaaauuaugucucucggagcaauguuaacgugccccauugcacagaucauaauguacacaucaauuuaaagucaggacuauauuucauaagcaaauaugucauuagcuguugcaagucaagaugucacaggcauuuaaucguagggggugccccuuccuugcuaauaccccccaaggaaauguaaagugacuuucuacaugaagauuuuucugaaauugacaccgucagguuuguaaagauuaauuguguagcaauuaauuuuagaauuucuuuucccccucaugaguuaguuuugacaucuggaggguguuuucaagguaaugcugauguguguuuauauaacugaaguggucugauggaauuuugcaaacuauucaucaauggcaaugagaucauaaugaucagguuucauuuaucauaauuaauuauuaauagaguaauaaucauuuagacccuggauucuaucccagauuaauacagcacauuaauuaacuagaaacauuugcuuuuuuuguaccugcauccauuguguuuuccuuugugcuuuaauuuugccccacugcagcuaaaaauugcaaaugccaaucuagcccagagccuaguggggugaaggauuuguccuccauccucuggcaggauguuggaacagaaaacucuucuaggcaaagagaauuaugaggauagcaacaaaggaaaaccuacucgcucagccaauauaguauguaccauuauugggagagaugggaagcuuacaauucacuucuuagauuuuuggcuaauuucuaccuacaauauaaaggacucagccaugucacauuauuugcauagguuugaauugaaagguuuuuuuauauauaaauaaguguuuuaucaugcuuauauugaaagaaacacuguuauacucaccaucuucaggcuaugcaauuuugaauguugauuuuauuuuuuaaagcaaggauucagcuaucacucauuacguacacugucauaaacccuagagaguaauuauagcauuucaaaaauauaccacccuuuugugaauagcagcauaccauggugguuaagagcggggaacagcaaacuacuacccaggggccaacucuggcccucugccuguuuuuauaaaugaaguuuuauuggaacgcagccauguccauuuguguagguguugucuguggcugcuuucccacuacaacagaagagucgaguauuagugacaaaaaucauuuggcaugcaaaaccagaaauauugaaucucuggcccuuuacagauaauguuuguggacugcugguuaagagccugacccuugacugcagacuuacugacucugccaccugugagcuuuguaacccugugaucuucagcauauaccucagucaccucaucaguaaaguggauaauauuagcaccuaccuuuguagggcuguaaggcugaauaaaugaguugacaucuguaaaaugcuuagaccagugccuggcacauacuuguaccauaugagggcuuguuaaauaaaaauaaaauagcucccuuuuugaucaauagcaagcaggcauuugugagacagacggucaaaggggugcaguuguggcuguggauuaggcaagguuaacuuugugagguuaacuaauuccaauguaauuguguccugaccuuugcccuuauucuuagagaacucagugggcuaaagucacugggcuggaucuaacaggccuuuugaaauuauucccagccuaugaucacugcuucacccccaccauucaacccuuagcuauuugcacuaauugguccagucuagaaccauaaaacauacaaggcaacagaaauuaguuuuguguaaugaugaagagugauguuuaaaaguagggaauggcaaacuuuuucuggaaaggaccagaaaguaaguaaauauuuuuggcuucguagaccauaugauucucucuuaacuacucgauucugcuguuguggcugaaaggcagccauggacuauauguaaaaaaauggaccuggcuguauucccauaaaacuuuauuuacaaaaccagguagcaggccagguuuggcucaugggcugugguuugccaacccauguuucauggcaugaaagagcaguguuaacaugguauagcucauccaaugaucagagcucuauaaucuugaacagagaacccacagguguggguauuaguaauauaugguuguuguuugaaucugcugaguuuggggguguuuguuaugcaguauuauccuagcaagagcugacuaauacaacuuuucugcauuuuauucuuuaagaugcauuacaguauggguugacucucuaaguacagaaugagaugugccuuuuuauaacugcaggacaauagaaauaaguugcuuaccaugugcuuccacuuaugaccacuucccaauaaugccggccacuaucaauaaacacauuuccagcuacuccauagcuccccuggcuggugaagcguucaggugugugacucuucuuggaugaugacucaucacguucuacugucaaguuaucaugggacaccuucaguuuucgaugagcagauuugggauccaguuuaaaugguuggccugaaaacaaauucacaaaacagaaaaaggaagaggaagaggauuguuuauuuuaucauaaccaauagcauauuuucaaaaucagguuuaaaagacaggaacaagccagcccucccugagucaugccuccuaucacaaagugguaucuuauauuuuaauaguaauuuaaacauuauaagcaacuuucaaagacauuugcuugcaaaguuuucauaauauucaaaagacaauagagagcagcaacucuguguauaguacaguacacaguaagagugaaaaagaacauguuccugucuucauaagcuuucagucuaccaguucuaagauagggauccagugguggcaugccaacuauucaacaacagcauggauaaggcuuagccagaaaacauagggugagcuagcuucacggauuccagguguauacaagcagcacagguacauacuggcuggauagcauccugaaaaggaggaaugaaugaagacuccauuuucaaccacugcaguguucuauccagcauaagaugcauucaugcucaauagacuucagaccagaaaccaaacaaaucaagaucuugggucuuaacauauagaauauucuagagguuuauauuauucugagauuauuaaaaauuaaagcauuacucuuaggaauuuaggaugagaauacaauuuucaggccacaaaauuaggaaaaaaugugauagcaaugccuggguuuucuacucaugaaauuauuuauauauaauaaggccuucucuauuucauuacucacauuugugucuuaaagauuuaaguauuaaaaaaaucuuggcagagucacaccuggacauuuugucauaguuguuacuucuucuuugacaauucaauauugguuuggaguacugccugucauucaacacugcauuggguacaaggcguuuaaaggcaggaaaugcauugcaaccugauacaaaugccaugguguccaaacuccacagucacuguugcaguuggcagguuccuucugcccaguauacagcucucaaucacaggaaaaggucuaguaaauucaacuguggcaauacacgaugcugggcgagaaacugacccagugaguauaggacaguguguguugucacauguggguaggccaaaggauuuccaguugccuuuuggauacaaacacaacacaacaccagcaccucuaaaauccuuucuuuuuaggucacggaccagcauacuuuuucugcaaagggccugacaguaaauauuuuuggcuaugcaggccaggccauguggucucuuuugugacuauucaacucuucugcuauagugagggggcagccacggacaggacaauagguaaaugaauggguguggcuauaugcuaauaaaacuuuauuuacaaaaucaggcagccagauuuggcccuugagcuauaguuagcuggcuuuuguuuuagaaaucuauuucuguacauaucaaagaaaagcuuaggcugggcugguggcucaugccuguaaugccugcacuuugagaggccaaggcagcucgauugccugaggucaggaguucaagaccagcuuggccaacaugguaaaaccccaucucuacuaaaaauacaaaaauuagcugggugugguggcggacaccuguaauuccagcuacuugggaggcugagccacgaguaucacuugaacccgggaggcggagguugcaaugagccaagaccaugccgcugcgcuccagccugggcaacagagugaggcacugucucaaaaaaauaacaauaaaaaagaaaagaaaagcuuuaaagggggagcagagaaaacccucaagggcugagcagggauuggacauucucagaggccguaagaucuauuggauuacauguguaguuuaaauuuugacuuguaaaaagaaguccuuaggaaugaucaugcuagcaacuaucagagauaaacuaugaacuaagacaagaagaguaugaagacaguuuugcuuaaaauauuucaauuuuuaaagguggaagguagaauauggauuaaaaaugauugauaggauacuaaugggcagagcaggaagaaauuccuuaauggcgcccaucauuuacaaugaaggccaaguucugcucggccuccuuccggugagauauaucagaaugucagagccauuggaaagaccggccuugugauggugacauacugccucaaacauccugccugccuuggcucacacccucacccacgcauguguggagcagaaucaugcaaucuuggugagcaaauucugcccaugccucagauauguuucccaaauaaaccacuaccuacucugcccaaauucaaggcuuuugcuucagugaagacaaauuaguucaagaaagagauuaauagcuuacuuuacuaaauaauucaauucauuauaauauuuguaugggacacgacucuuauucaggccguuguuuacuuacauggacaacucuuucaauaaucuuuugauacugugcccagcagccagucuuccuuccuuguaauccacucaccacaucauagugcaagagagcuuuauuucauggaaauuuucauccugccuguuugauuuaaacucuucaaucucuccaccaaucauugguauacaaagaaacucccugguguggcccaggaggcuuucgcgaucuguucuugucuccagccuccuggcucaccuauccucccaaccuaagacacacuuuaaccacauggaucaauuuucuguuccauaaauauauucuccuugucucugggcuuuugcccaugcuguuccuucugcauggaacacuguguccucacauccccugcuccuaaccuaccuuggaaagccucucaagguugugcuggggcacccuggcuuugucaacuuagaaccucucaugguuauuccagucagagauuucacauauugaauguuaauuaggauuaaugugcuuuauuccccaauagucuaggaccuuuuugagagagaagcacaccuuagggaguugaagauacucauaauauccuuagcaucuugcacagcaucccaaacacacuuggugcucaaacauaucuuuugaaggaacaaauauuuacauguucaaaugcaaaucaaauaaugcugaucuaagugugcauagguauugugccauuuguuguaugacuguaaagaaauauaucaucauguuauauucucuuauguacuuuuagaauuacuuugagagggucuuuuugacaacucauaacaacccucaaguuguuaaaauauucccauuuuaaaacugaaggaacacuaaaugcauugugggauccuggauugggucccggaauaggaaaggaacauuaguggaaagcugguaaaaucugaauaaagucuggaguuuaguuaugaguaauucaucaauguuaauuucuuaguuaugauaacuguaccaagguuacauaagauguuaauauuugggcaaacuggguuaaggguguacagaacucucuguauuaucuauggauuuccuguaaaucuacagcuauuccaaaauaaaaaaucuauuuaaaaauaugaagaaacuagccauauagcuauauggguaccaagugggaaagccacagucuucucauucguaauucagugcucucuuuacaucccuuguucuuccucuaggauccaacacauuccucuaggauacaacacuuguacugagaaacaaggauauagguuaaaugaggguuccccuugaaaagcacuuaauuguuccuguugacugccuggcaaccucacaacauggcgccauaccgacacacuccaauuugcuuucucuugggaggucuuaugcaaauaaacaccauguuacauaacauaauauuccuagaucaaaaggauguaaagaaagaagagaggauaaaacaaaacacauguggacagagagagggagaugacaguaucaugagacacacauauaggccagaccauucucugugaugcgcacuguccuguggauuggggauguuucccaucaucccuggccucuacucacuacaugccgguagcauccaccucagaugugacaacuaaaaaccucuuccagauauuacuaaauguccugguagggugggguggagggggaggaagaagugucccugauugagaaccacagacuccgacuguuuucuagaauaaaagaauuucugaagagugauuaguuggcuacucugcuaugaaaaauaacacuauccaccauuuacagagccccuacugugugucaggucuuacauauacaucaucuacuucucacaagaaugccuccaggaauauuuauuuaaaaaaugagaagacucaauuuuuuaaaauugaguaaugcagagagaguaauggccucacggcugugaaggaauagaaucaguuuuggaaccuagagguaucugaugcaaauuccauuauuccacacuggcuuuuuacuuguuuuggggggcugucaaugauacccaagacagagaaaaggaaaagaaagggggacagagucagcugaaagaagagcagauaagacaugacagcucuguugaguucacagcacuuacuguuugucuucaacuucccaggcucacugcugcggcugcccgccugguugauggccuugaccaugaagauguacuuggugccgcucugcagaccgugcaccguguagugguucugcuugauguuggguacuaucauccagcuaucagccgaauuacacagaccugcaaagccaaucagacauggugcaguucuuuggcacaaggggagcaauguuugcauaauuuuagguugaauaauuuccauuuauuugaauagaguugguaagugaagugcuuugucuugguagucauguacgaaaaacugacuucacuaacguagauguggcagauugcauuuuugccuccaaaauucucccugcccuguauauccaggcccaaauaacuuugcaggugcuccuucuaaagaggugcaauauauuucccugucauguggcuuugaauuuggucaagugacuugcuuuggucaauagcaugaggcugaaaugacaaugugcuaguugcaagaguaggcaugacaaaaccuugaggguuucuguugacccuuugugucugccacugcucuggagaaaauaugccuaggauacucuguuuaucccaacaggaugagacagggaacagcuuuaccaugcagccaacgcccagccagugcaggagugaaccaagcagcgaucagccaaccccaaccgaccuccaacagggaagcuaagaaaugaucaucaucccuaggaugacugguuucagaguggaguggggcuguugcucuggcugcauccugcaggauguggguuggggagcagaccgaguauuuaugaugcuuggaagaauauguaggaaaaggaagcccaucuuguuuugcagcugguugauggcugaaaacaucucuuugguaucagguccaacuccccucucuccuuuuuccacccaucaaucuccacuccaauagaaccuuuuuccaaacccuuggugaccaggcugucaagaaguuuccugacucuguugaauuuccuucacugaucccugggagagggcugggcccccuccacuuccagaggacuccaaagccaccaccccacuccucuuucaauugauuugcaagucaaaggguuaguuccuuugaucuugaggcaacuuauacuuuaccagauucucaagaagcagucccuuaaucuuuuuuuggucucaccucuuugauaaucuaauaaaaccuuucuguaguaagaaauucacaaaugcauauacacaccaaaccacaaauauaugcauagaauuucaagguagucacaggcucccgaagccugucuuugaaucuuacugaauacuuacuuacuccaucuuuugaguuaaaaauuauucaugguauugucacaguugaaaaauucaccuuauaugauuuccaucuugggugcauaauauuuucaaguacacaucagugaauuaaauauauauauauauauauguauguauguauauaucaucuaaagauaucuaaagauacacacacacacacacacacacacacacauauuuggucuugugaauuuucuguugccuuuuuuuuuuuuuuucucuaaccugcaaacauuuucgccaguggacugccagauuugaaaaagccagcuugaagcaagaauguaauuuaggacucauagaaggguuugaguguguguguguuuauauuuggagauucagcagagcaauaagaggcacaauccaucccuccuccccaaauuuauuuucucuaauucuuagcccucuguuuuccuaccaauucucauuugcauaugaugcaggaaaacauccacaaauaguuuaguaacaugggaaucuccuuacuauauaucccuucugaucuuccuucaccuuaccuuuuccuugaacauagcuauaauaaacuccauacuucuggauaaugccacagccaaauauuagauuuugauccaaucaaagaagggucauuuugaacucugaguucugggccccaagaggccuauaacucucuuuagguacuuaauauuauuacaguaguaauaaaacaaaaaauuagcuuuucuauuauguaggauaguguacucauauuccuagaucuuugucaauggcagucagccacgaaugagaacaauuaaggcauucaguagauucaaaugagaaucguaucaauuucacugccuuuauacuguuccuguuuaauugaauauguuacaaaaaaaugacuauuguggucaaagaaagcaaguguaaaaauguuucaauaaacuuuacaucacuguacaacccaaaagcuggguuuaauguggugggggaacgcuuucaguaacaucauaaagcagaugucugaaauugcugaaaacuguaacuuggccuaaaauccaaagucuuaacccaacaaagauuuuauguuucagaaaccuuuuccaaacaaaaagggacucugacuauccugauuauuuugaagaggucccuauuuuuuccuugaaaauuaaaagaacaaaauguuuaugaaguaguaaaauuucauugguuagcuuuauacugggacaaucuacuuucaugaauacuaacaaacacuauuacuguuuagguuuaccuuuauguuauuauuauugccaagauaauaauugagaaguugauuaaaaaugccaggaaagcaacauugacaauuuucuucugggggcuggaguaaguggggugacuuggagugcaccauuaccgguguuggucuuacgccagcaccaccuaacuucuugcauauggcacugaguuugcuuaagcaagacuucucugccuugacaccccacuguguuaggacucuugaccaggcuuuauucaucucuuuaugaaacacccacacaaccauccugauugaaacuucacuuuucuccaaacucauuuucagucaucuuugaggguguuccaacauucaccuccuccgacucaguuuaaaauaacaacggagcuuggaaaauaauuuguccacaaugaaaccuaauuaauugaguuuuuugauuuuauacauuuuuuuuuucauucacaauggguuagaagcauuucccuacauaauguggcucauuauaagaucuuaauuacaucugggauuucagagccuuguauggcaacugucaucuugccacaaaaaauuauguguaaaaaugucacaugauguggacagucuuaggagaggcugcacacugguuucuaacauccuuugucucuuccaacagacuggacagaagugaacauuccuuuccuucuccucuguaaaaauaguauauguuuaauaauuuucaugaauguuuucuaagugacuacaauaaauuaaaaacagauaacuacuuagccauuaaggcuugaaaaaaaugcagcuuuugauuucugcuaagaauaagaauaggcugcuggggaaaggacccaauuuaagacuuaaaaugaagcaucaaaaguaguuuuagagaaaacguggcaaacguuguaaaauuaaauaaauaucuaguuauugauaagcaauucauuaacaucuauagucauaacucuauuaacaaaaauaaaaaauaaaaauuaaugucauuacuuuugcauuugaauguauguauuucauuagugagggccuuuucguaagauugaaaaagcuccauagauauuaucuaagucuccuucacuaacgccaguugaaggcaauuaacuacaauuuauuaggaugagugaaggaaccaugaccuagagacaguaaaagauuuucuagugauauaaggagcuacagccagguuuugagcauuauaucuucucauuuucaguagaguuuuaccauuagaccuugucacgcaauacaacaucugcaaaggauacuucuccaaauaauaggacagauuauuuaacaucauucaaggaaagccuuucacauacugauuguguaaaaagcuaucauguagauaauccuggaaaauugcaaaacuggucuuucuuuuaaaaugcaauuauggggugaguacaguccguauuuuuguaggaauaauaacuuugaauaucuaugugcuaccacuguggcaaacacaagacuaagguguuuacuauuauuaucucaaccaugugaaguuaaaacacuaucccuucuuacagaugaggaaacggauucggaggacauuaaauaauuugcucaagacugcagagcuagugagguccaaagucaagauugaaauccaggucuccuuuggucacuacaaaugugaaaaauauuuaagaagaaaauaauuugaaaaucuuugccuaucgguuagcuuuuuaucugaaugaauucuuucuuugucgcaaauggauccuguaggcauuaggacuucacuauucugguuuaaugggcaucaagggaggaacacauccugauacaaacaacccggugagaguaucccaguuuggucagcaccagcaguuucacuguuuuucuuccauccugggagaaugggccuuucuggcaucuaugcguuaaaggcugauaaucuucacuaagccauuugcauuucuuuucuuauggcaacugguuucugggaacaaaacaucucuggaaucacccaacauaaaguucugaguucauuauacugagugguuuugcucuuguugaguuuuuuuaugcaugaccuuuuugcaucaucuauucuauuaaugcaucauguuugguauuauuuucgaugcaaauagcacagaaaucaaguuggucacaguuuagccaagugagaaacccuaaguuucaagcaauaaauaucuuccuuucauuuuggggaugaggugaagcucugguauugaguuagggccuuuuggccccaauuccuugcuccuuccuuguaauuuugcaggucuuugcauucucacucugggcucacccaggggacgucuuugacaaaccucauguuagcuaaugugacacagacaggggcuuaaaaagaauguguguaauugguccugccuuuacuccuucaucucugcaaucagggugagagcagacuugagcuggauuguaggaggaugagacagaugugcagcagucggguugccacaguuaucagucugccaugugagggagccaagaucagcagggcuuccuaguugacacucaguugacuccagaugcauaagcaauaugaauucuacuuaggcccugugguuguuggcuauucagcaaaagccaacggauacagagcccaucagucaaggccaaggcuacauguacucccaaaguguccaugacgauuugauuuaagaaauuucaggagagggcugggugcaguggcucaugccuguaaucccaacacuuugggaggccaagguggguggaucacuugaggccaggaguugagaccagccuggccaacauggcgaaaucccaucucuacuaaaaauacaaaaauuagccaggcgugguagcacauguuuguaaucccagcuacucaggaggcugaggcaggagaaucauuugaacucuggggguggagguuguagugagccgagaucaugacacugcacuccagccugggcagcagagcaagacugucugaaauuuuauauauauauauauauauauauauauacacacacacacacacacacacacacacacacacacacacacacacauacauauaugaaagaauaaaagaaaaccaaaagaaauuucaggagagacauaaccaucugaggaagacaugcccuaggaugguccccaggauuccaacucccugguauucauaacuguguaauauuaucuccuuaguguaaacaggaccugucaucugcuucuaaccaacagaauauggcaaaggacaaaggucuaucacuuuuauuacuccuguuuuuauauuacauuauaugacaaaggcgaaggcgaagggaguuuacagauauaauuaaggucccuaauuauuugauuuggagcuaaucaaauggcagauuauucugggugagucugaccuagucaagugaguccuuuaaagacagguuuggaggugacagauuugaaguagcagacucucucccuugcuggccuugacgaagcaagcugccaugaauuccacaaccacaaugaaacaaauuugucaacaaauggagggagcuaagaaguagauucuuccuuaguugagucuccagaugaaugcagcccagccaacaccuuaauuucagacugugacacccuaagaagaagacccagcucaacuaugccagaauccuaacccauggaaacugaaauaauaaguggguauuguuuuaaacugcuaaguuuuuggaaauuuguuucacagcaauagaaaacuguuagcacuuuuccugaaucagacgaaaaugauuugagagaaauauagcauuucucacaugggccaagaaccacucuuuugguauaaaaugacuccaaauguuuucuuuuuccgguuagacuauucacucaucaacagacguugguucuaucaguccucuauguauuuucagagaaccuuccuugguguuuuacaaugaaucaucucuccauuuucuaccugcucuucucagaccuucacgugcuucuuuucucuuaccuuggaauuucugaucaucuuuugaauuucaucuucuucaaguuugauacaaucccugguucaguuuaucccaaauaugcuagugauauuaaucacaaaauauugagaaaacaauuccuuaagugaagacaaaauacauuaauuauauuccccccuuuuuguuguguuuuuccuuccaugcuacauaguauaguaguguguguggaucaguguguuauggucucaguauuuagcauguaaucauguagauauuauacauuuaccuuguuuuaaauuaggguuucucaacuucgacauuacugacauuuugggccagauaguucucuguuguugggggauuucuugugcauugugggagauuucccaucuuuccucacuucuacccacuagaugccaauagcacccuccuccuagguuuugagaaccaaaagucucuagagacauugucaaaugucccuuagggggcaaaacugcccuuguugagaaucacugcuuauaugaaggagugacuauuuaguaugauauuagugaucauagauuaacuuguguuucagguuuauggugaagcacaaucaagguuuaaaauuuuacuagacuuuaauuccacguuaaguuuaugguauauguagccaagaucagugaaauacaauaagcucauacagcuggaaaaaugcauuuaaaaaucaugucaucucucugaagggcaauuuggcaaugucaaguaaaauuaaaugcaaauaaucuuuuccuagaaauugcaccucaagagauuauacuacagauauaauuccccguguguggaaggagagauauucaaggauaucuugaacauccuuggggauacuggggcauuguuuguaagggccaaagauuggaaacaagcuaaauaaacaucuauagaagaugggauaaauaaauuagagcauaucuuuaaaauaggauaugauacugccucaaaaaggaaugaggcaguucuuuauuugugcugaaauggaaugauaucucagacauaauauuuauugaaaaaaacaagguaaagcauuguguaugauaugcacauguagaaaaauauuuuagagaauuaguauuucuuuaugauuugcaguagggcauauagagucagaaaugaggaaugauaccagaagaauucaaaauccuagaaggugagcaaaauguuacuaaaccauugcuauacaggccuucugcgacuugccccaaaaagcacuucaaauaucugaggacacugaugauuuuuucccaggaaaaugggccagacgcagagaagucuuccuggaauuaucuuuuccuuuccaucucugaugcuggugccauuugcagguccuggcuauuucugccucagugaauuacuacgaaacuucccagcugaugucucugcuucugguccugcccuguuccucuccacucuccacagugcuccugagucaccuucuaguuauaccucugauuacauuacuguccugcaugacucucaagcccacaggguaaaauccaaacaugguauggccuggguagcccucugcaaucuagcucuugccugugaauuaggauuaggugacugaggauuaaggauuaagaacaugugcuuuuuggagcuaggccaauauagguuugagcccugguucuauuucucuaucuucauuucucacugucucccuuuccucacuuaccagccaggcuuaauuaggcaagaccucccacuaugcccugcuacguuacaucuugauagauuugcuuaugaugacauagcuguccgguacagccuuaacuugcuaaaaugcacccgcuuuuuuucaagacuuaguuuaaccacaacuucccccaagacauuuuugucccacucaccauuucugaccuuucuauauucccuacugacucaggcagcuugccagagcuguucuugacauugcaugacuuucuccacuuucauuuaaaaauuacacauucuugguaaauggcaagauuuuaauaaaagcuuccacggcaggccaauuauaggguagaaggugagggaguugaggagaggaaguuggagaaguuggggagaguggauauaaggaagguagggggagccauuuguugguaugggucauuuauacuuuagucccuuagaacuugguguauuucugcaucacucuuuuaauuaauccuaaaucaaauuucuauguuaagcaucguaugacucagaauuacuugugcuaggaaagagcaguuuguaguuaagagagaaaagguuuauauaauaaaagcacauuaaauugauaugaauuuauucaaaacaucucuuuguugaaacaugacugcuauucuauucuguucuauuuugacauauuguauuuuucuuuguuaaagaaguuucaagcuugcucccgugaaaagccaugucuucugguccauugccauuugcccaguucaauuuaaauaacucuguggguuggaggacugcuuccucuguuaucaucucuguggccugcuacuacugcuauuugaaaucaccaaguuaucucugaugccagauaucaaauaggccucagugagagggggcaccucuaauguuucagguaagguuggaaauucuucccggguggggccaguuacuaacauuuuaagugaugggcccagcucucuccucugaaugggaccagguauuuaacuuucuuuggcuauuuauuuuauuaaauccuuucuuuuaaaauaugugaaguaacacucaggaaaguacauaaaacuaaauguaugauaaaaugacuaaagcauguaacuuucaccuagaaauugccauuaaccccaagaaccccuguauauuucuuuccaguggugccacuugcccuuuaauccuggagguagccaucauccugacuuuuuauuuuuauuuuuuugagacagcauucucacuguugccccggcuggaguacuguagugugaucucugcccacugcaaccucugcuucuugggcucaagccauccuccugccucagccuccugaguaguugggacuacaggugugugucaccacaccccgcuaauuuuuguauuuuuuuuguauuuuuuguagagaugggguuucaccagguugcccaggguuuauaguuuuaacaccuaugaauguuucuuuaagcaaaauaguuuauuuugaucuuuaaguuaugaaccuauauguggauuaauacuauauauauauauuuguuucucucucuauguaucucucuauauauuuguuucucucuauauauuuguuucuggcuucuuucccuuaacauccaugugguuugcuagaggucauuaauuuucaucaauauuuagccagcuguuuuuacuaauguaguacaagugagugcuaucacuuuuuuguucaagaaagacaagucaauaaauauuguguguucuuuccuuccuugucuuccuuugaaguuuaaauucaggaaugcaaucaaucugaagaaagccaccaaagacagaaauaaauaggccaugagauacucacuaacgacguuggcuuguccggugaauaugguguacuggagcucguaggagaccacgcugaacucaucaucggagguccaaugcacagugauggugucauaugaagcugugcagagcucuucucuaauugugggaggguugggagcugugggggucaagaaugcuuaucaguggaaaagcacacacaacugggauaccauuucagaggagauguuugacaguuaagcagguccuucucaauagguccaucaggacuacuauccuagagauggugaccccaaucuaaagaauaucugauuggcugguuauugcuuuuguuuuuaauaaggagugugacuagagucagccaguauggacuuucuguguuuaucaugagaucaugagaauauguuugggagguuaaacaaauaauacuuucuugugcaugaaggaaaacuugucaaauaaaaaguaaacaagauaaaguuucauagcugcauucacuuugggagguuggcuaacuuuuucaguaaaggccuugaugguaaauguuuccagcuuugugggccauacagucucuguugcaacuagucaacucugccauuguagcaugaaaacagucacaacuuauacaugugggcauggccagguuccaauaaaacuuuauuuacaaauauagguagagggucagauuugggcuguaacccaaaguucaccaaccccugaccuauuaauacguggugccagauacuuauaucuuuaggcacccaauugaaaaaauacuuauguuuguuauccuacaaaaaaucagccacauaauuguuugaauuuuucuuucauuagauguuucgaugacuuacauaaaaaaaagaacuuacuaguccagcccuauuuucuucucauuucucaacucaugcgauauuucaaauucagaagaccaugauucauagucaaucauaucuaaaagguacauuuuccuuccccaaggaaaaaacuuuuuuuuggcauuugguuaauuuaucauuguagaaggcugcuguuuuauuucuuuaacacauucuggagcagagaagucuaaguccuaccaaaauaaugaguuuaaaaugacuucuacugaauugauuucaguaacugguuuuaugagaagaguaugugagcaaggaaaauaugagaaaaugagugcuuugcauuguaaauaauauuuuagagggagggguuggcaaacugugacugugggccaagucuggcccacugccuguuuuuguaaauaaaguuuuauuggaacacagccagauucauucauuuauguauugucuauggcugcuuuggagcaacagcaaaguugaguaguuguggccauauggacugcaaagccuaaagugucuacuaucuggugguuugcagucaaaguuugcugaccucugguuuagagaauugauccagggccuuuacuuccacucuucuacccacuagaaucucacuucaaaaggagaaacauaccugcacucuacaaacuaggagcaaccuuugcuuguacuauuucagaguuauuuccugcucuaaauuaugauuagaauugaugaguccuaagcaaacccaaagaggaagaaaaguuuauaaaaacuguaaauuuaaacucugcguuaguagucuucacuuugcuuuuugaauauaccucuaggacaaguaucacagaagcaagucuacgguauuaagucaauuagcuuagcuuuaucuauugguucugaauuccagaaacauuguugagcaccuccaacgugacaggcauggcauuaaauugugcauuaagacagaaggguucuacauaaccuuuaaagcauucuuucuggaauauguauuuguacaucugucuccugaaguauucacaugugagauuuagugucaugugguaugacuuggaugugcaugaaucagugacaccaaucaggauaugcauuccacggaggagguccagcugcaucguaaaaugugcuuauuauugucuguguggucccuguuggugugggaucacuccugcauggaccagugaagaaauacuuacucucucacaauuuaaacaguucauugaauuauuucuccaucaaccauuguagaaaaauuuuguucuguauugcaauauacaauuaaauagaaagaaaacguauguucaaaauaggcaaguagcugugagacacaugguaguagccauaaucaggaaggaaaugucaccucuauggguuauuaacuugauauaccacuuagaggcaugucauaggaaaaaaaaaaucuuguuuuuacaaugagacaggcuaaccuuauuuugacuguaaacccaaugaguuuguccugagaagucaauacucaauuuaguguaaaugagaacagcagcaugcugccaauuucaauacucauggaaucaguaccagaaguguuauuuucuugucucugucacaaacaccacccaaggaauggugggcuaauacuccacaaagacuucauuuccugcuuacaaaugucauaaacuauuuggacuuggcaguaucagccaagcaucauauguuauggucaggaucgauguuaugucuagaaauggacugaauuuguauuugggguugacagcucagaagacauaauagcagguaccccauauggccuuuaguuugaaauaaacagccaucgggaugaaauaugguguauguuacaauucagucuaaacuacuuucacaauuuccccuuuaaucaauacuuuugcauuccuauagagauuaaaauggguauauguuguugaaauacuaugaaauaauuauugggaaauggcaagggcacauucuugucaauaagacugauucugggcagaauggccaugugccuaggcaaauacuuaauuuuccagucuuuucugucccuggacaugaccuuguaacacagauacagcccaccagacauaaguggaaguuugcuaggcgggucuucugaucaagcuuuuuguuuuucugauaaacaaacuucacuggcagagcauuuuguccaucguuuccccuccaccccuuucuuuuugccuagagcuugagcacaacacuuggagguggaguagucauguugugaucauguggcaaaaaggcaacacaaugaaggcggcagaggaggaaaaaagaaagagccuggggucugaggucgucacugaaccacugcccagcccuggaacacaggcuucucuucugugacuguaauacaaacacuccuugaugguuuuauucacugcuaguuggauuuuuuguugcuugcaacuaaacucauucgcaaaugauauaagaaaaaggagauuuuuaacaggaugccacugugaaaaacagcuuagcuggagaaagucuagaccugcacuguucaauacaauagccacgagcuacauguggugguuuaaauuucaauuaaauuuaguugaaguuaaauaaaaguaaaaauucacuagccacauuucaaguuuucaauagccccaugugggaggcagcuaacgcuggauaguacagauauagaacauaucuaucaucauagaaaguuuuauuggauagugucaguuuaaauaaaucucagaguuaaaagcuuaaauaggagggcauuauguacacaaauauuugaaaccaaguuuaguuccauacgguaaaugcuuuuuuagucaauuucuuucuuccuuaauaggagugguauguuugaaagagagaguuacauaagauaagaaguuuguggaaugccugccugccuugcuugacaaugcagaaaggcuaaaaacggcacauuggguccucgcaaagaaaaaaugcucaucuucuggguacaaugcucccugaauauagaaccccuggccuucuauccacagacuguaaaaacaaacaucacacaauguucccuuucuccugcuccaccuuguucaaucgcuuucucacaaacauguacacacagaauuggaauugagaagcucaugucacgcuaaguuagagacguggucucuugaaggcuguaugucuuaagugcagcgcacaucuggcuucacuguguacauugugcuuuccugaagucgcaggcacugguggcuuuggcuaacacgaauaagguugucuaaacaguccagguucuaccagugaauauucucaguuccuacuuuagaaguugacagcaaagaaaaguuuagaagcaugcuuaggaauaggaguggccugagguuuuuguuguuuuguuguuguuuuuguuuuuuaagcucaaccaagggagaaacaaaacaaaacaaaacaccaaccaggaagcacacugaaacacagcacuaggaauuccaauguaaauuugugaccuuugccauggugacauuugccaagauaaaauucagucuuuuacuagaaagagcagaaguuuuuggaguuuguacaggucccagccaaauucuaauucugucauucccuaguuaccugauuuccagcaagacggcugaucucugucauuugcaaaauggggauuauaaugcuuuaccucaacucgauguugugcaaauuaaaacaagaucacaaauacaaggagaugaagcaguacagacaaccaaucaguuagcugccaauuuuuucucugccaauguauugugaguugcuuacuacuaugauaugaaaaauaccacagagagauacuauuuuuagcacccacaccuugagagugagggaaacagugguaaguaugcuuuuaaugguugagauucuccuuuuucuccuguccccaguuuaguaaugggcuguguuguuuugaugaaaaaacaaagggcaaugcacagaaauuguuuauggaaauaucagugccauuccuaggucaaaagcccauuccucugguuauuggggaauaacugaucugguggcaaaguguuuauaucacuaagugugcacaauauuaaagagaacauaaaagacaauaccuguaagguaauccagacauucuagcaguuucuucucucgggaaaaaucuaaggcaaaggugucaaaugugucauugagguugauuucaggaauuagaaccugggaggaugcaguugccauggagacucuguaaugcaaacaaaacaauguuucagaaaugucaagaugacuuucaacaucacugcauagaaaugaaaaagaaaaggaaaauaaauaucucuuaaaaagugcuuuuuuacacaugaguuuuaagaggcaucucaaaaugucacaacacaguaacauaaaacaaaugaaugcaagcuuuaaaaaaaagugaaggaauuggagaaaacaacaaaauggcuugcccucuuccuuuuuacuaucaggaaaaaaaauucccugcgaaagcaaaagaauauucauauuucauguugcuguguauuuaacagucuggcccggucacgucuaaccccagcaagaagcgcguagcucuaggcauuucuucacacaucugucugggaaacuguuuguuccuuucagacgcaacccugauccacuucaaaggagagucuccaaaauuucaaacugcauaaaaggcaaagugaauauuaaaaaagaauguuuccagauauuggauuaguuuaaucaauuacuagccucucucuaaaauaaacauuaaaaagggaguuuuuugucuggcucauuuucuuucucuuuguauucauuuucuugcaccauauucccagcagaugcuguggaaaauauucaugagcuuucucacaaauccccccaguggaugcacuauuucucuucuucauuuagguuuucugguuagaguucucauguauaaacuaaaaagcaaggcacuggugugucucaaucuccuucuauguacucucagguucauuuggaagguucaguuauuaauaaugaacacuuugauucaaaaaugcaagugcuucucuuaaaaacaagagaauuguggcaugaagcauaccauuucugagcauaucaaaugaugcuggacuaguaaucuuguugaguuugguauuuuguuaaguuccauaaacaacacucuuaagagcuauuauaugcggaguauugcguaggaugcugggaauuuuugagcaaagaaacaaccuugaaacaauuuaguacuaaaucuaguuacuuauuuucuaauuaagaaaauugaugcucauuuauacaaggccacaaagcuagcuggcagcagcaaggaggagaauuucagaucuguacucuucuguuucaucuagaaaaauuucaggccaguuacuccaaggguuauauguccuuuugagucucuuaauggcucuuaaagcuuuggauuuacaaauguaauauaucuuggcucuaaaaauuacaucuguggguauauaucuauacaacaggauauuauucagccauaaaaagggaugaaacacugacacacgcuacgauguggauaaagccuaaaaacauuaugcucugugaaagaagccaucaaaaaggccacauauuguaugauccauuuguaugaaauguccaaaaaaggcaaaaauucauaaagacagggaguagauuggugguugcuaggggcuaagaggggaggggagauggggaguaacugcuuaaugaguauaaggcuuacuuuugguaugauggaaguguuuuggaacuugauagaggugguggcuacacaacaaugugaauguccuaaaugccacugaaucgugcauucagaagcagagucucacuauguugcccagguuggucuugaacuccugggcccaagcgaucacccuuugggaggccuuggccucccaaagugcugggauuacagguaugagccaccacacccagccuuaaaaugguuaauuuuauguuguguaaauuucacccaucuaaaaaagaauauaccuguaaaaugcucaaaauucauagaaauacaguuucuauaguuguauuucuggcagauuuucaguguuguacaggagggaaggagagagccuaaucaacaaugucauaaauguaaugauacugggauugagagaugcaagugaagaggucuaagcucuggaaacgaguuucaagugucugaaugaggguagagaaucuaacugcaucuccugacccuuucaccaagaaguagugaauagcagaguugagugcuuuuguugacuaaauauugcacccuggggaauugggcuaauuauuguuaccaacagcugcuaauuuagacugauggauacggagaugguugcuaggcauuuuugauugauggucaaguuauacuuuaaaaaugcuuuccuuaugacccaugaacacaaaaaguccuuaaacuucauagagguccuaggauuauucucaacaaauauuuaugaagcccuuaaacuaugcuacacaccaaagagcccagaauauaugcauucgaugcagaaaaguuaaaagaaaugcuaaggugccauuugaacccuuaaaagauaucgcaaagugaaacgccaauuaauucuccaucauaaugucuggcagggagaacuguucugagcuacugggaaacaagcaccaaacuugcaauugcauuucccuggcuuuagcaguuucccugcccacuggcagaaaccucuuuauucagucucauccaaaauagauuuuguucccaaguuucuccugguuccauggucuacaaacaauuaaauaaaacauuuuaaauugagugacacuguuaauaaugucuaccaucuugaugguaggaacuuuguuacaugggaaccaaaaggaucaaaguuccuagccugggagguaaaggcugacagcaagaaucaguggagauuacugcagcuuuuaacaccuacacauuuguuuuuugauggaaggaaagauacuuaucuuuggcuacaacuucaaauuccuaauuggagugacaggcaaggggaaaucugccaaauucaacauuuuaggccauguuuuuauuucccaaauccuuauugcccaucuucuggccuuuuggauaaguugccaaauccacuagggcuguuagcgcuaugccacuuucucaacuucuugcuuuacagccaugucugggacacauggggccaguuuuccagaagguggacgugucuggagcuaugcugcucacaaggcuucugccaaacaaugugcaucaccaaaguaaaacccagugaggccucacaguaacaagauagguuuacuuuggucagcccaggaauucccaaacacauuuggccuugaaaacgugcaguuaucuuaaugccuaugaacacccugcagacacacuuccaaaaccacugaucagauaugcucuaauucuuugaaccaagcaacaucuuuucagaauugacaacuggaguucuuggcuuuguauucuggaaaagauccuugaacugccuauuguagugaggaacagaaggaucaccuugaggagucugagaaccuccuaggugcuuugaacaauagguacuauucagagggaaguuucuuuuuaucaccuucuugauacagauaaguuacugcuauaagggauuuuaauucuagauucuucauaagcagaccaacuuucuuaugccuggacuuagugaauagcuuugcuuauuuaaaauaaugcuauaaaggugcauauacaaucacaccaaagaccuaucuacuaguguagcuugagaauauaguacauuauacauuugcauucaucuagugagugggaaggaagagaacuaguauuuguugcauguucaucuugugacagaaacuaggcuaauguuuuuacuacauuauugcauuuuauccccacaauaaccaucuuagguaggaauaauuagucccgucuuacagauuuauggauccauucauucauucacucauucacucaugucaggcagcucgcaaugugcuggggcuauaaugguaaaaacaagguggcuaggguaccugccuacuuggaguauaugagcaaaauuagccaauguuaaugagcagccucaaugcuaucuauaauuacuaagcaauuagcacagagccaaacaaccgguuccaaagcaaaagcaucuccuacaauguaaagcuugaggcucucuccccuuuuggaguuguuugauguuucugaaaugaaagaaaaauuuacaguuuugauucagcuuguaggaggacauauccacuuuaagucgcuuaacgaugcagaaaaucucaucuaagucucacuucaagaaugccugcgggauuaaaaguuuguucugggcuccacaccugaauugaagaauaaagauuguuuggaaguauacaggagccaaagcccaaggcaggcacaauaggagacagaaaaaagaagucauguccuagagaagaauguuaagugacagguugaugaauaggggcagguagacagagaguagcauuggaaaaaagacacacaaggcgggcuagacugacauguugaaacgugaaaacagagauccaacuaacacucauggaguagcuauaaugcuaaugaccuguucuuaggaacuuaaagcaaugucaucacaacagugacagcuauucugaaaccaauuuuuuuaaauaauuuuuuuauuaguaaaaacaauucuuuuguggguauauaguagguguuuauauuuauggaguacaugagauauuuugauacaggcaugcaaugugaaauaagcacaucacagagaauaaguuaucaauccccucaagcauuuauccuuuggguuacaaacaauccaguuacauuuuuaaguuuuuuuuuaaacauacgauuaaguuauuauugacuauagucacccuauugugcuaccaaauaguaggucuuauucauucuuucuuuuuucccauuaaccaucccuacccacccccacucccacaacucccuacuauacuucccagccucugguaaccauccuucuacucucuauguccgugaguucaaucguuuugauuuuuagauuccacaaauaagugacagcaugcaauguuugucuuucugugccuggcuuaguucacuuaaugaucugcaguuccauccauguuguugcaaauaacuagaucucauccuuuuuuaugguugacuaguacuccauuguauauauguaccacauuuucuuuauucauucaucuguugauggacacuuagguugcuuccaaaucuuagcuauuguaaaagugcugcagcaaacacaggagugaggauaucucuucuauauacugauuucguuucuuuuggguauguaccuagcaguaggauugcuggauuauaugauagcuuaauuuuuggauuuuugaggaaccuccaaacuguuccugaacccaauuuucuaaguagaaaauagcucaaagacccauaguuaaaaaguggcagugcuaggacuggaacccaggucugccaacuucuagucuaagcccaguguccuuuuucuauauccuagcugcuggaaggauagaaaggcucaggaauuagccaagaggauugacaaauagugaugggaggagaggggacugcagaaacagagacaaggcucuuggcaaauuuuuacaggcucugugaauucaaacuugacagaagcacauucuuuguagaaagagaaaucaaagucauguuccugcucuugaugaguugggcuuguuauagagagagcugaaugggagcagauacgucccacuggaacugagggagauuguaugugggcauucccacaccugugcuauacuucagaugcauaucuucuuucagcaauaacuguuauggggucacaucaucccuggucacuagguaagaauuuauucaugugacacuugguugaaucuucagggauugaugaggaaugcaguucauaauagccauuucaucuggacaucucaaaguucauagauggagaaaaguacuccuggauuccgguuggaaaccgugaccuaaguguaaacgcuaucuauuaguguccuagguacacuggaguauuagugcuauuugcaguuuuuaacuuuagggugaauauugagcaacuggauauggcccagggaaaauaaacauuuggaaccaaggaaucaggaggaaagaaaugggccucucagaguaaggaggagagcaucuuaaguacauaacagggaugauagccagcuguuauccaugccuuuuagaagagauaaguaucuaaucagcuacaaaaggaauuuuccucaaauauaagaaauaauacagucaagccgauuggacaguagaccagaguuguaaaaacacgauacauuacucuuuaagaagagugaaaauggagaugucaaucacuccuccucuaugcgauauuuugagaauuagcacaaguuuccgaaacaagcaagcacucaauaaauguuaguuuccuuucucuuucuuugaauaaauuugagucauaagauggcgaguauuuuuuuuccuaggccagggguuggcaaaguauggucuacugccuguuuuuguaaugguuuuauuggcacacagccacacccauuuguuucuauauuaucuauggccgcuuuagagcuagcuacaauggcagaguugaguagcugugaccaagaccuuacaaccugcaaagcggaaaaauauuuacuugaugauccuuuauagaaaaagucugcugaucucugcucuaggaugaagaucagcaugcaugagcucucuggggucuucuagagauaggauucuauuauugcuuuggauaaagggcaguugacucugaaaauuagaaugaaugaagucaaggccauuagccugaguuagagaugucauuuauguggcauuggcuguaccuggcccagccuagugcuucucuuuguuuuuucauuuauuuauuuuuuuuggagaaagagucucgcucuguugcccaggcugaagugcaguggcacgaucucggcucacugcaaccuccgccucccagguucaagcaauucuccugccucagccucccaaguagcugggauuacaggcgccugccaccacgccuagcuaauuuuuguauuuuuuuuuuuagcagggaccagguuucaccauguuagucaggcuggucucgaacuccugaccucaggugauccacccgccuuggccucccaaagugcugggauuacaggcgugagccaccgugcccggcuagugcuuuucuuuggauccacuagaauugcuauagguguuugugucagugaagaugagcaauuuuuauaccaaccaaguaugugugccgaaaaaauacuuaucuuugccaguuuuacugcugagccaaccauucagauaacaucacauuaaagcucccuaccugagaauaaagaguauuuuaaaagaagcccguaugagguugacaguuugguccuuucucuccugcgugaguuggccuugaccuuuucaggugaggccaagcuccucaaccaaaugaaaaugggccuaacagagaacaacaccugugugauuuuaaaaaaaaauagaugagcccugugauggaagaaaauauucccuuuaauguuuuugccuucauuuugacucuuuguuaucaaguguacgauaacaucacaucugagagucacaauaaaugcuguuuuugugccaucauaagcuccccccucguccaaaagcagguugauuuuauucuuucuaacugguggacucuuguuucaaaggccuugaacuccagacuccaggcuguuacugaaagggcuuucacaugucaaaaggaagcaucuuuagcuggaacaaaacagcucaaagccucuauucucucugguacugagccuugaaaaugaaaauaaaagcaaggcgagggcaagaccaaccaaucacagcgcagauacaagagcccagcagccgagaaauucccaggggccccugcacucaccucucggugauauucuuagcagucuguaggaaacgcgcaugaucauucuccuucagagaguguuccgcuugggagaugagugaugcugaccgcucaaugcacuguuugcaguuugcaaucugcugagccaguuugcgaagccucaucaccuugaacaaaagaggcauggagagagaugguuacauggguggucuugcuuaaugaaaaggcaucaggcuggauccuucauuuuguuguguuauccuuccauaaaaguucaaaaaguaggcauagagauauaucaaaauauggaaagcuccguuaugggacucugguuuagauauuccuuaucucauuggagaagcauugcuaauucguuuuacgaggaaacacugaauugugaauugcuucccuguugaugggaaaaaaagguguugcccaguggcaacuuacaaagggucaccagacgucuucccuggacuauuccacacaaugacugcaagacuguagggaacccuggaacuuucucuaucucagguuuaucuucuuuucaucaagaagauaaaacaucuuuauagguggugaaucuaugguuuaaaugaaaaccauuuucuaaaaaguguuuuuuguaauucauguaauaaaaucgagaauggaaagcauuaaguguuacuauuucccacacuaccuaaaacucauguguuaaauuaacagaaagggagcauuuuucccauugauuaauauuuuuccuguugagcagaugagagaaagccaaaaaaagcacagcugggccauuuccccucacugggaacgucauuuccaggcacuuugugcuuacuugauaacuaggaacuauuuugauaagcauuucccaguugggauaaaaacgcaugauugcuucacaaccuccauuccaauuccugauucugucucgcuugaaaaugucccucaaacauaauugaccauaaccuccggggcaggccaagauaaguccaagguaacccacuugaccguucgcucuuguguuugaaaugugcugugagaugaaguccucuagccagaagccaaguuaaaauuagacagcuaauuggaauugcugugugccuacugcccccaaccacacacccagggacagguuucaaccggcuuuaugauaauucuggaauggaaaauagcccugggugaaaggguacggaggagaccagucaaucugucuuacagacaaggcuggcccaaggcucucuccagaauuccugcuaauuccaagaaauucuuucuuucuccaagucgucauuaccaucccuguauaacucuaaucuaagaaaaggaaggaaagagaugucagaacuugaggccucuaaggaacauccaauuccaaguauguacuauaagcaaacaaaggaaauucauacugaauuagaagcagcaggcacaagauuucaggcaagggugaaaaaaauuccugaaagagucagagaaugaagugucaaaacuuuagggcaaauaauauaggaucgugagccugguaaaagacuuaaugcauuauaauuauaguuacuguccccaguggauuaauuguauucauuaguggaauaaaauaacacuuauuuuacaccaaauagaauuuagccucuggcaucauucuaucuggaggcaaagcuaaggaaggcauccaguacgcgcaggauauuagaacauguucauaagaaacugucagaggaaggaaaauuccagaaggaaaacuaauuuacaguccacaggacaaaccaagugaauggaauauuuaaucacacagcauaaagaaucauuuaaauuacauggccgaauugcagauguuuaauacaauuccagcaaaagaaaauaaggucaaaauauuccuuuagaauaacuucaugacaacuacuuauccuuuagauaugccuauuaaagaccacacacauuucaaaugcgaugaugcuugaacuccaguuucuucuuuucuuuuucuaucaugauauugaacauuaaaagugacauaacaggaaaaagaauaaaagagcccuaaaucaugcaaaaauuaaagcaagacaaaaugagagucgccugugaaaauaucggaauguucuacagagaacaauuuugggcauaauuuuaguuauagguuaguguacaauuucaucugauacaucugauuugagcuuugcaaaccuaguguaaaagaaucagcugggcaucauuuugaaagaaaaacaguagauguuugggucuacgcuccaauauuugaguuaaggaguuguaauucgcagagcaggaggaauuuccauuucaacaagcaacaaauguuuuuaagccugcaggugaugaaucauuaggacagucaggacuagccuuuaaaaaaccaaauagaagaggagaaaagcaaauagcagagugcauuccugguagaaaaggcaaguuggguuuuguaaaaccuuuugugugugugcaugcgugcacgcuguauugugaugucauauauauuucuuacugcggguuacaguaaaaaaaaaaagaaaaaagaaaaacacugcucuaaguuagguguuccuaggcugugaucugugggccaaaucagcauacagccuguuuguguaaauaaagcuuuauuggcauacuaccacacucauugguuacacauaaucuauggcugcuuucuugcuacaauguugugcagaagugaguugcugcaacagagaccguauggcaaagccuaaaauauuuguuaucuggcccuugacagaaaagucggcuaaccccuggcuuaaaugauuacagucagauggcccugauuugcagcacacucugaaacacuguccuacuugucacagcacuucaaacucagacacccagcauggagcgaaguacuuaguuuucuauuagacaacacuuuuuaauguauuauuuuuaaaaguugacaaggugaauaaaauuugauguuuaaaaaaauuagauacugacacauaaaaagauucuguaugugucugccuuaaugcugcaagggaaauauuuuccagucaacucuucauuuuuccuuugggaagugagauuaccacauugcaacuuuuggaauuuacucucuacuagucauggaaauaguuugccugcuggaaucuccuuuuagcagggacacagggcuguuuauaucauuuuauuugcuguuuauuauaccuuacacauucuuuuaaaagccgcuuuauuuugcuugaaaugcguuuuaaacacuuauuuuuauauaaaucuuuuuauauguauguaggauacacaacccaaaacaauuagguccaaacaaugcauccucaauucacacaaguaucugaacugaaaaugaggccuguucucaccaucucuuuaaggccauggagagcucaacauuuaguccaaguuaauuuucuuaaacuuuuaagauuuaguguacauaaaaggcagugaagaaaagggacccuuauuuuguugagcuuuggccuucagaagucuaccauagaucucugugucugaacauuaaaugaaugaacucaaucugaauuuagcucuuuguguguugacaugaaacuuauccccgacuacugaaaaaaagaagaaaauucuuuuccagggagccucauggcuuaagacucuccaguccgcccaccuauaaaggcugucgaguuaauuuguuucagagaauguacaaugguccaagagcaggaaucaucaguagguacuaacguguaauaauaucaccugcuuggugaccucgucaauugcagaauuugaggugaguuugacagcugagugacuagugucagagauagacaggggcaaaauaaggcaguugaugaaacucacuuuugugaucuccacaauucugccugguucuugcuccaccugcccacuuccaauugcuugucagaaggccccaccauccguucuuuagacucaaugcccucaguugccacugccauccuggggugcagggacccaagucccccagugaaccccaaguccacacuugcccucccugucuggcaccucagauuuccacggguuggcauucacacccuuccucuuaaaaacaggccucugacacaauaugcccuggcuagggacuugagucacugugaguuucaggguuuggaaugaacuaguccuuggucaugugccaaaguacuagcucaagagaaaaggagugcggcccucaucuuucccaaguaacaucugcuuucuaagauugccuucugagauaauguugcugagcaaauguauacuuuuuaaaaagugaagcauuccauacauacaaaaaauuuaagaauauaaugaacuguccuguacauaguaccagguuuacuaaaucucaguauuuucaucauaugagcuucagaguuuucaaaaggaaguaaaaaagauuuuuuuuugagacagggucuugcucugucacccaggcuggaguguaguagcaugauuacggaucacugcagcuuugaccuuccaggcucaagcaauccuccugccucagccaccugacuagcugagaucacaggcacaugccacuacacccggcuaauuuuuauuuuuauuuuuauuuuuuguagugauggggaaccacuauguugcccaggcuggucucaaacuccugggcucaagugauccucucgccuuggccucccaaagugcugggauuauaggcaugagccaccacaccuggugguaaaauauuauugauagcauuaaagccucuguguggcacuuuauaaucucacucaugucucucuccagaagaaaagacccucucaaauuuagagcugaucacucccaaacauguuuauguacacauaccuaaacaauguaugggauuuuuugguaguuuauuaaauuuuauauaaugcuuguacaaauaauuauauaacuuucuucuguuuuugugauuuguccgugcuaauacauaucacccuaguucauuaauuuuaauuucugaagacuuuuucauuauauaauacacaauuuauaugucuaauaaacagcugaauugagauagaauuuacauaucauaaacaguacauacuuaaagugcaaauuugacacuuuuucaaauauguaugcacccaugaaacagucaccacagucaagauaauaaacauauauaucaugccccacaauuuacuccugccccuuuguaauuaacugugcccauccuuuccugucaucccaucccuaaaagcaaucauugauuugcuuuuugucacuguagauuaguagaaagugccguuucucgaauuucauaugaaucuacucauacagaauauacuacuuucugucugacuccuuucacgcaccuuaauuauacugagauccauccauguuguugcauuauaacuaguguaacuaguuuauuccuuuuuauugccaaagaguauuucauugugugauuaugacacaaauuguuuacccauucaucuguugauggacuuugggccauuucuaguuuggggcuauuacaaguaaaauuaacaugaaauuucaccuacaagucuuuuuuuuuuuuuuuuuuggauagggucucacucuaucacccgggcuggaguguaguggcaucauuucagcucacugcaaccucugcuucuugggcucaagcgauucuccagccucagccuccuguguagcugggauuacaggagugagccaccaacaccuggcuaauuuuuguguuuuuuguagagacaggguuucaccauguugccuaggcuggucucaaacuccugagcucaaagcaauccaccugccucggccucccaaagugcugggauuacaggugugagccaccgugaccagucucaccuacaaguuuuguauggacauagcuuuccuuucucuugguaaauaccuaaauggcuggaucauaugguaaguguaugcuuacuuaagaaacugccagcuuuccagcauguacuacuuuaauucccaccuccagcaguuugugagaggcucugguuccuucacauuuuugccaacacuugguaugcgccaucuuuugaauuuuaauuauucuaguagguaggaagcaguaucucauugaaauuuauuuugcauuucauuaaugacuaaugauacugaaccaucuuuucacgugcuuauuuaccaucugugaugguuaauacugagugccaacuugauuggauugaaggaugcaaguauugauccugggugugucugugaggguguugccaaaggacauuaacacuugagucagugggcuggggaaggcagacccacccuuaauugggugggcaccaucuaaucagcugccagcgaauauaagcaggcagaaaaacaugaaaaggcaagacuggcuuagccuccccgucuacaucuuucucccaugcuggaugcuuccugcccucgaacaucggacuccaaguucuucaguuuugagagucggacuggcucucccugcuagcuugcagacggccuauugugggacuuugugauuguguaaguuaauacuuaauaaacuccucucucucuauauauauauauccuauuaguucugucgcucuagagaacccuaaguaauacaucauccacaccucuucuuugguaaaguuuucaaaucuuuuaugcauuuuggugaaaggcuuguuuucuuauuaaugaguuuugagaauuuguuauauauucuggauacaauccuuuauuaaaauaaauaauuuguaaauauuuucgccuaguuugugguuggucuuuucagucucuuaacagugcauucugaagagguuuuuaauuuugaugaaacccaacauauaaauauuuucuuuuauggauaaugcuuuugucaucuguauguaaagaaucuuugccuaacccaaggucaagaucuccuccacguuuucuucuaggaguuuuacagcuuuuaccuuuuacauuuagauauauaaucaauuuugaguaaagucuuguauauaaugugaaguauggaucaaacuucauauucuuacauacagauauccaauugcuccagcaccaguuacuaaaaagacaauccuuucuccacugaaauugccuuugcaucuuuguugaaaaucacuuguccauauauguaugaaucuacuucucaagucuuuuugcugauccuuugaucuauuugucuaucuuuauacaaauaccaccuuauauugauuucugaagccuuauaauaaaucuugaaaucagcugauguuaguucuccaacuuuguuauuauuuucaaaguuuuuuuuuuuuuuuuugagacagagucucucucugucgcccgggccggagugcaguggcgcaaucucggcucacugcaaacuccgccucccggauucacgccauucuccugccucagccuccugaguagcugggacuacaggcuccugccaccaugucuggcuuauuuuuuguauuuuuaguagagacgggguuucaccguguuagccaggauggucucgaucuccugaccucgugauccgcccgccucggcuucccaaagugcugggauuauaggugugagccaccgcacccggucuauuuuucaaaguuuuaaaugauuaugcuauauccuuugcauucuaauaugaacuuuagaaucggcuugucaauuucugcaaaauaaccugcuggaauuuucauugagauuauguugaaucuacagguugauguggaaagaacagaaaucauaacuuuucugagucuuuaccccauaacaugauacauggcuucauuuuuuagucgucuuuaauuucucucagcaauauuuuguaguuuucaaggucuuucaagucucacccaucuuuuguuagauuuaucacuaaguauuucauauuugugaggcuguuuuaaauggaauuucuuuuuuuaaauuucaauuuucaauuguuacuaauauauugaaaugaaauuggcuuuuguauugugaucuuauucuaugucagauguuucagucuuugcuuuaugguuguuuuuuuaaaauuguuuggucuaaaaagaaaaaucccuccuacucugggaucauauguauguuuucuguuaaugugguucuguuaacagauauucuguaguugagccauccuuguauuauaagaauaaaggcuauuuugauguguuuaauaaaacacugauggauuacauuuucucauauuaaaaaaaauuuuugugucuauauucaugggugauauucucucacucuagauuuuuuaauguuguauguauuugguaucaagaucauacacucuacauaaaaugucuuuuuucuauuuucugaaguaguuuauaugagaaugagauuauuaguuccuggaacuucuguuaaaguaagcuauagaacugugggaggcuggugccauuuuggggcagaaaugcaaguugauggacauuuucaaugacuuauuaaaugucuucugcuuuuaaauuuuugguuuauucagguuuuccgcuacuucuuuauguaaguuuucaaauuauuggcaugaagacauuuacacaauuuucuuauguuuaaaaaagucucuacuguauuuaugguauauuuguuuauggggccccacacucuuuuuuccuucaucaaccuuaacuacagauuggucuuuuaaauuauuuuuuacaaguaaaacuccuccugauuaagggcuggcaaacuuuuccuguagaggaccagauagucaauauuuuaggcuuugaagaccacauacugucucugucacacauauauuguuuuucuuuauuuuuuuuaacaaccuuuuaaaaaugggggaaaaggcacuuuuuuuauucacagauguuucaaaauuaggcugcgaguuguucuuugcugacagcuguucuuguuuguuuccuguuuuucuuucauuuacuuuucuuccuuuauuucuuuccucugcuuucacuggguuuauccuguugugcuuuuucuagcuuuauuugaaagcuaauuuuuuacuuuuaguauuaccuuuuuuggggguggggggacagggucuugccguguugcccaggcuggucuugaacuccuggacucaagcaauccuccugccucggccucccaaagcguugggacuacaggugugagcuaccaugcccagccucuuuuucaaaagaauuaaagccuguaaguuugccuucagauacuuuuuugcugcuuacuacuuaugauauauuauaguucuuuuacugugguuuacuucuacauuuaaaaaauauuacugugaagauauauuuauauaugaauagauuuuagugucaaaaaacuauagaaacuauuauuuuauuguugauaauaucuaaugagauacaguguguggucuuagaggcaggguucuaugguauucaguuuuugaaauuugcugaaauacuugcuuucaaccaagugcaugauuauuauuuuaaaaaugccccauguguagguuuuccuauauacuuuccuaucuuuugaguucaaacucagucggcauuugucaaacuuuaaugucacucagacguaaaagaaugcguuuuauggcauucccaagguggugaccaaaacucaguuuccaaauuuccacugcagcugaguuuucuuucuaauuucaauaucuauauuuuucccuccaaaacugcuaauuuguugcuuuccuaucuauuuuuuuauuucauuuccuucuuuuguggcuucacuuuuuuugcucuuuugaaagagaaguuauuccuucauuucuuucuuugaacaucuuaagacuacuucuuuuaaagucuuuuucuuauuuuccuauaaaauuaauuuuaucugggguaagauaauguugucugcugauuuugcuggcuguauguuuagaaauuuaagauuucuuuauauacuuugaaauuaaacuuagaguuucaguuuuaaagggaaguaauuuauaauucuuuccucucucacccuccuugcucagccuacccugcucugauaguuuuccaguugccuucaccuggcccuugaggucauuauucaggaaucccauccuuaucucugugcuccuguucuguguggguaucagaaacagugugaacacaggcuucaagcuaacaaugugacuuugcuaaaagcuaugauaugagggaaagguuggcaauaauuuuugacugaagcaugaagccuucuauagcccauggcauuaaauaaugagccugauuuccauuccccaucccaucuggagcacuucuagguccuuuccccaaagcuucaagaacuauuuauccacaggagcuaaagccaaagcuacuuuggccucuuccagaccaaaucccaguagccuguauccucagccacagucauggcuuuucaguuuugucucauuucuggccuguggagauguuuaucuuguuuuugguucagcuauaugucuuugcuuuugcauuuuauuaaguucuuuauuacugacauguauuugggguagaacgagugcaccgaagcauaaacuccaugcaucacuauggcuggaacuuggggacaccugcacuacucugaucuagcucaugagagaaacccugguggugggaaguccaagcuaaguaagagaagggaaggcaagcuagccaggaaguugugguggagugcccuugcaggcugaauaagggcucucaaugcugcccacauccuaaucucaggaaucuuugaauauguuacucacauggcaaaagggacuuuacagacaugauuaaggaucacgagauggggauguuacccugaauuauccagguaaucccaauguagucacaagggucguuauaagagaaaggcaggaaggccugugucagagaagacgugaggaugggaagagaggucagauugaugcaaagagaccaugagccaaagaaugcaggcuaccuguaagagcuagaaaaggcaagaaaaaauggauuuuccccuaaagcuuccagaaagaaacagcacugccaaaaccuugacugucgauuuuguuuaacccagugagaucgauuuuuggauuuccgaauuucagcacacugagauaauaaaucuauguugucucaagccaccaaguuuaagguaauuuguuauugcagcaauaagaaacuaguaagaguaaggugcaaaaccucaauuagagaggaagaggaagugcuuuuucaaaaaaauuauuuauuuauuuauuuuuuacuuugagaucuauugcauggcauggugaaaacagcaaauaaauaauaacguauuauacaguucaaaaucacuaagcaaguaaauuucaaauguucucaccacaagaaaaggcuuugagaugauggauauguuaauuagcuugauuuaguuauuccauauuucauccauaaauuauaacaucacuuugcacuccauaaauauaaauguuugucaauuuaaaauuaaaaaugaaaauaaacuaauauguguacugagagcuaaucucugcaugcaaccauguaaagauagcaaauuaccuucuguaugcauaugaauaauuaauugugacuguacuucagguggccaugugucugagaaccuggaauacuuccagaauuaagagaugugcaccuaugaugcacgaugaugauggaagaugaaauauauccuguaaggauuccagauggacacucagugcucuucuaaauuggacaauucguauguggggaaaaguagcuuuucggcacaugugaguccuuggccagggaauaauuucauguuaaucuguuaaucuacuauaccagcaucaauaacuauuugauuucacuauuuuuuagaucauuuuaauaauuuauguguauaaauauuuuguaaucuauauagacagaguaaucuaaaacauuguacaauauuagaagguaccuguuaaauuuuguggaaaacacagaaaaccacauacauuagccacgguuaucucuguguuucacuuaaaacuugcuaguauguuuuaauuauauauauuuuguuuuaaaguacaacuaugaacaauaauaauagaaauggaugaauuuauuggaucauaaauaaacgcuucuauuuuuaaaaauccauagaaaaauuauccuuggccaggcauaguagcucgugccugucaucccagcauuuuaggaggcagaggcagaggcaggugacuugcuugagcccaggacuucgagaccagccuagacaacauggugaaacccugucucuacaaaaaauauaaaaauuagccaggugugguggcccaugccuguagucccagcuacucaggaggcuaaggcaggaggauugucugagcccgggaggcggcaguugcagugagccaugaucgugccacugcacuccagccugggugacagauaaagacugucucaaaaaaaaaaaaaaaaaaaaagaagaagaaaaaagaaagaaaaauuaucccugaauguggcagagaauuggguaaaauuaaaaggaucauaaguauuucaauaaaaacaugacuaauuuuaaaauagaauaaacugauggauuauaaagugaccaacaguuugugaaugaauuuugaauaaauaagaaagcagcuauaaagaauguaugucaauuuaucuuaaaaauauaguuugcuguaaaacaauaggaaauuaaaacauagaaacauuagaacauuagaaaagaaguauuauuacuauauccacaaaggaguauaugauauagugaaaccccagggguuuugggaccaugaaguuauaccuguauacauuuccucaaaaacaugggaaaguacuucauaauuucuauaaauaaagucagauucauuuuuaauuuauguaaugcuaugcuaguuucuaggauaucacaaugaauacaaaauaaacucugccuccacagaacccaccuucucauagacaagugagauagaaaacaauggccaugauagacaagaccuuuaugcuaccuccuggcgcugggcaauggagcagcccuuguaucacaggucuucacaggagaccauaguacaaagaaaaggauggagaaaaaacugccaagcaaaggccuuuuaacuaagucuuaaagacuuaagagggaauuauagaauguauagaaaaagaggguucucaacauuuccaaagucccuggaguguauuaggauuuauuuucuccagguagagaauaugaaaucuucugcccuagaaaucauaccuucccuucuuugaucuugguuccaauaaucugucgucuuugcugaaugaucucaaugagaagaucacacuccucugucaauuuggcuucuugacgugaugcauugaccuacaggauaaguacaaugguaaguguuaauuuggccuuuguuuuucaguuaagugcuauuuuuaauguauacuaggauguuucuaguaaucucugaaaagauauuuuaaauguuaacucuuuguccgauuacgcaaggauugcaaauauaggacuuacauggccacuuccuaauuugcauccuuggaaaacauuauuauccaaugacagcagucuuuucuacuaagccagacucagcugcagaaucuuuaacauaacauguacauagccauuaccaauuaguuggaaaaugaugugucaugugaaauauauuugcaauuccuacuuuuauauuuuuaaaaaguaucaaauuugcccuguuaaacauaaaaaaaguaaguuaaaaaaaaucaauauuauucuuuuauggaggacagauuacuaucaaucucuuuuagacaaauuuuccguaagcaauguagcaagccuguaucacauuugacauuucucuuaaauacaaacaucaauuuuguaucuaaucacuauaaaacauaaaaagcacaaaaagaugguucaauaguuuauuaaucuuaugacauaauuuaaaauuauacuccuaguauacuucugaaagaucaagguucuacaacgaaagcauaacauucauguggaaagguggaucauuagaguggcuuguauuugaaguuuuugugacuugcauucaagggaggcuuacaauuagcucauucuuggcaacuaggccugggaaauacucugcacaugcuauuuccuccaucucauggcaauucugaaaugcuuauucacaaacagaaacccagaaaccacagcugugagagauggagauagcaggcaugagguuuauuauuuuaacacagccacaggagaaguugcaauguuacaaagaaugacaauggcauugauuauucuagcauaucucagggaggagacauggcccagucccuagccuuuuugauuuggaaggcuuuaauuggaguaauuucauucucuaugaaugagauaaacuggaaguagggucaugaguucaagauaaaaauccacugauggcuguucacagaaaccauguccuguuuccagaggcccaggauuccuugaauuuuauuccugaucauuguucagacauaacauagagacuacucaagacaucuuauugagaagaugauagucauuggccauuugcaguaaaccaugagauuauguccuacaucaguuuagcagacagaguuauuugcuaaguauuuguuuaaugaacaaagagaaaaauuaaaaaugcauugacugagaaguacaaauguggaacucaggcuaauauuucaaggaggauaaucauuaggcuucauuucucuuauuguuauuuuuaugucaucauuucuagcuccccuugagguuucucaaauaaauuuagcuauugacauauuuacuugaaacuuacacucaguaaauuucuucuguuuccuuuugaccucaaacugaauuuaauaacugacuacaacugaguuaugaaaaggaugggaccauauugauaacaugagcacauuaugauggaggaaguaaaauuucuagaaaguagcacugacgaagcuucuuugcucgaccaaacuuuaguguugaacuuucuccugggcccuucugcgcacuuucuuguaaaccaguuuuagcaagaacccugcugaguugguuuagccagaauccuccaucuccauaucugaucacucucaguaucugauuggguucuucauccuucaccaugccccagaggaugucugaucaacuuggccuaccuucagcaagaauccuuuuaggucaguuuaaccagaaucucccuuaccccugauguuuccucuuaguaauuuuccauccacuuaucaucacccugcuccuuggcuguaaauccccacugguccacgugacauugggaguugagucccauucuauacugaggucucuuuccccuuauuacaauaguccugaauaaaauguuuuuacagcuuuaacuacuguccagcucuaguuuuucuuugacagaccccacacuugaaaaguaucuacuagaauaaacccgaagagcuaaguuguacuugagaauacgaguuaaaucugauagaauguaagcuccauaugggcagggaucuucagcuguuguauuaaauaagguaucuauuccaagcaccuggugccaugucuggcacaaaauaggcauucaaaaaauauuuguugaauaaauaaauagggaaaaugaccuuccaagaagagacagggcaaaaauguaauggagcaaguaguuaucacuaguaaucacucaacaugcagguaauggauugguuuccaaggacuguguagacacaaaauuaugaccuaaggauuguuuuauuugagggggagggaggaagggaguugauuuuuuuugagacagggucuugcucuugcucuaucacucaggcuggagugcacuggugccauaacggcucacugcauccucgaccucucaggcucaagcaauccucccccuucagucuccugaguagcugggacuacaggcauaugccaugacucccggcuaaauuuuuuuaaaauguauuuuuuuguagagacgaggucuugcuauguugcccaggcuagucucaaacucccgggcucaagugguccuccuaccuuggccucuuaaaacugcugggauuacaagagugugccacugcaccuggccaggaauugauuuuuuaaaacugccuuauuggaauauauuucacauaucauaaaauuuguccauuuaaaaugugcaguuuuguggguuuucguguauucacagaugauuucaugugcaaucgucaucacaaucuaagccuagaacauuuucagugcccagaaaagaaacccauaaugugugcagucacuccacauuuucccuaccugcccuagcuccagcccgaggcaaccacuagucuacuuucugucucuuuauggauuugccuguucuggacguuucauauaaauggaaucaaauaauacauaaucuuuuguuuggcuucuuucacuuagcauaauguuuucaagguucaucugugugguagcauuuaucaguacuucauuccuuucuaugccaaauaauauuucauuguaugaacaggccacuuuuuaucucuucuuuaauagaugcacacugauguuucuaguuuuuguucacuauaaauaauauugauaugaacauucauguacaaguuuuugugugcccauauauauucauuuuucuuugauauagggguggaauugcugggucacauaacuguguuuaauguuuuaaggaacugccaagcuauuguucaaaguggcugcauuauuuuauauucccaucagaaauacaugaggguuccaauuucuccacauccuuguuaaugcuuguuaucguaugucuuuuuaauuuuauuuuauuuuuagugggugugaagugguauuucauugugguuuugacuuacauuuuccugauggcuaaugauguugaccaucuuuuucgugaacuuacuggacaucuguguaucuauguuggagauaugacuauucggaucuuuugcuccuuuuguaauugggucauugucuuuuaauuaauagaauguauuauuucuuuacauauucagaauacaagucccuuaucaaauaugugauuugcaaauauugccuccuguuuuguggguuaucuuugcauuuucuuuaugauacccuuuaaagcacaaaacauuuuuaaauuuuaaugaaguuaauuuaucuacuuuucuauuguuacuugugcuuuuguugucguaccuaagaaaccauugccuaucccaaggucauggagacuuacuguucuguuuuccucuauaaguuuuauauuuuauauuuaggucuaugagccauuuugaggucaguuuuguguauggugugaggguaggcuucuaacuuuauauggauagccaguugucucagcacaauuuuuugaaagacuauucuuucuuucacugaagugucugagaaccuuugucaaaaaucaauugaccacauugugagguccucaaguuuuaauguugucacuaacauauuccacacuucaagcucuucuggcuuugacuaaguccagugagaacccacugcuaauucuagaguacgggcugugaaaugaaaugugguguguaauauacccacauggugacauuaggaaaaucuuaggcuaucuccauuuaugaguuuuccuauuuuguaaaaugagcugaauaauaucugcucucuuagccguguggaauuauuguggugaauacaugaaauaauauaugaagaaacaccuaaacuuaugaagccauugacaaaucugagguacuguugucugcauugagaagggauuuuguaaacagauuaugauuuaguuuaggguccauucacucucacaaucauugggaguugaguuacugcaugguagaaaaaguaucccaguugccauuguaauauggggcucaauuuaauccaaauuuugacuauuugauuuacagaauggauauguuugcuuuaccaaaaaagugggcugaaaucuuccuuguugaggcaaauguguuuugagaaaacugguaucacaaucaccaucaccccaauauguaaauuccuagaaauuugggaacaggaucuauucauuuuaggccaaguauuuuuccuagaucuuucagagaauacagauuuagcuuuccuuuugaaaccagggaaguugaaucuuguuuucuacuuugaugaauuuccaaauucuuguaacucuaguauucuuauauuccaaaagauacaauaaaacaaguuaaauacuauucuauauuucagaauuuuuucuacuacaaagaaguuuuccacaguuuugcuguuucaugugucacuuaaacaaagaauuaacgauuugauuggacuuucucauuaauuucuauuaguucaaauauggcaggguuuauugguuacuugcaguuauguucugguguuucuaguucccagguuugguuuggaagcuagcagcuccugguuaugauuuuugcuuucauuucugauucacaucuuuugauucagaaaucauuguggcugauggaagugcucugaggagggccaaucuaaggaugcagaaaacaaguucaaacucuucuuuccacuuuugugccaucagucuccuccuuggccccuaaacuaacggcaagagugagaugaagauaauuaggaaugauguccagugguggguaauuacugucuccugccuuuggaccacacuggaaauggggcacuugacuucucaggaugaaauacagcuuaaaauuaggccuuccuggccgggcgcgguggcucacgccuguaaucccagcacuuugggaggccgaggcaggcgggucacgaggucaggagauugaaaccauccuggccaacaugaugaaacccugucucuacuaaaaauacagaaauuagcugggugugguggcgcaugccuauaaucccagcuaaucgggaggcagaggcaggagaaucgcuugaacccaggagucggagguuacagugagccgagaucucaggcuaggcuccucaauacuaugguuuuuucucaccucaaguacacucaugagcaaauaucacauuagcccaccaguaugagaaacucagucacuuucaccucaucucauuuuugaccucacccaucugcucagcacauaccuucucuacaucuagagucaguuuucuuucgcgucuugaaaugcaucuucuccccaucagucuugccuguagggaguugcugacccacuuucuccuauuccuaggguaauacugcugcuucucucugccaaugacuuucugauccuuuacagucugaugaaagagauauuacaaaauugaauaaugaugugaauguagaagcacaacaaucauaucuggccugccuaguccugagauggaauucagcauugagggucacucggcuucauuaaugcucauaucugccaccaauaaucaguugcagucccauguaaguugcuacugggugcacgguuuaccuucccuuucuagaaaugcaguuacgcguaaucauuccccagauuaguuaaugaugacauaaauggauuagcuauuuucucgagggcacuugguuagcaacgcccaaagucucccugcuaaguuuuaugguguaauaguguuacaguguuuugaggaaugggugggguaaagaggacaaauauuuuuuccuugucauauauguauaaacauuaaagggauuuaguuacauacauauacuagaaauuggacuaggugucugugaaauguucuuuagcagucuguaagugguuuuuaaguauuauuucuaaaaccuggcucuuuuaauuugacuuguauucaacugcaaaaugagauguucagugcagaguauaaacaucauuagauuucagacaugugugggcuuaaaaucuuuagaaauauuuggaacucuuaggauggagcaugagugaaggaaaaaaaauaucuggccaguuuucacaggugaaauugaucuagcaugcauuuuagaaacucucauuuucucacuuugcagugcuuuauugaaauaaguuagccauccauagacuuucagaauacagccuuauaauuccucuugugaaaaugacacacugacuugauauaucacuucuuauucguacacagacggaaacacugaaguaagcuugggacaggauaaccccaacguguuggagacaggauauucuauuucuggguguugagaagaggguugcugcacugcacaaauccggaggcuacuauucacuuugaauuccgcaagaaugguagaccccuugaguugugccucucucaccccggcccaccauuacugcacucuugaaauugcaccaucaaacugugaacccuuuaguuuaagauucugaaccuugccaucuuugaaaccauuaccaaggaguugggaguuuaaaagacaaaugucuacuuuacaaguuugccuagauucggccucauggcaaaaacaaaagcuguuucaugccacggugaauaaaugugaccuuccauuccaaggucacaaauuaaggugaucuugagaaaggcugaaacauuuuuauacaugaugcuagguugauguucuuguuauuguuuagacucaaaaggacuuuucucuauaacuaagaauauguaauuuugagucugcauccaaauucgaagggguuagugguacuacauaauguggcauaaccaucccaucucacuccaaaggaaaaacauuggaggaguuaauuccaauuugcccaaggcugaaguaacugaaacaaaacagagcuuuauauaagcugauauuuggccuguggaugaggguacagggagaaaacuguaugcaagugggcucuacaccccgcuguguaccacugaccaggugcaaaaagaaauaugaugauaugagggugcuuuggguuuuauugccaaagacagcugugaugaacauuccagacucuggggcaaaaguuagacagagcugccagaggaacaaugaaagggauucuaauacuucagucuguauauaaaacugagccaaggagaauugaggaacagcagacaauauuaccguaauucaucugauauguuuauauguaaucuucacucugaaacucuuucacaccaaagucaaauacuuguggaccuggcucaagugaaugagagagagagagaauggccuggcuccugaggucucugucuuuggaggacaaaccagaguacgggacaauauuuuuaauguuuaauguguuaauuuaauauuuaacauuuuugaucaaaucuuuuuaaacuccaagaaaggcuuuucagaaaaauuaaaaauggaauccuuucauaaagugcuuuuggugggaaguaauagcagugauauagugauacaacuagaagcuacauguaauccugcuuuagcauagugacguaguggaaaauuauuuggaccagaggagaucaauucuacauauugauuauccagaugggaauuugcuaugggacuaaaaaaauagcuccgaggaaccucaugauaaauccucuuuucuugagguuucuaagauuaugaagcuugagugcuggacaaggaagcaagacacuaucaaaaauggcaacacacuguggugaguagagcaauuaaauucuuucuuaugaaugaaauacaacuguaauaaggcaauaaaacugccuagcaaaaaaugccauugcuaaugccuaaaacuuugaaacuucacauaaaggaguuuuacuuccaauaguagcauacagaacauggccauucacgauguuguugaugucgcuguuaguuuuucaguaaagcaaaaucuucaaacagguaaaauaauuuagagggagcaagggcuaauggaggcagugguuugggguucagggacuugaggaagucuucccgggauugaaacaccagguuuuuauugcuuacuaguuguauguuauugggcauuuacuucaacuaucuacaucucaaguucccuaccugcauaaugaggaaaauaacauuuguuaccuggcagaccaggugcgaugcugcuaaacauccuacaacacauuagacagcccccacaacagugaaagguccauccccaaaucccacuagugucaagauugagaaccccuggguuagacuguggugagaacuaaaugagugaaaacaugaaaagcccuugacaaaugcuuggcauguaauaauuacuacauaaaugugaacgaucacuauugcuaacaaacucuuuuuaucuggaauguccauagauaauuaaaacuagagguucuaggaccagucagccugugcugguuaccugaggacuuucuagcaugaaucaaaacuuugaugcaucuacaucaucaaaauaauagcuuuggaagcuauaacaugaggcuuaacuccagaauuuuugaagcuacuuuuaaauccuaacuggguuccuugaaggcugccuccugaugcaauuuuggaugggggaagaagaaggguagagaacauucuuccgugguacagagcaggaguugggggacuuuuuuuuuuuguaaaggccuagauaguaauuauuuuagcauugugggccagacggucucugcugcagcuucucaacucugcuauuguagugugaaagcagccauagacaauacggaugcaaauggacguggcuguguucaaauaaaacuuuacuuacaaaaacagucagauuuagcaugagcgucacaguuugcugaccucuggcauaaaggaaaaaucauggacuuuauauucagaggacugcagguaugaaaaauauuugaauuucugugagaauguuuccucauuugcauacuuuugaugaaaauaucuguaaacaaucugguacauaguagaugcucaauaaauauuaguuuucuucuuuuaaggcaugaauagcuacaaguacugaauuaauggaauuucaauuugaaaaugacaacauacuugcgguaugguuuucacuuuccccaugauguccugcugacuucugucacaauuauaauaaauguuacuccuucuguaauguuuuuccuaggcuacacucaacugacuucaaucuuauauucuuggcaucaauaucacagccuuuucuuuuuguguuuaaugguaacuuuguuagaagcaguuccaaaaugaagaagcagaauggaagggguugcucauaauucauugaaaaacaauaaacuccucccuuccuuucucuuauuaauuacacacuuuauaaaacaaaugcuucacacccuuccguuugggcugggcacacugaaugaaaagaaaucuacuuaaccugccauggguguuugucucuaucacgucuuuuucauaaaguuucugaaaaguagcgauuucuauuaaauaauuuucaacaaauguguuuggcauuugauguuguggucagaggguaaacaauaacuuuuagcagaugaccauuaauggagugccaggaaagauggaggugacguguuuaagggaagggaaguuauuucuaauggaaagaggaaaccucuacucuaugacuuuaccuuaaucacuuucaaucuuacauguuauuucucauuaagugacauuccuuuuaguuguugugccaugauuccugaaaagugauguacuggaaaaauacugaguuggaccccuuuuuggguuucaguuacucagguauagaagccaucugcuucugcaaaguucuggaaaaugaacauuggguuucugcucuuugguauuccguacagugagugaaauacacgugauuacgucacugauagaacuuaacugggagguacaacuggaaaauguuaagcuuuguucugccuucaugacgcacccacaagugauaucuaugaaauaucuugcccuguuguugucauucuagaauaucaggagaagugaguagauugauuuuuaaauaucuuugauguccagugauucacauguacguuuauucaaacacaaugaaagagacuugaguuuagagaaauugaacaugugagcuauagccaugacuagaaaaagagacuugugcuaucauuucauuuuagacaugguuggcaguuguauccuccccaagaaggauaugagacaagaauggauggucaaauuguugccagaaaacaccaguacuggguaggaagugaaacagggacaacuacgaagccaguaaagugugacuuaccaagaccaccuugggcaacuggagauuaaccccauugggcaacucugggaaacaguacagaacauuccagcuaauagggaagaagcagaguauuuauguaacaucucccaucaggagcugguugaaagcuguugggggaagguaggcauuaacuucccuuuggaauuaguugguccugggaggggcagaaaaaguucccaggccagggagauaggaccugugagugcaauauggguauggccuugacagcuguaggcaggagcucuuacacuagaggagacuacaauauaaccauuuugagcucucauggaggacagagagagcuggcaucacagucauccaauuuuucaguuccaaugacuugugacuaacuguggggcuaaacagaauuugcaucggacagugcuuucuguacuggccuuggucauuccugacuucagggucacaaucuaccuacaagcacucauuugcaacugacuguaagugggucuaaguuugagcaaugguaggcaaaguucccugaaaaagaaaacacgugacaucuagcgugucagaccaaaauguauauuuccucaucuagugacuccuaacuuccaucauuucaacucauugugaaauuauuauugucuuucuggaacaaugguuugagaacuugaagccucugcaguaaacuugacuuuuuuaaagcuugaguuaaggauuauuuggagaagugucccucucucucccuacccccuuuuuuuccuccccccuccgcccccaucucucccucuuuauacauuaucauuaaggucaacuauauuucuauaaacaaaccugacagauguuaccaucuaaccuuccuaccugggaaacagaauggucuguugagguuugucaggaucggggucaggguugugggaagggagagggcagccugccagguaauggaaacacugcuugcuuuaauuuuauugccaagaacaaagccuucuuauuguuuaauagaacccuuaaaggcaggccucauuggcauaguucuaauuuuuucgagaccacaaacaagaggaauucuuuagggccacuucgugaaaagcagaagaaaaaaauaguuuauucugcaaaaauuaaagcaauccuuuguuucaguagccagugucugauuucagguuggcaucuguauguguccucucuacaggggcauuuguuggcauugucugcaugggcacccacucuuucauucagauuaauuggagguuaugccugacauaugaaggaacuggacagaaaccaucuuucucuggcaaaucaucccuuuggcagcaauacuuucagauaacaugcuaaaagaagaaauguuucgcaccaaaaacaaagaagcaaacacucuccucuugcaaaaccuauuuauaaaacugggaaccacacacaucuucauucagugcuuauuuugauucuaccagcaaacuaaaccuucuaugcaguccuugcuucucagcagcaaguuuuacuucucucuccauuuaaaguauaggugaccaaaguuuccgguuuccagagaucuuugcaacaguguuaguagcuaaggaaugaaagugagaggagaugaggucauucuuguuauuccaugaaugaggaagaugcuaucaauguacagggaucaucuaugaagcaaaucuuagggauuuguugagugcccacaaugugcaaagcaccaugcuaggaccugugguagaaacagaacuuggccugcuagaaagaaugacuucacuagagaacaagcagcgaacaugccaagugcacacauaauuaacugcuaaaccaugggcuacagaaguucuagagcugugugguccaauauggccaccacuagccacuugugguuuugagcacuugaaauaugguuagucugaauugagaugugcugugaauaugaaaugcauacauuaaucauuuuuacauugauuacauguugacaugauaacauuuuaaauauaucggggucaaauaaaauguauuaguacaauuaauuuuaccugauuauuuuuacuuaaaaaaugugauuacuugaaaauuuuucaauuacauauguggcucacauuacacaguacuuugauuggaugaugugacucuggagaguuugagaaaugaggcaauuacugugugaguagcugaggaagguuucaugccaaauaugaaggagagacuggucuuuggagaucagaguaggcaagacagaguuaggaaacccaggggugaggaagaugagaaaaggcaccagggaagagaggcaaaagaacauuuuugcaagacagaggaaauuaaaauucuguuucaacaacaugcaggguacagugggcaugcaucuugaauugguuaucugggaauggggagacagaaauaccgaagccaguuauaucuuacugccccuugugaaaagccuuuugggggccauuugcagagagcuagccaugacugagcuccauagagucuggcuaaaacaaaacagcaaauugaggaguuuaacuugggaguggggaguucuuccuugacccccaccuuuuucuaauugacucccuuuguauccuggucuuagugggccuucagcauugaucuuuaaagcuauccaugcuuacuugcuuuccuggaguuuucuucugaaaugguaguggggcugguaaaaguuacaauggcaguagaagggcaggcaggaaggacacuggagagcuguacaauaggggcuuugacaaaaggacagugaagagcaaagcuaaucugaucuggaagagaaaaggaaagaucacagcauuuagaugucuuuugguugcuaauuuugaaguuguggugaguuugugaguguguguguguguuugggaaucaugagagacugauauugaaaauguuuuccuguuaagucauuuucagaccuagguugauuagccaucuuacauguguggaauuauuauuuauaaguguuuucccaagccugauucaaagugacuaucuaacuauuuuuuucuuuugcaaaccagaaaagauagagaagguauccuagagaauaaaaggaaagguacagguuuauaauaagggggaaggaaagacccaccucgaucgaucucuauucagggcucagcaacacuccugauggacagcucucucauuuuugacuucccuuugucaacuccauccucuuagcccuaccuggguggcagagcccucaggcugggagggagcuccuugugugcacuagcauuacugauccuccagggauuuguggcuacugagguuugcugucauaaaaacacagugcuguguacagucuucucaagaaggguccuuucugcccuucaaggugugagcuuaucggacaugcugaucuaugcaaaugagcuagugcuacaaggaggacagaaggaugauguaguuggccucuagagguguuccauucacucaucaauagucaagugcugcaugcuaaacgcagcauacuaggaagacuguccuauuuacccaggaguccaaccaacuaggagaaggaauagacacagacuuacagaccaucaagauuuuuguucaagaacugcaucuaugucaacaauucacuauguaguuucccuuaagcuuuuaaguucaaauuaugaucucauuauucuauucauacaucuaauaaauuuuaugaaaccaagaauaaucacucucgggaguccuugaaucaauguuugauuaacucaaguugaauagacucaacuccauuaaacaaucaauucugucuauacauuagcugauuaaguuccuacacacauauuuuuaaauugcgguaaaauuuacaugcaaggaaaugcauagaucuuaagggacaguuuaauggauuuugauaaccgacagcucaaucaagacauaaaacauuucuaucacccuagaaaguacccucgagccgcucuucaggucaauccucaccccuaugaggaaucacuguucagauuacuccuguaacacuuuaaacugcauuuaucaauuuaacacauuugauuuacuuuauaagcacuucaaaugcuaacaggauaaaauuaaaauccuaacacguuauaccuucccaaguccuuaaguagcucuuauaaaucuaauaaacuaaacuuaaaaaauaugcugaaacccaggccgggcgugguggcucacgccuguaaucccagcacuuugggaggccaaggugggcagaucacgaggucaggagaucgagaccauccuggccaacuuggcgaaaucccggucucuacuaaaaauacaaaaacuagcugggcaugguggugcacacuuguaaucccagcuacuugggaggcugagacaggagaauugcuugaacccaggaggcagagguugcagugagccgagaucacgccaccgcacuccagccuggcaacagagcaagacucugucucaaaaaaaaaaaaaaaaaaaaaaaagaaaaugcugaaaccuaagguuuuuugaacauugcaauauugcuuugaaaccuaaacuaucuuacagauccaacuuaaaauaacaguucuaaaagaaauuacauguuaggcugggcguggucgcucaugccuguaaucccagcacuuugggaggccaaggcgggcagaucacuugaggucaggaguucgugaccaggcuggccaacauggugaaaccccaucucuacuaaagauacaaaaauuagcugggcaugguggugggugccugugaucccagccacucaggaggcugagacaggagaaucacuugaaccccaggagguagagguugcagugagccgagaugacaccagugcacuccagccugggugacagagcaagacuccaucucaaaaaaaaaaaaaaaaauuacguguuucaaauuagcauuucaaagcaaaucugucaaauuucuguaauaugucauauuaucuuaaaugcuaugaacuauuaacauacaaacaaauauuucagucccaaguuguaauauauauauauuuuuaaguucagggucucugucucugucacucaggcuggaguccagugguacaaucauagaucacuguaaucuccaacuucuucuggguucuagugauccuccugcuucagacuccugaguagcuaggacuacaggcaagaaccuccacucacaguugguuaauuaauuaauuauuuaguagagacagggucuugcuauguugcccagguugguucuaaacucuuggccucaaacaauccucccaccuuggccucccaaagugcugagauuacaggugugagucacugcacccagucauaacccaaaauauugauuuuaugcuacagguugaguaucccuuauccuaaaugcuuagaaccagaaguguuuuggauuuuggaauauuugcacauacauaaugagauaucuuggggauaggacccaagucugaccacuaaauucacuuacauuccacauacaccuuauacacauaagcuugaagguaauuuuaugcaauauuuucaauaauuuugugcaugaaacaaaguuuguguuaaguacuuguguguggaauuuuccucuucucgcgucaugucagugcugaaaaaguuuuggauuuuagagcauuucggauuuuggauuuucaaauuaggguggcucagccaguauuauuuaguucuucaucuuuauacaugaaucucaaacuuccugggaaggaggaaaaaaaggaauuuacuuauuuacuaaaggaaacaaauuuaucaucucaaagaaguugagguuagagggucaaugguuaauaauaaaagauuucagaacguucauaagaacugaagacucacugauuguacuggcacugcagauguacacuugcugagccuuuguuaugguggguuuaacaggguuuccaauuaccuaucugauaagaugguucuuguaaugagaauuccccugggaaucuaacuuucuaaucaccugguuuggguucaguaacaacuccaguuacuuauuacuugguuaaauucaaccuauuucuuuacuggcugauucuuguuauaucuggcuucaggccacguaucugugguuauuugaaugauguuuaugucaaaagacuguugggauaauuaaaucaggaagugacaguaagagcuggucauggucauaacugcuuguagugcauaucuacauaaguccuaucacuuuuucuuucuuuacacuacagucuauguguugcugugaaacuggaacagaucuaugcaauaaugcuccccuuccaacaccugcaaagauggacaaggcaccaccuucccaauccuauggaaauugacagaaggcuuccuugaaugaacuuaugacaucucaauaccaagcuugccuugucagagaauuagaccacuauauaguuuucacgacuuuacauauaugaacuugauguuauaucuagggaaaauacuuuuaaaagcauaguaaaagcucuaucauaaauuccuaggccaagaaguuaccucacuugguuguaaaaaucuuuguguugcuccucacugagagccuuguacauuccaugguagccucgggcauuuuaaauagcugaauuuaaaauuucauauuucuauuucaaacaaaaauaaccaguacuacaauugucuucuuguuaacggacauuuuauaugcaugacucaauuauuuugcuguggaauuucaaaauuagaacaaagcucuucauuuuuuccuacaacauuuaauuuagcaaauuaaaaauagaagucaaccgaaucagguaaaaaaugauaugucuggcuucuuucauaaucuguaauuauuuuauacacagagauaauuucaacuugauugucauuggaagacaauuuuauguucauuuauugagaaaaauaauuuaaacuagauauuagacccagaaguaaaagguugguucaguaacaaaaugguggauugauuguuaggauuauucuuguuucugaaugucaugaaugggagcaauaagugaaccaaagcuuuuacuugagaguuaccuucucaccugcaaucauuccauuccccucugacucuuucaccugaaaccauccagcuaagaccaucucauauaaaaguugaguuagaaauaacaauggccauuuuauuuuauuuuacuuuauuugagacagagucuggcucuauugcccagucuggagugcaauggcgugaucucagcucacugcaaccucugccucccagguucaagcaauucuccugccucagccucucgagcagcugggauuacaggcgccugccaccauacccagcuaauuuuuguauuuuaaauagagaugggguuuuaccauguuggccgggcuggucucgaacuccugaccucaggugauccacccacuuuggccucccaaagugcugggauuacaggcgugagccacugugccuggccaacaauggcuauuuuaaaaaauguaucacuaccuguuccuauuauucuuuauaucaugccagaaacaucucugcugcucuagucaaucacgcaaguaaauauuuccagguaaagaagguuguguguggaauacuguaauggagacaggauaaggaauucuuguauuguguggagggagggagcacaauaagauauaucagaaaaaagcacacuuucucucuaacuuucuaaugcucagccuuugggccuccaauuaaggccuauugcuucacauuuaaguauuaaccuuggaaaucugcacuaccaaauucaaacauuagaggguuugucuucagaggcacguacaaguguucauacuccaaucugagccacuagguaggauucuguauaugaugcaauaggucauaccacccaaacuagaaagauuugcagacgaugaaagguuuggauaauguuuuauauaaaguuucaaaacugaaacuugggaaugucauucuaaaaguaauaccagcuuacuaagccuuauauucauuuauucauaagauuaaucucauuccaaaauacucaaagauuuuugcugauaucuucucauuacuccuuaugaauaugcccaagaaagaaacaggauccaaugccuguuaugaaucaaauuuuucuaagucaagggcacugaauccaaagggagacauucaaguauguguuagauacuuuaauaauuaaauuuaaccucuaccaagaaaaacuacauuugcuucaugaguugucaauuuuaguaaacuugguagaguaaacuguuucaacugucuuacuauugcauaugaauagacauuauucaaaugcaauaguaaaaacaaaucuucuccagagaugauaaauuucugugcagaccaacaguucuuuucuccuuugucaugggaauccuaagacgugaacuugggaaaucaaccauuauuauaguggcucgucauaauccaguuucugaaagccaccauauuugcacuaucacauuaucauaauucuagagccuauuacauggagagccagagcugacuguggguuguaugaugugguuuaaugaggcccagaaucugacucuaauuauaccuugaaagcauucucacagggggucagaucgggugggaaucugacccucaucugcaagugaaaauggauuauaacuuuggacauucaugucggcccccagcaggauauacuucauccaagaucagacacacguucacaagacacaaauagcucguuugguguuugcaugcuggucuucauccaaugacuccggaugaagccauugccaaguuuucuacggagagagaaugcuuuggcauuacaaaacugcacaacaaaauuaaacaaaugguucaucuuucuuuuuaacccagugauuuuucauuauuucaaaguuuacaaaugaaugcuuuuagggcuuggugaauuacuggaaaagucuucuacagacucccaucuguuuugccaagugauuuucuacaauuucuuacaagguacauaucacccaaguaacaccucacucucauccuuuucaauuuacaaaacucaucaucugagcagaaaucuaauuaaacagccuuaauuccuccacaagaaccuugucacuuuacaugacaacuagcacuggagaaacucagagaaagccguaugagagcaaacuuuccauuaaaauaaaacaacaacaaagauagauuaaaaacuuagugagaaaaauaauggcaaaaagaauuuuaagaagugauuacaaacaaggcaagauaaaccaaaggggccaaugcuggaacuuugaagugauguuggauuagaaaaugcccuucuaggaugaccuugagcaagaaugguaaggacugcugagccuuuauccucuugaaaccauuauggcaauuggccacccuuucccaguuguucuuggccaucaucuuuagagucacuggcaccuaucauuuccaaaacgaacaucuauuaagugucaagguguuguauuugcuguaaaagaacuugauuauuggaaugugcagaaaauuugguacauaucagugauuccaaguguuugcuuagcuaauaaacugugucuucugauuuuucaaagaaaauggaaagagaaaugugaugaagagauacaguccuuaucugaccuagaaaaguuaaguucuacaggugacccaaauuuugaucauuucucauaagcuugucuuucacuacauauauaauuaacuccaaacuugucuaguguaacuacaaacucauccauucuaccuuauuucucuccugaagaaaacaaaauagagugguugaaaacccauuaguuuuuacaauccuagacaaacauuucuuaggagucuaccugaaguugcucuuuuuuuuuuuuuuuuuuuuuuuugagacggagucucgcucugucccccaggcuggagugcagcagugugaucucagcucacugcaagcucugccucccggguucacgccauucuccugccucagccucccgaguagcugggacuacaggcgcccgccaccaugcccggcuaauuuuuuguauuuuuaguagagacaggguuucaccguguuagccaggauggucucgaucuccugaccucgugauccacccaccugggccucccaaagugcugggauuacaggcgugagccaccgcaccuggccugaaguugcucuuucaaugucucugccuccugagucccaaacugucuuggccuucauacucugcucuugugugugugugugugugugugugugugugugugugugugugugugugugcgcgcgcgcacgcguguguuuuaagagacagggucucacucugucacccaggcuggagagcaguugcacuccaugggucacuguagccucgaccucccaggcucaagcaauccuccagucuuggccuccuuuguuacugggauuacaggcgcacaccaccacgccugucuaguuuuuuuauuuuuuguagagacgaggucucacuguauugcccaggcuguuauugaauccuugggcucaaguaauccuccugccuuggccgcccaaaguaugcugggauuacaggcaugagccacagcaugccauucucuguuauccaccguuuuaaaaauguuuggcacuuacaaucaaaaagccauucauuugcuuacccucauuuaaaaaacaaguuaugaaaacaauguggcagggguggggagaguuggguggcugaaggggaaccuucaaacuguuuuccauucugaagaaaagcagagguaaaucccugggaagagauguggacuuauaaggauguggcauuuccucaugggucgugggaaggaauucauugauuuaauuuacaacaauuaggaggugccucugugcugugaguuuuuuuuagcuccagcuggcaugggaauuauuuucccggggaaugcucauacccaaauacaaggacaccuucaggaagaggaaaaggaagaaguaccaucuaggaaccaaggauguggaccaggaaauucuuuuccacugcacugauuuaaaagaauagcaugcuggugccuaacaaacuccauggccuuuuuggaguuuccuagugcugugaagguuucccuuggacaugagauuguuuugcaugacaauauccauauuauuuucucaauaaccaaaaaugucauuuccugaaaagaguuggaaaugccaguugucacugugaaacucacacaggucuauguguuccuugaacccucacuaaaccuucaaaaccaaaguucaaauucagaugcaacacgaaagccuuuccagcucucaacucucccaaacuaguuccuacagauccuuccuucuuccaugcuuuccauuucuccagaaugaacuacuugcuuuguguacauacauuccucgucuuucuauccccaugccuuuauuugccuggcaagcagugcugcuuccauaaacucaaauguuaccuacccuugaaggcaggcucagaucuugcgcugcuuccccaguccccagcuagaaauaauuucuuguuucucugaaaguuugaaguagauaauccacaccuucuucaugguaauuauggcuuucuacuuuauuuuguguuauaagugcucuucugucuuagugaagauaguaaacuuccugugggcaggguccuuuggcaccuaacacagugcaacacacacacaguggguacuccaaccgcacuaccaaaaugaacaaacuagcaagacacuguaacaaauuaaaguaacuguccacaggcaaaaauguacauccccucccagaaauauuuguuuagcaaacacugcuccuagaccaacagucucuagaacagaaagucauguuaagcaaaauuauccaaaacauggaaaaaagagaaagagaagacugugagcccuuccaaagucccacgagagcauauuccaugaagucagccuaagucagggucaucugacucuccagacugggauguaacagagucugacuuucuauuuacuagugguuagggcuuagacucugcgaaguuagauguuaacuuagagaaacccaguaauaugcaacuuauuuuguccaaauguuucagguuuauugcccuguaggucacuaaccaguuuuguauccaaauuagcuaugcuagucuggcauucuuuucccccuacuacccccuuccccacauuuauauguauccguuucuggcauccuccuuggaagcagcuuuaucaucuugcugguuccuucauuaagaaguuaaaaaaaucuuugauguggacuaauucauucauuauaggagaauuggguguucaacuuuugaaaauuauacuuucagaauacuaauaauuaggaauaaaaacaaacguaaaaauaaguacuguaaguaucauuauuuuuguacucauaauuuucuuuaauuuuuaucuagaauaaauuucccaaauaccaaauuuacucacccauaaacaugugcuuccauucccaaggauuuauacaaaaacaacagagaaaagaaugaauauucuuuauuccuuguaaaugcaaguccacuacaaucaauucaguaauagcuuuauuugaaaagccuguauugcaacuaaaaucauaucugaucuauuaaaauaaaacuaaaaucucccuguaaauuucuucaauuuaucuaucauuugaaauuacugaacaucuuagaauguaauuuuacaucauguuaggaugaauagcgucuuguaaauucaagccauaauaauauugcauuagaagcaaugcauuuguucugaaaucacaacaggucauaauggaaaccagacauuaaugcuuuaaggaguaacuagcugaaauugaaugacauaaucacccaauccauaaagcauuuauaagauuuaccauaaagcucagguaauuuuuuuuuuaacugaagagaaauaauucuuucuuacuauccuaaacaucaaaugccaucacaucauaaaaauaaaauauggcacacagauuauuccauuuuguucauccauuuauucauauaauacauauuaacuuuacccuauaauaaugaaaacauuaugcuuguucacuauuauuuccaauguuguuuaaucaacaaggcucaacauguucccuggcaagaggcuugccaaaagagaauccagucuaagcagaggguucaaaaggucuggauucugcaacacacugcugccuucacacucucaacuucaucucaacaugaugaaacacugauucuacccugacaaucauguagcuuuuaaagcaagagggucuacuaagugaaccaauaagcucacuggacaauccuaaucugcucucucaccuauguuuuacucugauuccucccuuucuuuccuuuuguaugccuuucccucuuccaccuaucauaaccuccaucagcaccucaaaugaugaacagcuggaguagauggcuuagguaggagaugagaacaucccuaauuucugucucccuggauauuauccuuggaaaacacaacaaauuuggaguuggaaaaaguugcuaacucauguguuucucuuaguaaccaguuuuacauuucugaucacaaggggagcacuuguaaguaaaagcacagacuuuacaaacacaaaguauuuuaagccuuccaccaaagcaccaguauuugcauaguagacaugcuuuuacacugauaggaucuuucugaaagcaaucuuugcuaauuucugcuaugcugaggaauguaucacugacaaacaucauuguguugcauaaauaagcugacaccucaauacuuaggguacugaaaaauaauaguugugaaaucuauaagaacuggcucaaguccugacucuuccacaaagcuucagaaaaauuguauucgcauuuuuuucucuuuuaauccccccuucucaaaccauacuccaucuaaucuaagauaccagcaacugucucaucuauauuuugugugccaguaggaacaaacaaauguugcccauuaaacugucucaccauucauuuaaguugcagcucaauuucagcaauauuagucuucaaaaaaaugcuaaucuuagaauccauaaaugcaauauucuacuagcugagcaccugauuggcuacucuacuguucuuuaaauauguuguuauauguguguacacuguucucuaacauauuguaaucuuuauuauuauuugcuacauugugcaucuacugacaguuauaggcacauaggaggcuauaaacuuauaauuacugcguagacgaucaaagggacuugaaggaauucuuauugcaaaaauggaguuacugucaaaauuuuuaaaugccugcucaaaauaauuugcuucuccaacuuuagauauuuuaggggagcugaacuugcaggcauucaaauaguguucaaaauuugccauuuggagagucaucaugcaaauucaucuaaaacaaauucccugagcuccuacugugugaaaaucauugcaucagagucugugagauacaaagacgaauuagauuugauucccauccucuaagaccucacauucugguuggaaaaauggaacugguacaugaaagaaugauaaagccaugagaagauuauuacuauucuugcauugcuauaaagaaauaccugauacuggguaauuuacaaagaaaagggguuuaauugguucacgggugcugcagggcuacacaggaagcauggcaccaggcaugugcucggcuucugaugaggccucaggaagcuuuuacacaugguagaaggcaaagccagaacuggcacgucacauggcgaaauuaggagcaagagaaagaguguguaugggaggggggcgggcggugggggaggagugucauacacuuuuaaacaaccagaucuugugagaacucacucauuaucauggaaucagcaccaagccaugagggaucugcccccaugacccaaacaccucccaccaagccccaccuccagcauuggggauuacaauucgacaugagauuggggcggggacaucucuccuuucucugaaucacauacacgguaucauaaaauguuacgugauucagagaaaggagcgaugacucugguccagggaaccagagaaacguucacaacugaagugccccuugacuuaggacuuggaggauacacaagaagcauucugacaaauagacauggguuagaggaaugggccuaccagucagagggaacugcuugguuaagggccagaaggcuuaaaaguguaaugaaugauaauuguuuaguuucaguucaugggguggggugguaaaaaagacaguuugggagaagauggaagaggaauuugaaaaucacauaaaggaaguggcaucuauuuuuuccuuauucaguguagucauugcagguucugcuguuguugcaauugugguuuauuucauggaaacauaucugacaacuaagaugcauuaauauacaccugcagugcauuaaacuguguccgcaaaaagguauguucaaguccuaacccuugguaccuguaaaugggaccuuauuugaaaacagaaucuuuguuuuuucuuuuuugagacaaggucucacucugucgccuaggcuggagugcaguggugcaaucucagcucacugcagccucgauuucccaggcuugggugauccucccaccucagccucccaaguaacugggaccacaggugugugcucccacgccuggcuaauuuuuuguauuuuuuaauagagauggguuuuugccauguugcccaggcuggucuccugagcucaagcgauccuccugccuuagccucccaaagugcugggauuacagggugugagccaccaugccuggccugaaaauagagucuucgcagauguaaucaaguuaaagugagguaaggcuggaguagggugggcucuuuauaacaauaaggaaauuuggacacauauucagagacacaccaggagaaugugauaacggaggaaggguuuagagcgcuguagcugaaagccaaggaacuccaagaauugccugcaacuaccagaaaaugggaagaggcaaggaaggauccuccccuagaaccuuuguagggagcauggcccugccaaaaucuugauuucagacuucuagucuccaaaacugagagaauaaauuagucuuguuucauacuuucccaguuugugguaauuuguuaugguagccauaguacacuaauacaauaccuuuuuuuugagacggagucucccucuguugcccagacuggagugcaguggugcgaucucagcucacugcaagcuccgccucccggguucaugccauucuccugccuccgccucuggaguagcugggacuacaggugcaugccaccacgcccagcuaauuuuuuguauuuuuaguagagacgggguuucacuguguuagccaggauggucucgaucuccugaccucgugaucugccugccucggccucccaaagugcugggguuacaggcgugagccaccacgcccggccuacaauaccuuuuuugacuguucuuuguaagggcaauuaaaaucuccaacauuaggacugcuauguaaugcuagaucaggaagagcuauaaugggaaugggaagcagcccuggaugggaaagacucucugaaguucuaauuccuuuuaauuuccuccaucuuuuauuuuggcuuuugcaaaauauuuaauuuuaagaaagauucuuguuuuaaaauuauaaagcaugaggauaucaaaaccuugaucuggcaguuuucauaugaaacauaccauacagaaauacagagauacucacuucaacauguugacagguuuggaugaguuuagccaaaagggucuccaguucuguguuccucuuaauaagguuggugagguuacucucuaaguuuugcuguucaaaaaaaaaaaaaaaagaggaaaaauauuauucugcauacuuuuauacuucagauacacaaaauuacucauucucaggaaaaacugauacauuuuucagaaaccuuagugaaaucgacauaauuucaaguauuuauagauuuaaacuggauuuucaaaaguugcauuuaaaagaaccuuuuagacacgcucagacuuuauucuuuuuguuccugcuucuugcacuaacucagggauacuuaacagaauaauuaguuauagguuaucucuaggucacgaccuaggaagaaaggagguaauuggauuucuaucccuuuacuugaaucagagcuggcaauaacauaaggaauauauucccacaucaaaucaacuaccauuggauuuuucagauuuauccuuuuaugggcaggcugaggcuaaucccuuggaggaagguuugaauuguuuagcucuugcugacaauaaggucauuuauagacauuuaugauaaguccucaucacacacacauuuggucaguuguaguggaguugacucuguauccacuggguuccacauaccuggauucaaccaacugcagaucaaaaauauuuggaaaaaaauggaugacugcaucuguacugaacauguacagacuuuuuucuccucauuauucccuaaaccauagaauauaacuacuauuuacauaguauuuacauuguaauaaguaauauaaguuaucuagagagaauuuaagguaugcaggaggaugugauuagguuauaugcaaauaacaggccauuuuauaucagggacuugagcauccaugauuuuaguaucuaugagagacccugaaauuaauccuuuauggauaccaacaaacaauuguacauuuuauuguucaugcuucuauucuuuguccaucaaugccagaucaaauuucuuugaacacuguauuuaccacucauuauccugcauaagacucuagaauuauucccuauuccuuuagagcaucaaacuuaaaguucucuggaaugacuauuuaauccuauuuucaaacacaauagcucucuguucuggguaagacucacuaagauuucucuguuccuucucauucacaugcucuugauugccagggguguccaaucuuuuggcuucccugggccaugcuggaagaagaacugucuugggccacacauaaaauaacuaacacuaaugacagcugaugagcuaaaaaaaaaaaucacaaaacaaucucauaauguuuuaagaaaguuuaugaauuuguguugggcugcauucaaagcgcuucugggcugcagguggccuugcaggccacguguuggacaagcuugauuuacaccauucauucauuuacuuauguguuccuaccauucauucauuuacuuauguguucauacaacaaguacuuauuaagcuucuacaauaugccagacucugaaagagacaguggggaaaucaaauaaaaauauuaauaucuauucccuguccacaaggaaauggaugacuguacaaacugggagaaagaugcugcaaacaagagaagggaaagaguugauggcugcugguuaaagguuuccaagagggccaagucuugcagcugaggcuugaaggauguccagggguuuuuuguugcacaacaguggaaacuucuuggaaagaaagaagugagcauguggaagaaucuuccaugggcagggaauagaacaaugucguaugccaacaucagagagguugagagggcaaaagauuagggaaacuguguuuuagcauauagacaguuccacaaguauggcaaagauacggaacaacaggaaauuucauggaaaagaaaacagaccucaaauuuauaaugccauccaagaaagaggauuuagaaagaguuugagggauuuugaaaacuaacaaguucauaaagguguuaauuucauuaugcuguaaaauuuauuuaugaaaauuuuagcucauucuacuucccuaaauuuuuuauuuagaaaaguauauuaaggaaaagaaccacuuucaucuaaggcuuaaaaugcauaugucaaaagcagaacuuucugguuauuuuuaaaacaaguuaaacuuauuaaucugguguuuauccuauugacugauuuuaaaauuuuuuaaugaaugcauuuucauuucuaguagguucuuuaucacaucucccuuuucuuauugaauuucucucuguuccuauuacaaaaacacgauucucuucuccauaaucucaaaacaacuaaacuuacuuauucuuaagcucuuuugagaaaaggcaauucuguauuucccugugcuuguugacuauuucucaaggaucugauuuuaucuuugucuuguaauuuuugucugacagcucauacgauguaaacuuuguucccugugcugugauuuggggauugacauagcccagccagauaagaagcauauucugagguuagggcgugagguucuuuucccaaagaagacgcucccacaaggcacucgugugcaacagaggcacagauccuaguuugacucagugccucugcuuccuuccaugagaguucugugucuggcuucaauuccagagaagaugucagguucccuuugaguccagucuaugcaugggggucuuggccuccagguguacaaggcucuugccacaugugauguucacuucccuauguguccacugaagucaccauugccccaugucaucuccacuucuugggaguagcccagugucagucuucucucaccacucuacacuuucuuucauuuccgguccuuggaggcuuuccacauauguuuaugcuugguuauguauucacuaaaauacauuuuaaaauauuuuaucuguaauucucauguguucaaacuucagaggaaggcuuugugcacauuucaucuggacuggaaaaccaacaagaaaccuucaauucugucuuggaaucacucaaaacauuucaaauaugacaauuuuaaaggggaagaauaacuuuuucacuuaaagaaugggauacaagaggcugaagagucagagaaugaacuagacacagugauuuauguacaacuugaucuuaugcuugcaucaaagaaaaacuugcuuuuaacaacaacaacaacaacaacaaaagccaaaguuuuuuuuuuuuauuguuuggauuaaaugaaucgcaacugcuaaucacuuuauggucagagacuagaggaugauuuugaagcaucccauucuucaauguccuugauauagacauaaccauuauaacguauauuugucaacuuuuuugguauguuaauacuaggggauacuuuucuuuuuggcugacccuucacagcaggaaauuucuagggaaauacaucaucuaacuguuuacaguucaauugucauaaguaugacuuuucuaaaguuagucagcaaaagagggccaaagaaaugcaauccaacacauugagauuuuacaaacaucugcuugcuucccccucccuuuauuaaguauacaucaugcaucaaaucuguuuuuaaucaacuaauacauagacuaaagccugugguuuaaacacauugaccuauccagauccuuugggguuauucaaauuuaaauaguacaaguguuacugaagucugcaaagaauuaccgagucaguuagaagcauaauaaagggaaauuaagcugggagagagacuuguuuccaagugguaccaaaggggcugacaacaccuuugaagggaaccuggguaaugggaagauaacaaaauccaguccuuaaugagccaugcacccauaagcuuccacuacagggacuucucugaagauuuucuggaaauuaacucuaucacuaacauccugugugguaguggucagcagucuccauaaucucuugauuuugauugugacuugugcaaaacagagaucauacuuuuccauauaaaagucaugggauuaaguagauaucaguuucuauacugcccuauggauaucuaaaaaaauucuacagagcacaagaaaaauugguuuuaguuuccuguucucaccuugaaaacaucaauauauugacaucuccuuacucaaggcaaguuuuguagaaauccaaggagucagugaccacauaugaagagggaggagaccgggacuaccaucccagcuggacucucuucggcaaaugacuggaugugucuugggcucaguuuucccauccauaauguauggauaaugauaaaucuaccuaucuauacuauuguuaagaucaaaugagaaaaugaacacauucaccagagaacuacaugaaugucuguugaaauuaugaauuagaagauggaacauuuaguuuggacacaguuccagacacuagaagggcccaacccugugccucugggaggcaccauucuccagcuugcucauggcuuuuuccugcaagcaccugugccuuuucaccccagggccuuaccuggcuucaggcaaggcaggugcuggggagaguaagaagaagcugauguuccuaggagcagcccucaaguggcaauuacuggcaauugguggauaugcagcccagcuuuuucaccuccuggguggaaccacucugagccucugucuacaaaaucucccacagggcgcaauugggaggcagcacauggguccacagcaacaaccugcucauuaacccucuuuccucuucaaucucuucccuguuugcauccccucucccuccaggugcuuccuggaucaccucccaauucaaauucugagucagagucugcuucugggagaacucaucuacgaucaucuccauagaccaccuaacccauuuuugcguaugccuuucugugaggaagagccaaaucagaaaauauuuuauugcuuuagaaagacauuugcaaauacaagagguuuucucucuuuccccaucuuuccucuuucugcuuuuccuagaggucacauauccuccaaauuccaggcuguagaucagcaguaucaauagaaaccuaaugugagccacaaaugugagucacauuucaaauuuuucuaguagucacauuaaaaaaaauagaaccaagaaaaguuaauuuuaauaaaauugucauuuccaccugcaaucaauauuugaaaacugaugagauauuuuauauuuuguucuuucuuuuuacuaagucuuuggaaucugauauguuuuacacuuaugacacaucucaacucaaaccagccccauuucaaacacuugggagcuacaucuggcugguggcuaccucacuggucuagaacaggggguggcaaacuugcuauaaaagaucguguaguaaauauuucaggcuuuauuggccauauguucuuggacacaaugacucaauucugcugcuguuuuagcaugaaagcagccauagauaacauguaaacgaguggauaggacuguguucaaugaaacuuuauuuaccaaaacaaguggugagugagauuugacccacaacuguuguuugccacgcccccagccuagaagguaaaacucaaaaugauaauauugucugggccacugauaaacaucugcuucuguuaaacacuaacauuugucccaaacuuuuuguguaagucugaaauagaugccacucaaugaaccucuaggaagaauucuuucuguacaagaugcuaagagcacuuucacuuaugggcagaaagcuuagcuugacagaacccacaauaaucugaagaaaauuaaacagcauuuugacucguagauauucuaauuuaaggagcauaaugguuaaguacacagaaccuggugccagucugccugguuugaaguccuagcucugagaccuucaacaaguucuuaaccucugugccucaguuuccucauggggcugucaagaugauuagaggaggagauacauggaagcccuaggaagaguaccuggcucacgauguguuguaucggugcuuguuaaauaaaauaaaaaacuuguuuuucaaguuucgaguuuagacugauuuuuaaaaaaagcuuaauuuguaacacuuauaccacaaccaaauuaaaagcaugcccauacaguuaauaaaauauuuaaaccaccaccaaauuaaaagcaugcccacacauuucauaaaugauuuguucuguagauuuucaauuuaguaguacauagcuacaagaauauauuucccccuaagauuacauuuuccaaaaacacugaauccuauuugcucagcuuucucaugaugugauuauugucagaauucccaucuggacugcgggucccuguuuuagacuaaguguacauauuucuaaaauguugugcaauguccuaaaucucaaugaaugcuaaugcuacuauuuguugucaucucguccaugaagcccuucucaucuguuaguuugaaugggcaacucccuuuccuuucguggucaguauuacucauaccucuuuuccucuacuuuccccacuccugugcugugcuccugccauugugaacaagcuguuuuauggauccaggcuuguuucugggucugagcaugggcgcagucucuucccuuugccuggaaugcauguguguagcagaaaauucuaccagcaaaaagagaguauaauaaagccacaggauguauugaguacuugcuguauacccaucauugcuuagucccuucccaccguacacccuuaaauaugcaaugauauuuccaauuagcauggaaaacugaauauucaccggacaacccuucugaaauccaauguaguaaaucaacugauuaguuaauuuaacaacuaguguagauaguuaagacaaugucuucucucagcuuugcuaaacaacagaagucuuccaugcuuucaggcuuuucucauugguaccguugagucugaccccaagaagagggccuugagaguuuagaagaauuuuugaggaauguuauauaacacuguccagagcacaggauuccugugaaggcaaauauaacauuaucaaacaaauuuuuccaaaccgggauuuauaaaaauagagagaugcuauagcaauuaucacuaacacaucaacuucaaguuccaucuaaacccaaagucaaguugcucccagccuuaauucauuaccuuuuccccaagugauuuuuucauagugcucuuauucugugagguuuacgacuugguggcauucaauacuacccucccaccacuaccaccaaagaaaagaaauacaaauaauucaaaaugguccuuauaaaaggcaaggauaccugugggcagauuuaguuucuuaauauuaagccaaggauuggguauaggucaaauuuguggaaggcaaaguuauaaaacauguguugcuuaaagaaugaggcuuccuuacauacuuuaugcaaaaagggugauuaauuuuucuuauaauuuuuauuuuuaaugcacacauuuuggaugcaucuucacagagccacagucaaccuccuucauguuagguaguuuuuaguaaggcuuauuugagcugauaauugaacaauucauguugggacagcugauuuuacaccaaucucaauaugagccuuuaggcauggauagggacaccagcagagaauaguaaauccaacuuaacagaugagcuuuguacuucuacauacagugauacccaaucaaauagcaagggaagcagacaaaugccccuaauuuuagccuuuggagaccugaaccuaagagucagguugcagggaauuaaugacuugucauugagcacuacuauuaaaauguaugcuugaaacaggagauuucaguaauuccuuuuggguuugcccaggacuuaaagaaugcuugcucuuauuccgaagucaauacuucagaaugucuuuaaaguacaauauuaggucuggauaccuuucaaggcaaacacagaucuggcuuguuucauuccauaauauucagagugacauucagcaacuguauucggagcccuggcacccaacaccaccacuccagcgugaucaggauauggacacgucaagugccacgacccauauauuuucuucuaagaaacuuuaaucacaauaguuaauaugaaaacacacccauauuaacacaugccacuuguauaaaagcauaaauucuuuauauguaacuaaauuuuaaagauguuuuaauugcacugcaggaggcugagacuaucuucagguuugacucgacagaccgcaaauacauguaauuuagguuguuuuaauuuuuuaaugcauuuuuuucauugguuauaauagcuaccauuuccaaaugcccuggcaagacaggccgccgagggaacuucaaaaaccuaauaaaauacaaucugcauauaaauuuaagucuaguauuccauggacuacaauuuaagucauuuugauaugugauacaguguuuaccuugucagguuuuauuugaaauuucuauauuaacaccacagaaucuguuccauauauuuauaaauuccaucauuaggaguucaguguuuauuuuucuaaccugguagucaauaacauacagagaacaacuuuuaaauacuguguauggucuagaagagcuuuuauuuuaauggagauaaauagguaucuuaguauaguucuauucauuuaguuauaauuuuagcagauccaaugacgacuaguuauuuccagguauuagagaugugaauggccuuuuuuauucacuccuccuccccagccccauuucugccuauaauaagagaggugagcaaaugaccaauaaauacauuuguugguuuugagaauggauaucacaugaagcuauauuacuagaauccuuucaaauucucuaacuuaaaaacaaugaucucaguugcaaaauuuaugccugcagaaaaaugcuucuaagaauaagucuauaacuuuuaucagcaggacauaaaggaagcauuuuguaagacuauaacacagcuagaagagcuguggaugguccaauugggcaacucucuggcagcccucucugcucauuugcccuuguucaacuucugaauccuucucaacacaguacucugggcugccauagcaauaucaaaagaggccacaggcagggcacugugguucaugccuguaaucccaacacuuugggaugccaaggcgggaggauugcuuuaaaccaggaguucaagaccagccugggcaacauagugagacccccaucucuacaaaaacuuuuuuaaaaauuaaaaauuaauauuaagccaaggauuggguacaggucaaauuuguagacuacagcugguacacaucuguaaucccaguuacucaggaggcugaggagggaggauugcuugagccugggaguucaacacuucagugaguuaugauugcaccacuggacuccagccugggggacagaaagaggcccugucuuuuaaaauaaauaaauaaauaaaacaaaagaggcaaucuacuugccaguuaagaauuacauggugaggaggauauuguagaacagacuaauaguaguuaauuauuuuuguucaagugaaaacuuucaaaucaggagauauucaauguccuaaaccagagguuggcaaacuaugguugguccacuggucaaaccuugcgugccgccuguuuuuguguggcuuguuagcuaagaaugguuuuuuuuuuuuugagacagaguuucacucuuauugcccaggcuggagugcaauggggcgaucucagcucacugcaaccuccgcuuccuggguucaagcgauucuccugccucagccucccgaguagcugggauuacaggcaugugccaccaccaugcccagcuaauuuucguauuuuuuagcagagaagggguuucuccauguugcucaggcuggucucgaauucccaaccucaggugauccacccgccucagccucccaaagugcugggauuacaggugugagccaccgugcccgcccucauuuuugcauuuuuaaauaauuuuuuuuaaaaugaaaagaauaacauuuuaugacacaugaaaaguauacaaaacucacauuucuguagccauaaaguauuguuuacuguugcuuucacaguacaaugagaaaguugaggacuuguaccuacaaagaccaaaauaucugcuaucuggccauuugcagaaaauuguuuuccuuauuuaaaaaacaaccuucucuuuuuaauaauccaagaaagaaagaaagaaaggaaagaaagaaagaaagaaagaaagaaagaaagaaagaaagaaagaaagaaaaagaaagaaagaaaagaaagaaagaaagaaagaaagaaagaaagaaagaaagaaagagaaagaaaagaaaucccugguauccauguggaugguaaaaaaaaaaaaacaguccauguaguuuuuaauuaauuuauacauaacauuuuuuuucuguugcuccaagccauuuuaaaauuucaauauaauucaauuaacuuaacauuuucaacaccuacuaugggaguguaggaggaugccucaaauuccaauccuucagguacucaaaauucuaaagacucuuuuuguuaaccaccaaaauaaauuuuaacucagaaaaaaauuauagauaagaugucuuaaauuauggauaaaaugcaaugauugaauaaauuccuguuuuauuugugucuuuuguccaggaaagcaggagcuucaaacugaggaagaguaagaaaugacaaucuucaauuguaucaagguugcuauagcaaaaacauggucaaaagugaguaaggaaggcacagcaugaggauuaguuaguuccuaccacucugcaaauaaauauauaaagcauugaguuuuaagugccgacuggauaaggaauuacucauugauugcuaucuuccucaauucuauuauccuggucuuuuuuuuuuuccucaaucauaaaauacaccuuaaaaggcaggcagggaggguguagagcacuagauaauuaaugucuauaaaauccccugauacugauggaugucauacauguugucuguauaggccccuucaagcuuuacuuccuccaucacucagggauugaauaauuuugaucuuauccccuuucuuccaucuuaaguagaugauaacauugccagauacucacuaaugaacauguucuggucuuccuacuucaacaggguuuuaacugauaccaucaaacauuuuuaccagaccugaaugucaaauuagucucauaguggaugcuuagccuuggauggaugaaaauacauuuuuguuuuucagauacuguaggaaaaccaaaucuuuuucuaagccagcaccacgcauccugcagguacuucaugucaguuaaacucaauauauuaaacauauuugaagcuaaaauaguugaaagucuuugaucuaauaauuuugaauagauaaguaugauuuccuuuuuuucuauaggaauuuaucuucugaauuuuuuagguuuuagaggaaaaugcccuuuucuggaccagcugcugaaaaugauuauuaaaauucaauacaugaucagcuuuguucuugaauuguggcauucaaaggaaagguucguagcuuucacaauacucauauccccacaugugugguacaaaaaaauauuuaaggccaagggaggucacacucuuuggcucaaaaaaauagauuaaaauuccauuccauccaaaguggguacgaucugucaggaauuuacaaaaucaauauuauguaagagaauuccccauuugggacauccuacagaaucaaagaagaauaugaaagcaugccauuguuuuucagcucugaaccuucaaaaacagacccuugccuaaguuuugaaguuugaaucucaaauucuuaaaauucauugcauccuuugucccugacuucaucaucuuuacucagccauuuccucaaccuuuaguaggaccgacacugccuuugucuauucaagaugauuucgacugaguugaaagaaauguggaaaucauggaaggaaagaagaugaggagugucuacuaggggaguaguucccauucuggccuacacauggcaaucaccuggaucuauccucccuucccaaccggagaguauaaauaacuucgccugagugagguccagggagcaggauuugugaaagcuacccaggagauuccaaugugcauccaaguucgagaaccauugcucaaaauggagaaacagguucugugauacagugaaggaaaaucaauaauuuauucaauuuacuacuuuuauacuuuaggauuuauucagaauaaaaauauauuuguaaugcagcuuauauguauauaacaaguacaggaauaaaauuauauauagauguauguagaaguauaaauuuaugugauuuuaucauagaaaaucccagcaacuuuauuaaaacagugcuuagcggggaaacacugauuguugcuguuaaggaauuuagaggacuuuuuauacuugaaaauauaagggaaugcuuucuugcauucgaguauucccaaugccuaaaaagagcuacugaauggucaccucaauuucuaauuugccaaagcauuuguauacaaauuuggucuguugaccuuaacaguaguuacuuucaccagaaacacaacagaaguguacuacagauguuuaucauucaacaauauuuuaacacauuuaacuuaaauauuuaggaaaaacauuaaaaaaauucugacgacaaaagaauagauuuacagcucuauucacuuucaaacgucaacucaggcaagagcauugcccugaagccuuguguagucuaaaagguaaauugcaaaauauucccaauauuuggaaaccaaagugauaaaguauucugaggcugggcauggugacacacaccugucccagcacuuugggaggccaaggcuggaggaucacuugaauccaggaguuugagaccagccugggcaacauagggagacccugucucaaaaaaaaaaaaaaauuaaaaauuagcugggcgugguggcaugcaccuauagucccagcaacuccggaggaugaggcaggaggaucgccugaguucaggaggucgaggcugcagugagccaugaucgugccacugcacuccagccugggcaacagagggagacacugccucaaacaaaacaaaacaaaaacaaagaaaaccacaccuaguauucugcuucuuugauugauggccacuugccuggggaaaaaaaaaauagauuuucuagaaagugauuuaauuugcuguguuuuacaaaaaauauuuacuaaggcauuuucccaauagcauucauuuguuuauacaugacuaaagacaauuuaugggucacuguauuuuggaagugaacuagcucucaguucccugaacuauauuugaguuuacauauacaacguguugcuaaagcggaagucaaauaauaaauguuacuuucaaaaacuuuuaaaaaccaagccauuugcuuuuaauccagugagagaaaacuguccaauacucagaaguggaaggagacuugccaguuauaacaauuacaaauugcaaagucucaucuuuucuguagaaucuagaagguagaccaggaguucucaaaauguagcuuggcccaaccacagcagucaccuggggagccgguuaaaaauacaaauuguugggcaccuuccccugggaaaacagaaagagaggaaaagcuaaguaggaaguaagcaauugcucugcuucucuccccacuuucccuuucuuguggacauuuuguuaucuuauuacuuacuaaggcuuuguaaucaggucccauucuugggccuuucccgaguuccuucagucucuacugcggaacaggaagcagaacugaagagagagcuagagaagguguaaggggguuaugagccaaugucaugccacacagaagguucaggcauggaugcugcaccucgaucagcugugcuuuuuaacccaucugacuggcaguucuaaauugcuuuuucuaauaaaaaugaagauagaacucagauguucacaacgugcccucucucacacgcaaaaaaacagucaugcugaaguugcucccaguguauucuugauuacuuauaaacgucguucuuaaaaaaaaaaauuaagugguauugaaagggggagagggcaaccagccagcagaggauccagacucaucuguuuaugaugaaaaaauaaugcccccccaaccauugguuggacucaguguaccucuucaaaauucaaaauucagcuugacagaaaauauauaaagcugaaaacaaacauguuaaacuuugcucucaggacuuuuuagugugacuuuuauaauuugauuuccaaaugucugugaccuucgucuaucacugugauaggacacucuggggaggcagugucacaugacaucagacagcuuaauaauuaaauggugauaguaaaucacaaagaggacuuuuggccuuccacaacuguuaucuuucuccagugugcuguuuuuauuugaauaaagugucacugauacagguaaugaacaaauucucaaaucgaaugcauuuacuauaauuaaaggcagacuuuagcacugugcaauuuugacugcaagugaguuucccaccagaacauguucuauccaaacaauuauaauaaaacaguggcuucauauguacauauuccaucagcaauggcauucuuuuucacagcuuuaacuccauccucuguccugacacgauucagauuuugaucucagaucucaacucugaccuaagcuuuagucucucacuaucaguucaauaccaacuuucagcuuugcugguccccuguuauuuuaaacucaacugucuuaaaugcaucaucuguuccuuugaaauuucuccccaccuucccuuuauuuauuuauuuauuuauuuuuauugagacagugucucacuuugucacccaggcuggaguacugcggugugaucucagcucacugcagccuugaccucccagguucaagaaauccuccugccucagccuccccaaguagcugggacuauaggcaugugccaccacgccagucugauuuuugcauuuuugguagagacgagguuucgccauguugcccaggcuggucuugaacuccugggcucaagcaauccacccaccuuggccucccaaagugcuaggauuacaggcaugagccaccaugcccggccucgaucuuuacaaaagauauuacuaugcucuucaugucuucuaucuaaucacucucuaaagauuuuggggaguuguuuuuuuaaaagacuccuugacuucaguuuucccuuuucuucccaagguuuccauucuaacaaucuuccaugaaucacugguuuucauuccucuaauuuuuguccaguuggguccacacauggccgucaacguaaucuuuccaguaagcuuacaucacucucaaaacuccaaaauuuuucaacucuuaaaggaugaaguucaaacuccugaguuggcgugcaaacucaucaaaacuauagguuuaaaacuuucccaguagaaggcagcuauaauuaccaccacccugcaaaaugaacauucaacuucagcaaaacuggauuccuuuuuggccaauaaauugugccaugucuacugcuccuuccaagcucucaguuacgucuuucuacuaaacuaguauuuuguuguuguucccccacaacaucuuaacaucuagcggguuggcugugcaaauagaggcacugaugaauguuugcucaauaacaguacauaaauaauauuaaugcaaccaaagauuuccugacuauaacagaagucauaugaagccaaaucuuaauuccauuucaaaauuggauagaguuuaaucauaugguucugaagacaucaaugcauauuuaagacaucaagccauaguucacuguauuauaaaaacauuuugauuaaauuaguuucagaaauugcucucuggccaaggagcuaucugcuucacaauggaccaugcaauaaaucuuagacuacaugugcugacagguauaagaugauuuauugaaauguaggaugaggaauugugaagcauuacuaagaaauacacacuuucuuccaauguaacauuauuuuacuuuacaaaaguaauuuaggaggaaacuguacuaucaagauaauagcaaacacuucccaaacaucucuaauucuacauauuaaaaauaauccaagaaugaaaucauuagaucgugcggcuggcucuagaucagacagaugacuuaauaaugauccaucucccuauaacaaagcucaccucuguuaauaaucagagaauuuauacuaucugugaccuucaauauugcuucaaucaugugcuagcccuaggauuuuuaaucuuuuauuugauuuuucuuugcaauguuauucuauuuuacauaaugaugacuaaagagauugagacuucacuauaaauugagauucuuaaaauaaagcugcuucugaauucaaaacaacaagaacaaaaccaaacaaacaaaaaaagaaacugagccacauauguaacuaucucuucaugauuaaaguugauuauaaugaucuccugaauuuuaccauuuaacugguuuucugagaauuaacacuauuuacagcuacaguuuccucaauagccaaaaaaaaaucaaacccucucuucucuuuucuuuucuuucuguucuuugagacagagucucacucugucagccaggcuggaguacaguggugugguuacaguucacugcagccuccaccucccuggcucaagugauccuuccaccucagccuccugaguagcugggaccacagguaggugccaccaugccuggcuaauuuuuguggaagacaccugggcucggugcgguguuucacaccuguaauccuagccuaggcgggcagauggcuugaggucaggaguucaagaccagccuggccaacauggugaaaccccaucucuacuaaaaauauaaaaguuagcuggcugugguugcacaugccugugaucccagcuacucaggaggcugaggcacaagaaucgcuugaaccuuggaggcagagguugcagugagccaagauugugcuacugcacuccagacugggugacacagugagacuccaucucaaaaaagaaaaagaaaaaaggaucguggaagacuucuggauacugccugcaggccuuuagauaguauaucccagggccuuuacaauguuucaagaucugggaaauuuccauauucuuccuaacaccaaguacuuaacaaggcuaaagaauucugccugugacuuuaaucuguuuccugggcuguuaguauuccacacaaauaauucuaguuguuaccugcagaacguccugagguucauaguaagaaguuugcgacuaaacuaguuuaauuauaaagccugaugcauugcuucaaagugagagucagucugucuuugauugucugagacccaauauuucauccguggagucacagaucacaaaggucuauuauuccaauuuagaugguuccaucuaaguuggaugugcacugugcauaaugaggaucucauccaaauagucaauuuggugaaaauuaaaucgacuagugccaauguucucuaguaacacauacugagguucucccugccucuucuuacaguuagacaauuuagggcagaaaagacucaugaauucccuuaaaaggaaagcauccuuaggacaagacccagguugcucucccuccccauuggauucaaagcaccgaacacaguauuugcugcauaguagucucaacaaauauuugcuaaagaaaugggcagguagaugggugaguagguggauaacgguuccuacagaguuugagaaaacaauuuggcacuuugguuucaaauccugggaaugaauugagagugcagagugcucucaaauuucagagcuaugcgggugcugccugggaguugaaaguuuuuccaguucucuugaaugggcacucagguucucuugagaucugucuggaagaguccaguuacuugucauacugacauucuacggaagguaccaaaugcaauaggucuaagcuaucuccuucucugcuaaaaaacacaauucucucccauacaugagccgaaaagaaaggccucacucucagggcuaccucuacucuuugccuggaaagaugcugucacauguuagcaggugaaauuagcagacacuuacuuauuuuuggauuacagguaaacagaaaucaccaguucaggugccaguaauaggucccccugcccucccaccaccccccaguaaaucacagcuggugacuacaacuucuccauaucugaaaucacuaacuuuaaaaugaauaucugaauaaaauauuauucaauguacuccgaggcaggcuuugugcacaccaucucuuuugauauuacauauaauugauauaucauauaucaauuacauauaucaagacugaaaaacacaaggcuguugauugacaagcauuuucuuuccuccaguacugaaguacgauagagguuuuuuaaaugaaaacucuacuaaaguaguuuccaguucuuugcacuuuguaguagagaaaaaguauuuccuaacacauaaggcuggaauuguaguuuagcauccauuucaagcagcucucuagaaauguaaaaaggaaauugcaaaaaugaguucaaaucacaaaauauaaaaaucccaagugugaauuuucugaacaacaaugugcaauuaagaaacaaauagaggaagggugggagggugggggcuucaagggauaagcaccuuacgcugaagucuuuggggacccccauugcuaggcaucuccacuggauuuuccaggacucugguucauuuauuucuagacagcuauuuuaccauacuuaagagucaaaugaugggaguuuuacccccauuaacggaacuuaguguggacagcguucuaauggcauagaauggaauuuggcaaaaucaacggccauuuaaaaugguuaacaaaccuggauaauaucaauuaaaucauucauagaauuuuaaccuaaauuaaacauuaccaauguacauauaagaagcauguuaaaacaaaacaaaacaucccucaacucuauacaucacaaguauuaauguguuucgcagacuuuuuaaggcugggaugaauccaacuugaccauguguaggcugucuuuggcaaucauaugauuuuccaaaacaauuauaaaaauaaaagaaacauuugcucauugcuacuaguguauauagugucuccauaggguaauuuguguugcuggacuaaaugcucugaaccuuuaaaaaaaacuuauaguucacgacuuagcaaggucugccaguuguaagaaauguggaagucauaaugaggacuggaaggggaacuuaagacccaauuaaugugguaauuaacgucagaaauagugucuaaacaaaaaggugaagaaaaaagggguggacuugaaccuuuacuguucuaaauacuuucuuuuuuuauuaucauuuuacauguuuagaaugaaaagcaaaauguaaaaaaugaccauagauuuaauauacuagccagauuuacuggguaguaacuuacuaaugacaaagguaucuuugugcuaaucuuagugucuucccaucccugacuaggaucaauaaauguuugcugaauugaauuggaguacacacugacauuagguuggcaggaguaacggaacauuacaaagauauggcaaucaggucacauuagaaggcaacaucauaauuauauuugaguuuacuuuuauuuuggaugaaaaaaagaauuucuaaugcaauuccauuccaguucauuauguggaagucuuaauucaaugacuacauaccaaacacauaauaauucuuccucaugacacauucccugguauauaagugcucacaauaauauccacguaacaagggcuacauacacugaaccaauuugaaguguguuagguauaggucagcuuugaaagaucaaauauugaccaugagauaaaucucaacacccuugacaauauucaacuuuggaacaauaauuuucacagccacacaaguacagcacugggaauguacucaggcucuccuaucaacgaugguccuaucauucuccuuaaguuacucuuggguuuaucugauuccaaaacacuuggucauucuccuauuccugcuagaaaggugggcuacagugagguaacaacucauuuguuuagagcuggauaaaguggcuucuuuuuccacaguccuccuuguuuggcaguagaaauaauaguaggagucauaauaguaacaaugagaauagcagcaguuuaguaguagcagcagcuguaguaguagcaguaacaauagcagcuaccauuuauugaacacauacuacaugcccaguauucugcauauucuaucucuaguccucuuaauaaugugauaaggaauguaugauuacccugauuucuagugauggagagaugaacucagagcugggugugguggcucacaccuguaauccaagcacuuuggggggcugaggcggguggaucaccugaaaucaggaguuugagaccagccuggccaacauggugaaacgcggucucuacuaaaaauauaaaaauuagcugggcgugguggugugcaucuguaaucccagccacuugggaggcugaagcaggagaaucacuggaacccgggaagcaaaggcugcagugagcugagauuaugccauugcacuccagccugggugacagagcgagacucuguuuuuuuaaaaaaaaaaauuagccagguguguuggcaugcaccuguaaucccagcuacuagggaggcugaggcaggagaaucgcuugaacccaggagguggagguugcagugagcugagaucgugccacugcacuccagccugggcaacagagugagauucugucucaaaaauacaaacaaacaaacaaaauguacucaggcuguuucccaggguuacacgacuagugaugccagcgcuggaacuccaaaccaguuccauuugauuucaaagccuguucuccccacacaccauuugacuucuggagcaaauuuaugucuugcuucuuauggcaucguucuuuaaaaagucaacucauuucauucauuuuuuuuuucaucccuuguaacaucuccagaaaaugccuguuaugauuguugcacugguuuaacagauugagaugccaaagacuuagugcaucaaagggaaaguugggauuucccagguuacacuuaagggagaaaaaaaaaagugaaauguguuaucuaagugauacugguuagaaccaaagagauuugaaaucuuaguaaacacuaaaugcacaauguggaaggccucuuuugaggaggggaaaaaaaagcaugcuuggaauuucuuaccaggacuuaauuaaaauaccuuaauuugggaaauguuuuucuacaaugaauugaaauccuuaccagaaggcuuuucagaagaagggaaauauugcuacauuuuaauauauagcucacucuaaauaaaaccagcucugagucauugaccuaauuuaguuucacaaacaguauuaggacugcaucuaauuuaacaguagaaauauauacaguauuccaugucagcaucccuuuaauaccacaagguucucccaaacucuuauuaugggauaauucuuaucuagcucucuaccaauuauagggagauuuauagccuggcgaaaguuuugauucaaauuuguaaggaaaggcuaauagaugagcucagaucaggugaaaauguugcuguccuauauaguagaaaugcaacauaauuaugaacucuaauuuguggaaacauaggcuauuuccuuucaaagcuaaguguuuuuuguuuguuuguuuguuuuguuuuguuuuuccugagacugagucucgcugucucaccuaggcugaagugcaguggugugaucucggcucacugcaaccuccaccuaccagguucaagugauucuccugucucagccuaccuaguagcugggacuacaggcacaggcacauaccaccaugcuggguaauuuuuguauuuuuaguagagacgagguuuccccacguugaccaggcuggucucgaacuccugaccucaggugauucgcccaccuuggccucccaaagugcugagauuacaggcaugagccaccacacccggcuucaaagcuaaguuuuaaauuacauguguacaccuugaguuacuucagaauuucaacaagaaaaaauaccuggauagaaguguuuuuguaaaacccaaaguaaagaacauuacgggaaauuucggccuuucuuucguuaagugugggaucuugaacccagaugaacgagacuuucaacauauugaagguuaucaugauccaggaugacaaacucugaagguauuuuugggagccugugucuuuuguccugccuaauugacauaagaagauaaaacauuguucuucacccuuuucccacucuacaaucauacuuuccuuuagcacauccaguaaccccuuugccugcaaaaaggaugaaagaaaaaauuguaccaauacucaggucagaaaauuaaaagggagggaaacauuccugguaaacaccuucaaaaugguuuguuugcuugugguaugaugauugcuucugaaugaaggagaaggagaaggagcaggaggaggaggaggaggcggaaacauaccuauuugaaagcccaauaacaagcuggugguuuguuuuauugcuuuuuuaacacuuuuauuuaucaguucauaguagucaugauucucuugcuuauuuuaucuucguuuuuuuucuccuuuagcucuaugcagcaguguuggcugcugcaguagaugaauaauagauuugaauaagcuacaagacauaguuuagauuuucacugcuuuuuuuuuuaggauauugccaauguauuuuaaauggaacucuuacacaauagaacauccuacagggauuuccuaugguaguuuaagacuuuacaagacaaauggcugggccccaugagguugccuccuucauccugccaugggcauuuugggcaugccugaaauguucuagcauuacacucucugauuguugccuuuuacugcauggaguuuauuauuuagaaaaaaaaguuuuuaauauuuuaagguaaaaauuauuuccugugcaacaacagcaaaaacacacacaaacaauauuuagaagcuguaaaaugaagaacaguugauucaauuuugaaagaacgaaagauguucugaaaugcuuugguuugguuccaugaaaauucuuugaauuucagccauuuauaaaucaucguucaauaagucgcuggcauuuaaugaccacaugauagauuuauauauuuuuauauaucuucuuuauagcuguuuucucaaugauacugugaaacaaacaaaccuauuuuuauagcacuuuuuuuuuaugccuguugccuguccuauaaagacaaucucaagugcagaacuucccuggauaaagaucaguucaaucuucagcaguugucuuaucaccuaacacucccugucagaagaaacccuugguauuaacucauaucacucaucuucuagaacacuccuugggaacacuuuauuucauaaaaucccuuagggcuauauaacucucaacaguacuagaaaaugacuccccacugagacucaagaaucaaggauuaagccaguagugaaguuuuacuaggguggagugagcaaacuuagguguugcuguccucacauaugugcgagagauaaaaucauccuccaguauguuccucccucuugcauuucuccuaaucauagacacuuccuugaagaagacagaacaugcagccuaggcuauguuaugccaaaggguagaauaauaguaaugguacuacagggaauaauuugucaucauugaaaguuuugggggccaggugcagugguucacgccuauaaucccagcacuuugggagguugaagugggaagaucgcuugagcccagaaguuugagaucagcccaggcaagacggcaaaaaccccaucucuacaaaaaaauacaaaaaucagcugggcaugguggcacaugccuguaguuccagcuacucuggaggcugagccggggaggucgaggcugcagugagccaugauugcacuacugcacucuagccugggagacagagcaagauguugucucaaaaaagaaagaaggaggccgggcacaguggcuuaugccuguaaucccagcgcuuugggaggccaaggcgggcggaucaccugaggucgggaguuugagaccagccugaccaacauggagaaacccugucucuacuaaaaauacaaaauuagccaggcaugguggcacgugccuguaauccuagcuacucgggaaggcugagacaggagaucacuugaacccaggaagcagagguugcggugagccgagaucacaucauugcacuccagccugggaaacaagagugagacucugucucaaaaaaaaaaaaaaaaaaaaaaggaaggaaagaagggaggguaaagaaaggaagagaaagaaagaaggaaggaaagagaaaagaaaagaaaaaaagaaaagaaaaaagaaaagaaaagaaaagaaaaaacuaaugaacaaaccaggcauucuacucaauccuuuaaagcacaaucucauauauucucaaauaagccaugaaaagcagucauugcugaacccacuuuauaauuugggaacucaaauuuaaagauguucagaaaccuccccagagucaagcuuaucugaggcagagagaaaauucaaauuaagguugguaggaccgcaaaucaccucuaaccaaguaugauuaaggaaaccuuaauaaugccaggaggauuacugcagaaagcuucagagaaaaacaguucacugcaaccacauuugccaguaccuucuaaaaguuguaaggccaugaucacacauaccauagaacuaggcaaaaagagaaaaaauagcaugacuuaaguguacaauuaugaaaaugaacuguuguuauuaugcauauuuuaauuaguaugggaagcccucauaaauuaugaucacuauuauuuauguggccaaauugauuacuggauuauuuuaaucuaccacuguguguuccauguccccucucaaagcucccucuccaugaggcuccucuccaugcaguuauuaucucuaugauaccccucucuaugauguuauucucuaugauuucccucuauggugcccucucuauaaggccccuuucaauaacuucaguucaaugauggcaucauacagagggaugucaauuugugaaaaacaaauugauuuuguuuuuccaucucuaguguuuauccccucagggaaaucauugauugaacaccauuuuauaaucguaaauaagacaguuuuguuuuuucaggacaugaagcacuuuuauugaauguguuauuuagauaaaaaagggaagagguagagugacuuucucugaaaaacauagauacgaaguaauugccaaauagagauaaauuaaucuccaaggaaaaugaccagauccaguggcuuuuuaacauuucaggaacccuauuuuuaugaguguacuuuggaagaaaggcuauacaaacagugaaaaauacccaaaguuucauaaguaccaaacacauaacucuccacauuaauugugauggcuuucuuuccacuucuucagccuuaguccaugcuguuucccaaggacucguaggaagcaucucuagcuauuagauauaauucauauucaaauuuacucagauguauucaaaagaaaucugagauaaaguaucuccccaugagucaucagcacaguaaggaagaauuaagagauuuucaacugauuccuuuacugggugaaaagaaaaucagaucuccauuuuucuuagcugauuuuuuuuucuugcuugcuuugguggucugaucacgcugucucauuuucugacuuucuagcugaaaaaauuucuuggauaggaauauuauugucuggguuauuacuuuaguaaaacacauauacugugauuauuacuuuaaauuugguaaauaccaucaaaaugcagaccucucauaaagacacagauaaugaaaauuucugcgcucuagacuaugaguaccuaugcuaagauauuugccuuaacuuacauaaagauaauuauuauuuaaccucuacagaaguuggguauguuauagacacugcuucaaacaggaaaacugcaucuaguagaaggaagaucacuuguugaagguuagucuaucuguggccuagcauauggguuucuacuaaccaacugugagaucuaaaccagagguuggcaaacuauggcccaugggccaaauccggccagucaccuauuuuuauagagcuucauuggcagccugccacauccauuuguuucugaauugccuauggcugcuuuugagcaguucccacagaaaccauauggccugcaaugccagaaagauuuaguagcuaguccuuuacgguguuugcugacuucugccuuuaugaauuaaucugacccucaguuuacucauuguaacugaggaauuggaaaagaauaaacuuuuuccaccaaguuugcacauuagaaucacuugggguaguuuuggggaaaccccaaugccugagcugcaccccagaagaucuugucccauugggcugggcuucugcccaagguaaucccugugcagccagguugagaaccacuggacuagauaugcgugauggcccuucgagcucagcgcuuucaugacaugaacuucuugugaaauaaguaguaccuuccagcaggaacaaaugcuuggaaauuaugacugaauaaauucagccucagcaaugaagacucacaucugauuuaugcuauuccaagucucugacuugaggaguuuagaauccacaguuuugcaaggauaaagacgcaaugcuauauaaauauaaaugguuccuuuggaagaccaacuuaaaauagacuaacagauuuaaugaguuaacuuuugaucuauggaaauaauucacuuuuaauaauaucacaauuaaaacuauuauacaucaaauauaagccauuugggcgaaagucucagcugccagccuguucucugcagacuccccacuuggaggaaagccucaggcucuccugucucugacacagacggcuacaccuggaagguaguccugaaaauaagcugcaaacacuaggaaaucuaggggauagcagauaauaucaaauacaccuaaaucauguuuugggaagggauuaaagaauauuucauaagccuuuggagguuuaaauacuguugaaacagccugaaggcuggcaugugcgggcccagacugcucagaguugggcugggggcaugggugagagaagcccgcugugcaaagaacucuggggcugcuuccaggcugccaggcugccaggcugccacucagggcaucugcagauggcgggaggggaguucugcaaugucucagcucucuacaucucaaaguagauuugguuuaggggucacacaaacaaguaaaugucuguaagaguaaaacugagcauuucucuuaugucauuaacaaagaugcuuugcuucgacucaggguaucuccgcuuuggcaccaaugacauuuggggcuggaugacuaucugucuggggggcuguucugugcauucaggauguuuagcagcauccguggccuugacccauugugcgccaguggcagccccuuccucucccaaguuucgaaaacuaagcaauuguauauugcuaaguuuacccuaugguccucaugauaccuuaccauccugucucaaaguggaauuaaacucuauucugaggcaauagggaagaaaauacacacacacaaaauauauacagucgucccgagguaccuguaggggauucguuccaggaccccuaugaauaccaaaauccacagaugcucaggucccuuauauaaaauggcauaguauuugcauauaaccuauguauauccucccauauacuuuaucucuagauuaauuauaauaccuaauacaauguaaaagcuuaguaaauaguuguuacauuguauuguuuagagauuuuuuaaaagucuauacauguucaguacaaacaaauguaaccauuuauuguuuuugaauauuuucaguccucgggugguagaauacacagaugugaaauccacagauacggagggccgauuguauauguacaugguauuauuuuauccuauccuuugugaaucacaaauauuugaucacugcugccugaauuaaaguuuuaaaaauucaaauggucucuuuauaagacuuucuugaaagaaaucauugagaagaaacuuguagauucagaaaggugugcagagaccugaaaggcauuauuuugcuugacuauguauuuaaaauuugaaagaauggcuggugggcuaggauuuuccuuuuuuuuuaaucugaugggcaacuucuaccuacacaauacagacuguaaucuaauuaaaucauuacagccuuuuucaacugguuucaacaacuauuuacuacugauaaaauaccuuguagcuuuucagaaugcucuuauuguugaaaaaugaguaaucagauauaaaagaacacaaaauacagccacugggcuugagaaauugaaacacuauuggggagggaagacuuaugcccaaaguagguuuauuuuuacauuuuuaacguuuuagagacagggucuuucucugucauucaggcuggaguguaguggugugaucacggcucacuguagccuccaacucugggcucaagcaauccuccugcuucagcuuccagaguaacugggaccauaggcgugugccaucaugccuggaauuuuuuuuuauuuuuauuuuuuuguagagacaagguuucacuauguugcccaggcugguguugaacuccugggcucaagcgauucuccugccucagccucccaaaguucugggauuacaaacguaagccacuguacaugguauuacuuuauccuauccuuugugaauccggcccaaagaauaugaaauaauacacaaacagcaugcaauuaugaaggagugguaaaaaaaaaaaaaauagggaaugucggagaucagauaauuuuauuaaaaguuaaauuagaguaguccuccaugagauuugaguugauccuuuaagaauaaucaagaguugguagaggaagagcuggaaggacugaggauucacuuacauaaacuguauuguuugacuuuguauaagaacauauacagucauuccucaauaucuacaggggauugguuucaagacccuccuacagauaccaaaaauccauggaugcucaacucucugauauaaaaugguauaauauuugcauauaaccuacccauauccugcaauacuuuaaaucaucucuagguuacuuauaauaauacaauaauuauuaauaauuaauaauacaauaaauagucguuauacuuuuuuauuuguguuuuuaucuuuuuuaauuguuuuuuuuucaaauauuuuugauuuacgauugguugaauccucagaugcagaacccacaaauauggagggccaacugcauuguccauauaacuacagaaaaggcuuaaaauuuagaauaacgggguaaagauagaggcauucaaggaauaacaauagugauggaaagaggaaccacuauccuuuguccagggcuuccuaggggacaagcauuauggaguuauuacugaauuauuaccucuguuuuacugaugaggaauugaggcuugaaaaguuaguuuuguuuuuuuucccuuaaguucgcacaauucuaaaauggcaacgccaggacacaaguugaaaucagacucuaaaccugucucagaucugcugaaucuuauaaaugguggcucaugauguaaucccaguacuuuuggaggccuaggcgggcagaucaccugaugucaggaguucgagaucagccuggccaaccuggcgaaaccccgucucuacuaaaaauacaaaaauuagccgggcgugguggcgcaugccuguaaucccagcuacucgggagccugaggcaggagaauugcuugaaugcaggagguggagguugcagugagccgagaucacgccacuggacuccagccugggcuaugcagcgagacucuaucuaaaaaaaaaaaaagaaauaaaaaaaauauauauauauauguauacacacacacauauauauacguaugaacccugaguggcuuugugcacaaccauguuugagauaucuuuguuuuagaaaccaauuuaaaucuacaauucugacugauuagcgauccuagaaagaggaauggauaacagaucaaaaaguuuuauuauugacuaacacauggugaucauuuuuauauguauccacgcuuuggcaugaauaacuaaauaugaauauuaacucguuuuggucucuuaagaaauuugaaauguugaacucauagaccaagacuauaaauuuacauuuuuagccaggguaaguaaauaaucacauuucaagugaugaaaugauuuuagggaucaucagagauucauucauuuauguuaacacuuagguacagagaaacuauugaguauuggauaauucaauauugcuguaaguaaauaaaaugauuccauauggauuuccauauuucaacuuuguauuuuuacuucuuuauuuauauuagaguggaaacuagcucauccucaaucauagucaccacuucaaagggaacuucuuugcucaguccagggagccugugugucaaaagugaaggcaaaaauacuugcucucuccauacucaaacucucucucuuucuuucucgcuaauuuuuuaagggugguauguuuggaccauaguuguuucugcuuuaaucauaggugacgauuagucaagggcaaaauggggucccugggucugagcuccaaaacguagucaucugacuacaguuaugcuuuugaauuuuccauggccucauguucugcauuguuaaagaugguuccuauuuacccagcugcucccacccacuaaaugcuaggcuagacacuuggaccuauauuaucucauuuaauccucccaagaucccuaaugagcagguauuaucauucccauauuuuugcaggagauacgugguuguuccaaggaucaaauaauacuugaaagugcuuugcaaacugucaaucuggagauuuacaaaugcuaguuauuauucuugguaauagcuagcucuugguguuugaucaacaaacacccuugaaccacaucucaaaacaacuuaaagcagcaucuugacagauuacuccaccuuccuguacuaccacucagcccugaccuacgaggcaguuuucuagagguauggaagcagcccuauggccuugccuaauauguuaucagaugaacguuuuauugauacauaauauuuguacauauuuaugggguacaugugauauuuuguuacaugcauagaaucuguaaugaucaagucaggguauuuagaaugaaagagcuacuggaaccaguuaacaagcuggacacuauaaauaagugaggcccuuguuugcugggacccucuagagcuuaaaucagcaauccagaggcaaaaauagcaucucccuccaagcuccuuaagugaagugcauacggcuuccccaugucuccuagaucuuucagacucacucacacaggccauacucagugugugagucuaaaagccugcccauuucacucuucuuggcuuugaaucugaccaugucaaccaagagugacugagcucuaaacagcugugucaagggucaaagaagggggaaauaaacacucuaccaggucaggauauucauccuaacaccuaaguugguaaaaauuccauaacagauaaagcaaacccaccagcuggcuugguuaacacaauagcacuuccgcaaguuugcucccauaauaucuuccuagggauggauccuuucagaguggaaaugacauaaacugcuugugagccuggauauuuaucugaccuauuagcccuguucaggaaggaaauggagaccucugaggaaagcacgugagaagggcuagcaguccagcccgcgaacaguagaccuuucauaagaaagcauccagccggcuuuuuucauggauuggagucuucauauuuugcccuuacuugcaauuccaaaugacugaacaguggaauuugcaauuccaaaugacugaaugucacuguucucuguaaauguugcuuuuuauugaaauguauuuuuacuucagcuuuuggaauuaggcaauuuccagauaucaacaccgaagucagugguuuuuuauuauuauucacauuaaaaauuaucucauugauugagcuccauggagcucuuuucauauccugucuauauauucuuauuacauguuauaaugagcucuagaccauggaagcaacgacuuaucuuuguuuuucauuucugcauucccagaauuuacucaguguuuaucucauaguagcuacauaaaauauucccugaguaaacaaauaagguuuuuucuuucuuuuuuuuuuaaaagcaggaucugauaaagcagauagggaaaagaauauuuauaaaggcacaaaaggaauagaagcugcucaugauuuccauauuguuucaguaauaagaaccuagucuaucccaauguaaauaaaaauaaaaaccauauuuuccggauuuucccccucaauaaauagcaaaagagauauaagggaggaggcagacgaugauaccgcuauucuaggcacccugcacaacuggcacagaagagagcacagagaacaaaacaccccagggccccuacaguggaggaguuggaagcugccuucuuguacagcuccuucacuucagcgcuuuccuccuccuccagccccagucgauaccgaaguuccuuccucuuccuauucuaagagagacagcugcuaacacacagcccagggccaacuugcuucaucauuuacucacauaccaaaggcaacccuacaaaaaaaaaaaaagaaagcuagcccccugagcucgucugacuagucuaggcuuacuguguaucaugucacccaucuuuuccucaucugucuagauguguauaaaugugacagccauaguauaaaccaaugccagcuuuucuuuucuuggaaacagcuguaggugcucugauggcaccuguggugcugauccaaucagauuaaccagaaacaugaaagagccgcuccccuccaccccugccacccgcauccccagacuucaaauugggccuuguuuuuaaagccauuucuuucaauucaccacucacugcuucuuaaaaguccauuucacuacuuagcuugguuuagaaaggacaaaucaaaguuuccacccaauuauaauucccuugagaguuguucaaaguuucccaugucagccagaaacacauaucaacccuauaaccacugaguaauuuaugauacugucaagaaauccaccauuggauuacaccaaugaagguuuuauuguaacaguaaaugcccagauaaaauaauaccucguguacauccaacacuuacuaugugccagucaccaugcucggcacuuuacaagcauuuuccuuuuugaugcgacaugcaaaauguguuuuccuuugucagcuuaaaguccauaccucauggguacgcaacaacguugugucauacccaaaaguccagaauauaaagugauuaaguuuuaaauggauuuuuacaauugcauuuguaucagauuuuuccagaauguuuaugccacauacugaaaauaaauuaaaucuuuagccacauucaguuucucagacuacucaugcccacuuuauggcaaugucaaaaaauuuaccagucuaagaauaaucuauauauuaagacauucaggaaaacaauaauccuaagaagggaauuagugagcccauuaaguugcaaccacaauuccuuuguuuccucauugacaucacuguccuaacucugcuuucuuuugcaguguccccgagguugucuggguccauguacaugaacacagcuccaggcaugaagucuggcccuucaagauggccaaaucuacacuggcucagcuauagaaaaugucagcaugggggcaucuucuaggcaacuuauuuugguggcccuggaggcaucauugcaaagccacaucucugcaauaauucccagacagcaugguaaggcaucauccuacacccaugaugcugguuuauugccaggccaagcaggcguuuaaaaauuaccguaaaaucauuguguuuacuccugaaaaccucagaagagaccucagaaauuucagaaccacucaaaaggcaauccugccugugcuggcuggcacuguuaaccgcuguaggaaguagcaggaaagacacaaaacuggacagcugggaacugugcucuaguccuaguucagagucacuaacccacuaggucauugcggaaaacuucuuuuacuacucucagcccuacuuuccucaucugcagaaugaggauggaaugacaugagcuccaagguugcuucuggcucuaaaacauuauuuugguuuauagugggcauucggagguuugaacagcauucuccuuauugugaaucaaaaagccagaagaaauaaccaugcauuguccccacugugucuuacugcacuagaaaagcaggaaaagaaucacauuugugucuguaccuaagagccaaucagcaacgacaucuccuauuucuuccuaguuuuaaggggcaggaccuugaaucucacaauuuuacauguuucuguugacaggguggugguuuuugaccugugauacuacuucuuucugccaauuaaaagagagaccacaaaaucuaaaguaaugugaaugucucuucccccuuuuauuucuuccaugaacacaguaacccuauccauucuuauauucucacaugaaauuuauuucagaaaauauacauuaaccucucucucuuaaaaaaaaaaaaaaaacacuucacuauuacucuauagaaaaugguaaaaauggccuaaacccuuaaccuugcauuuaaagacuuucaagaccuucccuccaggugacucuuccaacauccucuuuccuggcuccccauuuggcacccugugcucuaguuaggauugucuaaaauuccaaagcugucuugccuauuccuaccgacaggucucugcuggucucacuccugcagagcaccucacucuucuuugaugcauaauccacagaucugucaaagcagcuuaaaucccaccacccugaagcaagguuuauugucuacucaaaagcagauucaucucuuccuccuccgaaucccaaaacacucgucuaaugcaucaauucugcacauguccaucaacaaguguuuauuaauugucacgucucugcccuuuggcaggugcuuuagaaacaaaacuacaaaacacauuaaagcaacaauauauacucuuaucucacauacacauaauacaagacagugguuaaaaaauauuuggcagucagucuacauccaauguccauacacuuaaccauuacacauucugccuccuaguuucuaacagucguucugacauguguugcaggcuuucuguaggccaggcacaaugcuaaggcacaugaaacacuuuauuuugcucucccaauuuucugugaaaguaaguacuauacauuagcccuguuuuauagacgaguaaaauauagcacaagaacguuaacaaggugcccaagaauuacguuuacacagccacaugaugaagagguaccauguguacuuguuugugcauuuuucgaacucucugagcuuaccaagaaugauuccaacaauaauaaaucacuaggcaauaauacauugcucucugcaggugaaggaguugagagaggacucauccagaaaauagacaggugaggaggaggaaaaggaagcugccuugaguuucccauuaagaacauaugccuggagaugcuuucuuuuauuccaucuaucauaaauauccuuguaccaaacuaacaaaauuaaaauauaguuuuaauacauuuuacaaauauuuggaaaucuuauuuuaaucacauggaaacuauuaaaaaauauacauuucaacacauuguauacacguuuggaaauaucagacuauaucucauaaauaugugcaauuauuaaguguccaacuaaagauaaaaggaaaaaaauacauaucuauauugcagacuaaacaaaugcugccauaaaauuaguacaaacagaauugcauauuggagucaguuggaacuggugaaacuccauaaaauuacaacauuuuagaagacaugugucugaguuauucacauaccacauggugaaacaucauauagucugucuguauuuuagauuaaaaucaacugggaauuacugugaacaaguuugaaaaacuauauaggguuacacaaagaacaucauacgugguaaaaaguuaaaaaggaauaacugauaacagggauuuuacagacaucuaguaaauucaauauuguuuucuaauacaaggcuuggaaaugguaggugcagugaucccuuuucugggaagccuuucuccaucucucaggacuggggucaguaccuuugcuuugggcacaaugugcuuccugccaccaucaacagagaaaguauuuaguagcuguuggaaugcccuacuagacuauaagcuccaugaaggcagggacuguuacuguucauauuaccuuaauuaauuaaacacauauuaauuuuuuaugaccucucaaaaaaccuauauuaacuuucauuguggguuuuuuuuuuuuucuuuugagacagggucuugcucugucacccagguuggagcauagugguguaaucacugcucacugcagcccugaucucccaggcucaaugauccucucaccucagccuccagaguaacuggaaccacagguacaugccaccauacccaguugaauuuuuauuuuuauuuuuaguagagacagggucuugcuauguuguccaagcuggucucaaacgaccaagcucaagcaaugcuccuuuuuggccucccaaagugcugggauuacaggugugagcccccaugcccagccauaucguucuuaauaacauagguucaaaaggccuaaagcaagcaaaaugacagaacuaugaagaggacuugaaaauuucacucucggcaaaaaaaagcuagaagcauucccuuugaaaacuggcacaagacaaggaugcccucucucaccacuccuauucaacacaguauuggaaauucuggccagggcaaucaggcaagagaaagaaaugauggguauucgaauaggagagaggaagucaaauaguuucuauuugcauaugacaugacuguauauuuagaaaaccccaucaucucggccccaaagcuccuuaagcugauaagcaacuucagcaaagucucaggauacaaaaucaauguacaaaaaucaugagcauuccuauauaccaauaaucgacaagcagagagccaaaucaugagugaacucccauucacaauugcuacaaagagaauaaaauaccuaggaauacaacuuacaagggacgugaaggaccucuucaaggagaacuacaaacaacugcucaaggaaauaagagaggacacaaacaaauggaaaaaaaauccaugcucauggauagaagaaucaguaucgugaaaauggccauacugcccaaaguaauuuauagauucaaugcuauccccaucaagcuaccauugacuuucuucacagaauuagaaaagcuacuuuaaauuuaacguggaaccaaaaaagagcccauauagccaagacaauccuaagcaaaucgaacaaagcuggaggcaucacacuaccugacuucaaacuauacgaggcuacaguaaccaaaaacagcaggguacugguaccaaaacagauauauagaccaauggaacagaacagagaccuuggaaauaacaccacacaucuacaaccaucugaucuuugacaaaccugacaaaaacaagcaauggagaaaggauucccuauuuaauaaaugguguugggaaaacuggcuagccauaugcagaaaacagaaacugaaccccuucauuacaucuuauacaaaaauuaacucacgauggauuaaagacuuaaauguaaaaccccaaaccauaaaaacccuagaagaaaaccuaggcaauaccauucaggacauaggcaugggcaaggaucucaugacuaaaacaccaaaagcaauggcaacaaaagccaaaauugacaaaugggaucuaauuaaacuaaagagcuucugcacagcaaaagaaacuaccaucagagugaacagacaaccuacagaaugggagaaaaauuuuacaaucuacccaucugacaaagggcuaauauccagaaucuacaaagaacuuaaacaaauuuacaagaaaaaaucaaacaaccccaucaaaaagugggcaaaggauaugaacagacacuucucaaaagaagacauuuaugcagccaacaaacauaugaagaaaaaaagcucaucaucacuggucauuaggaaaaugcaaaucaaaaccacaaugagauaccaucucaagccaguuagaauggcgauuauuaaaaagucaggaaacaacagaugcuggcgaggcuguggagaaauaggaauguuuuuacacuguuggugguuguaaauuaguucaaccauuguggaagacaguguggcaauuccucaaaaaucuagaaccagaaauaccauuugauccagcaaucccauuaccggguagauacccaaaggauuauagagcauucugcuauaaagacacaugcacacauauguuuauugcaguacuauuuacaauagcaaagacuuggaaccaacccaaaugcccaccaaugauagacuggauaaagaaaauguggcacauauacaccauguaauacuaugcaggccugaaaaagaaugaauucauguccuuugcaaggacacggacgaagcuggaacccaucauucucagcaaaguaacacagaaacagaaaaccaaacaccgcaugaucucucucauaaguggaaguugaacaaugagaacacauggacacagggaggggaacaucacacacuggggccugucaggguuguggggcgagcgggggagagcauuaggacaaauaccuaaugcaugugggguguaaaaccuagaugauggguugauaggugcagcaaaccaucauggcacauguauacuuauguaauaaaucugcacaugugucccagaacuuaaaguaaaaaaaaaaaaaaaaaaaagaaaauuucacucucugaguggaaggccuaagugcaccucuccuagucauuaauugauuacacagacugaaaacauuaaugagcucauggaaauuuugaagauacaauaaacuuauucuaauauuucuuaaagcauacugcauccauaagugagaccauaugcaauugucuugagcccugaucuuaagggauuuaaacuagaaaccaauaaacagaaagacacauuuuaaaaaauacacauauuuguaacuucaaaaaaaaaccccuucaagauaagacucuucccacaaaaaauauaccaaguccaaaguugacuuguauccaucuaccaaacauucaaggaacagguaaaauauuuugagugaugggaauauaguuauuauugcuauguuuguugucaucucuugccugcagaaugaaauaucccuaaugaaaauacuggucacuugaauuugucuccaacuuagauucaggaagauuauaauauuaaauaaauaaauaaaugcauguauguauauguauaugcaaguaugugugugcaucacacaccauagcacuagaaccugcacuaugccugcuacugguuuucaaagaagaaacaaguuauagaaauuauaauaaaaagaagucuagcucaguauacacuuacaacuuuccuaguugcaaacugggaaagauuuuucaaacauagaaccuuacaaucuauaaauuaaacccaagaaugaaaucucaugucuucacuuccagauaaaaagugcuacauagaaaugcugagcuuuaauuugaacuuuuaaaucaaacuauuaaaaaauuacaaugggaugauccguugaaacaugcauuauacaaacaaacuuccucagccagccuuuagaauaagaauagcaaaacaauaguuuggaacuucagcuucagcuaauuugaaggggcuaugcugaaacugaaaggcaaggaaaggucaguuuuuuucaauuuguauauuuuuauagguauaauuagagaaaagaaacaagagcuccaaccuuguauguuggaacagaaaaagaggacuacugcauuuuaauuccuugaaaacucuggaaugcauuaauuauauuaaauucucuuauauguuaugugguucacaaaucaaauuuuuccuccaaguuugaaggacugagaggcuucuuaaaauucaauuaaaacgauguaaagaaauauccacauuauggauacgcuccacuuagagaccuuugcacuuggcaggaaaacuuuucucuuuuuaucuuaguagaguucaggaaaugcuaccuuaauuuucucuuugcuucaauauuucaugagugccucucaaugcauagucuccgaaagcguuagauuacugacaugaugcuauuuuacaugauguggaugauuuuauuuguacgaguucaacauguuagaauuuuuaucucuuuuucuuuuacacuuagaaaaagauuguaauguacaaaaugauauucugauuuuuuguauaaacaaacaucucuuauacugagaucuaaugaguaaaauaugucccccaaaguuuaguauuauugcaagaaauuauucuucauaauaauugcagaauucccuucuucagguaauaaacuuuuacuaacagaaggacaaaaauguuuccaaagacaccaggguccuuacauaugcaaauuaauaaagcaaaucuauugucuuaucaaugaaagcauccucaaauuccuccaugcuuuaucuguguucucacaucaucacaaauccacaucuauaugagauccuagagcuacagaaaaaugcauguucagagcacauuucagaccaaaguaguaauuaacagaaauauacuuccuugguuuugguccucuugguaugcuauuacuuccuucaaaaaaaucaacauuuauauugugcuuagguuuuaaauaaaacaaggauguacauauguucauaaguaugcgauaacugaaauaucagacauccaaaugucauaauuauuauuuuuaaaauucuaacguaaguggcauguuuuaaaacaaacaugcuaugucgauaaguuauuuguucaaaugcucauaaguacaucuuauugaacggcuguaaauguguuucggugcauuggaugcuguuuauaugcuuauauuucuguaacuaggaaauaaaaagaaaccacaucauuaauugucaggcccuccaugugacaguagaacaaccgauaggccacuggcucaauuaaagugugcagggcucguaacugaagaguuuuguuuuuaucacaaagagggcuagagcaugacaggaauucuucauaaauuuggagauguuauguaaauauuuaauaacucugcugugacaggccaugaguacuugagcagaaccugaccacaagauuuaaauaaauaucaagccugggaguuguuaaauauugaacaucauuaugauugugguguuuuaacaaacaaucauuaaaagguagugcaaauccaaucaaaggaacauuuuuaauaaagaaacaaagaucuggcauguuuacauuuuggaaaacaaaaaucaaacaucucuguucaguuauccuaaauauucucccuucagcuccaccaccaaccaaaaaagggguaaaaaaaaaaaaaaaaaaaaagauuaccuugguuuguaaaaauuaauagccuucgcaauuucuucagaauuugcucuagaggcacagcucauacaugcauugccuuugcuaugauuaacuuuggugguacuuuucuccugugcugccaugcacuguucuggaaagccugucagcggcugucuucuguugucugugucaccugaguccuugugcuugacuuccucuacaugguuuaaagauggauuugcaccaguaauucuuuggauacuugaagugaaacaugcugcccaggugaugcuuuuguugcccaagugacauugagaagcaggaauugacuucagcaugucggcuucccucaacaugucaagaaauagcaaagccaaaucccagaugugguccguuaaucccacugucacagaauaaacuauguggucccaguaaacacaaccacccauuagcgcuaaggagaggugauagaaaccauuuguuaaaggugacacuguuuucuaagugauaacacucuuuugaucaugugauucauuuuguuugcucaacaacaugguauguguuuuuccugagaggaaggacuucaauauauauuuacuuagagcuuuuaauuuauacuuccuuucuuuuaauuggugucuugugaucuaaaauuagcugaugaacauaguaucucacucaaacucucucagcugaguuuucaauaauuagacccacuguugccugaaauugaacaaacauguggagacuuggcuuauuauuucuucccuagugcuuucuauccauacuuagagagugauuuuuuuuuuuuuuuuuuuugagagagagucucgcucuuucacccaggcuggagcgcaguggcgcgaucuugggucacugcaacauccaccccccagggucaagugauucuccugccucagccucccgaguagcugggauuacaggcacccaccaccacacccggcuaauuuuuuuauuuuuaguagagaugggguuccaccauguuggccaggaugguuuugaacugcugaccucaagugauucacucuccucggccucccaaagugcugggauuacaggcaugagccaccacgcccugccuagaaagugauccuuuuauuucacauauagucauauuaaucauuaucccccaagcuggaguuagguuaauaauuucauguaaaaaaugaaguucaaauagucuugacuguaaccuuacugaauaaagagccuacacgaaaaggaauucuuucgugaaaccugagauugucagagcacugaauuucaccaauaagcuggauaucguuuauacaaggaauaaaaggucacguguccucuaaaaucccacauuugcuacagacauucuucccucuauucuuuuguuugugcaguaacuagauacagguacaaugagagugaauuaguuuucccagaugagugagaaaaguaaguguuccccaaaugcccaaagccagauuuuaucugucauucucucucucucucccucucucucccucucucucccucucucucucucucucucucucucucucccucucucucagagagaggcagcacucucuuuggaagaacuguaaggauugaaaaugauccagaaaaacugcauggauugaaaaugauccagauuuuuagaauuugcccucaccuugacaacgcuaaaauuacaagcagcagucaacuuuuacaagauacccuuauuguguaacauuuauagguugccaaaaacaugcuaaaacuaaucagauaacaaaggugaggagaaaaccuucaccugccauguagcuagcagugaauacacuuuuuauuuccaugacauuuucuggcagaaagggguuggcuuaaggcggaucggacuaaccuucaauuugucauagcgcucacucaaagcugccaccugaugaucgcggugccgcccaaccaguuuacacaaggcacagauuaacuggucaucggucacacaguacauauucaccuucucauccucaugcuccaagcacaucagcccccggaugugagaguccggaauuggcucaaucagacgauggccuguaaagggcuucuuauucgggugaguggcuuucaggcacucgucacaguaggauacuucacaagugacacaggucuucacagcguccugggcaggauccuggucacaaaacuggcagaggaccuucucggcggaggucaugguguuggcgucaaaggcccgcucccgacgggucucgcugggagaguugggcccgcucacugaugcuuucuggaaccugucgaugauguucuguagggugacguugcgcuugagcccgucuagaccucgcuggcugagggugaugacaugccggcagguggggcacuggaaggcggugauggacuccacagacucguugguggcacagugugauacuaggaugcggugggcgcaguugaagcagaggcugugugcgcagggcaguagaagaggguccucaaagagcuccagacaaauagggcaggucaguucugacuccaguguuuccaucuucaggcaaagcucucuugugucaucagcaaaacccaaggaagcugaucagcuaucuggaaacaagaauguaagauuugauuaggcacagggaggucaaccauaggggggugucagcuuugaaugcaucucagaauaauuccaaacacaggucaugaaaggguaaguguguguacauuccaaauaauucucuuucuauucacuggggaaaaaaggaggaaaaagcauccugagccaucauauaccaguuaacauuuucucaaaguucaguaacugaaaaugugcaauuuuuuuuuucaauuuuguuuuuuaaaaggcuucauucaaaacuagaauguaauugaaacuguaauuuccauaauuuguauuuaaucagaauaaucuuauugugucagagucagguuuaaccucgcacagaaaauuaaaauguagaaauauucaucaauaaacuagagucuuuuauaaauuugaauuuauaaacuuacguauuaauguauacgagauuuaaggacuuuuacucugcaauaccaaaccagguuucagaacaauaggaaggcaguaacuauagaaaugggcaugaaauguacaugaaaucaaauguggggauuucagcagagaugaucguguuuaagugugggaugucauuuuccaaaauauauuccugagaaaaaacauugacuuucacaaagaugauugugauagaggcaauauuuuuggcauguguucauuauguuucugaauaauucuauuguuuaauccagcagugggacguggguaggcagaacgaaguggagaaaaauaucugggggcuuuuucaguggcugcaguaaguuugaguaccaaugacuaauauuuagagcaaugauuuaguuaauuagaacaaggauuucaguggucaucauauucaugugauaaguuauguuaugacaaugauaaugauuacaguugagaaagcaauuuaaggaggcuuacaaaacugcugagggacccuuuuggccaaaaaacucccaccacgggcuugucacuguugccagcaacaggccaggcuggcaggagguccagccucacacucagagcuauguuggccuggguacgaccucugcuagcuauguugcucuccuccaggccacccgaggguggcccagcugccugcuccccuugccauaaagaccugagugcuuuugugaacucucaucugccuucccaucaaaaagaguaguagaaagaauuccacacaaaccccaguucauuaagggugaagaggccucaugcucauuagcaggccugggaaccaagccgcuuugaaccuucucccuuucaagaccauuagcagaggucugcagaccagugaugggaauauuacaugcagcccauugcaggcugugggagaacagugcaguucacccaguggucgggagguucaaaucacccacgggggugguggggagagcguucucagccggauuuaugggaaggcuucacauccaaagcuauguuuagugauucugacaaucaaucguuuguauucacaccuccgcuuauuuacaaaauucacgguuucuagaauacccugaccccuucugaaauagcaucccucagaaauaccaauauggugcuuuggugaaauuaaugcucaucuugcuaccaacugaaugguaacugaucauuaaaaguauaaaguaugucccgagccuguuaaaaauuaaacagcuacuggcuucauaaaagccugguaucuuaaaaaaucuucaaccauucacuagcauuuauuauauaggaaagaauaaaagagcaacugugacuugaaauauuaaagcuuguacaucuuucuacaaccugcaauggaaacccuaggguugcuguuguaagaaacauaucauccccacuuggucugucaccucuuccuacagauggcucagaagaaauggaaagguuuuuaccuauuaauaauuauuuugguuaaucauagaaaaaauguagaauuaucuuuaaaucaaaguucuuuuaccuucucaucagaagcauauaaauuaaaggaaaaauguagcccuuuuggucugcucuguucucagauaaaacaagaaugccuaccaaugaaucugaauagaaggaugagcaucaaauuaugucuggagagcuaugaugacuauauuuuuaaugcaggugccaggauuccaucccagagaggugugaugagaauuucuagaaaggauuccacuggggagaccucaguggaaauacugacauuuuauucauuccuucaacagauguuuacugugugccaggcacugaguuagaugaagaagccagaaucugggguucacaucaccucaucucuauuaucaugggccaagccagcaucaucucuuauguggacuaucauaagaccuuucuaaauggucucuuggcuucuguucacuccugcccuucccccuauagucuauccuccacucagaagcaagagagccuguuguuaaaacaugacagaacaugcaucuccuuuugcucugcccuguaagggcuucccauuucacccagagagaaauucaccagaauaaaccagccccagaaaacacagacucagacagugagcucacuuccucccacgcuacccacuccuuucucugcucugagcacauggccucguucugacuccucaaacaugccaagcacaucaauccccugcucgccccugcaaggucuucagaauccacaugacucucugcuccagugucacuuucucucugaacccacauaaaaccaauuccccuucuaccacuauaccaccuacccaucgugguaauucuucccccaucucgguuuauuuuucuuuauaauauuuaucacugacauauucuuuuaguuuguuuauugcuccuucuguccccacuguccucaacacuagaauauaagcucugugaaagcagagauuuugcuuugcucuuugaagaacguaccaccaacaccuagaacagcacucagcacacaaaaugacucaaacauucauugauuccauuaaauguacugacuuuucagcuaaaaccaaaaagaaucaaacacagcccuugacuuuaaggaucucucaauauauuugaacagaggucaacaaacuuuuucuauaaaggguaaaauaguagacauuuuuggcuuugugggccaaaggggcccuguugcaacuacucaaucuaccacuguagugcaaaagcaaucagacacaauacauaaaggaaugaguauggcuguguuccaacauaaccauauuuagaaaaacaggucacaggccagcauuggccugcacaucuuauuuuguugagccauguauuggaagauagaggcauauacagauaaccagaacauaaaugaaaaucauucucagagagguaugaauaaaaugcugugugggcaacagcagcaaggauggcggagcaagacuugaacaagcacuuacaaguuuccagugcuaaugggaaaugauaugcaaugggcuuugaaucugacaucaauggaaauuaugugacucgagugcuuaggggcaacucauguaagaacgaauuaauaguagcugcucaaaacuagauauuuucuuuuacugccauagcaccuggcauagugcuuuaugcaagugucuguacuguaaaugguuaauuguauuaggugaagacacaauacucagaugugguaggugaauuucagccaauuuucuaaaucuuuugccuguaugcuaccaaaaaggaagggguuuugguuugauaucuauagugcaucccacuuuuuccacuuuuacccagauuuuacaauggcauagauagcauuuuuguuaaaugacucuacaguaucuuauuuguacucauuccauuccuucuucuaaaagaaacuuaguaugguuuauuuucuagcuuucuuuaaaauaucuuuuuggagaaauuaaaaugccauucauuccuuuuuuuuuuuuuuuugccauucauucuuucaccaaauacuuaaguucaucuauguacuugguccugagacaaguacugguaacagcuggccccugucuccaugaucuuaugguucauuccgagagagaaaauaugaacaaggccaggugugguggcucaugccuguaaucccagcacuuugggaggcugaagugggauaaucacuugaucccaggaguuugagaccagccugggcaacauagugagacccuaucucuaccaaaaaauaaaaauaaaaaaauuagccaggagugguggcacaugccuguggucccagauacuugggaggcugaggcugcaaugaaccgugaucaugccaaugcacuacagccugggcaacagagugagcccauaucgagaaaaaaaaaugaacaagguguaaugcaacauaaaaaaagaugcaugccaaagacagacagggaauaaucaacucuauauagggggagaggagacagggagaagcuuccugaaggagguaaaguaugaaguggguuuuaaaagaugaacagggauucaccaagcagauagugguacaugggugggaauuuuaugcaaaauguuaucuuucuuuucacucucucucucucucucucucucuuucucucucccuuucucucucucuuucucucucucucucuauauauauauguaucuaauacacacacacacacacacacacacacacacacauauauauauagcuuacauuguuauuuauaucauuaauaacaguaucaggccgggcaugguggcucacaccuguaaucccagcacuuugggaggccaaggugggugaaucgcuugaggucaggaguucgagaccagccuggcuaacguggugaaaccccgucucuacuaaaaauacaaaaaauuagcugggugugguggcgugcgccugugauuccaucuacucgggaggcugaggcaggagaaucacuugaacccaggaggcagagguugcagugagcugaaaucaugccacugcacuccagccugggcaacagagcaagacucugucucaaaacaaacaaacaacaacaacaaaaaccccaauaucauaaaacagcagcuuuugccuuuucuuaacugucauaauguaauuuccaugccucaaaaaaaaaaaaaaacuucuucauuucuacuucaauaaaaggaaaucacacaugcauauuguugucaggaaauccuauagcuuaacauuuuugugaaugggcagauugguccucauugagaagaggaucuagauaaucuugagagucccuugcaacaaacugggaauggcaacaaaucacagcucacaccucugccuguccaugguuuaaacaucuagaacacagcacagaauaaugaaugaaaggggagagagcuggacaggugacgggauaaucuaagacauccugcaguucugcuacuuauuagcugucugaguauccaugggugaguguccacagauguucccuacagucccucuagcacucacucuaaucacuccccuaggcaggagagucuucagugacagauuacagugaagccccacaucgugggaggcauuggauacaucuuuugaaaaaacuuucuuauagauucaagacuuaugaggaaaguacuucuuuaaaauggaaaauuaauaaguagauguuuugcuggaaaauaaugauguaaauguuuucacaccucccucuucuuccuuuccuuuccucucucauaauauguaucuuaguccauuuuguguugcuauaacagaauaccugaggcugggcgauuuauaaacaaaagagguuuauuuagcucguggcuccacaggcugggaaguacaagaagcaugguacuggcaucugcucaagagaaggaacuuugcuuuauaacaacuccauucucaugggaacuaauccacuccugugagaaccaaucuagucuccaugagagcaagaacugacuaccucaagaagggcaucaagcgauuugugaaggauccauccccaugacccagacaucucccacuaggccccuccucccaaugccaccacauuggggauuacauuucaacaugaguuuugguggggacaaacaaaccacaucacuguaugucacugaaacuguacuuuccuaguuuuccucugucuaaccacugcugacuucuaccucuugcuaaucaaagccuaaguguuuucugauggucuaugguuccuuugacagggccauccaguuuuuuguuuguuucauguacugccucucugagaaugacugcuaggcuuguaucccaagauggucgagaaccccuuucuggaacccgguuuagcacugacaguucuuugcuucauguacugcaagugccucagacuuggaaugcacaugaugugggauuuauccucuucccucauuagccugucuuugucuucucuacagggcuccuggugucuccucacagggcuucuguccuccuggucaccagacagcagacaccacaguuucuacuccucccucuuugggggaggcacaauuaugguccccaaagauauccacagccuccuccucagagcuugugaauauuuuagguuauagagcaaaggggacugacuguugcugauauaauuaagauugcuaaguagcugaccuugagauggggagagcagcauggaucaucuagguggacccaaaggaaucacaaggcucuuuaaacguggaaguggcaggaagaagagucagagucagaaugaugagauaugacaaagacucgaccagccaugccuggccuugaagauggaggaaggggccacaagccaaggaaugcaggcuagaagcuggaaaaggcaaggaaaugaauucuccccaagggcccccaaaaggaauacagcccuaaagauaccuuacucuuagcccagugagaccugugucagacuuuugacucuagaaauguaagauaaugaauuugcauuguuuaacaccaucagguuugugcuaacuuguuacagcauccauuagaauaaggagaucgcccaucaucagcacaucauccauaauuuuuaucccaaauuucccuuaauggaggcauugaccuuuuuaaugauaagguaaacccaccucucaaugcuuuccuacaaguauucuagguuaugucugcauacuccaugaaauacaauuauuuuucuaauuuggaguauaugaaaaagaacaugcaauucuaucaauucuaucaauaauuuuacuuccagccccucacuuuguacaacucuaaagccuucacuaccagggaaauuagugagucauuagaccaaggaauaaacuuguaugccaacacuggguggccugugauuaaucguuaauaccacguggcugucagccacugcccagaugauucccaaggcacuuccucuaguucuuuuccaaauauccucuggacuauagagacuaacuuuauuguuaaauuuaccaaaacauaacugagaugacaaacacacuguuaaaauugcacgauguuacagcaagccacacgaaaaugguuucagaacaggaagcuccuauaaguauuucaaacaacaaauagcauugaaaauguacaaaugaauuauuugagaguccuaaauuucagaaacgaaaucaagucaauuuacuugauuguccgcuccucuuaaccccuauucaccuggguaauuagauuuaguugacuauugcuguuuggauuuuugcuaugagauuaucuuuauuauagaacuauaggugaaauauuuuuuaaagacugcagagugauguuucuaucuuggaccagcagaaauacagacuuucagaggacucaaaacuacugaagugugaaacacuggaaaucaaccugaguuugggaggcagauugcaacggggacccaacucagaagggacuugcucucaucuuaaauaagcauaauuucucaacucaaaaacuugucuaacacaaacucaauaaaaacuggcugcuacauccaagaugaauucaucauaggguauuuugaauaacauaauacaagcacucagcaucugcauauucaauuaugccauuuaguauuugacuuugagugauaaagaccaccgaauaaagacacuacccaaauguuacuuuacugauuagcacucuggccaauuugagaagcagguggguuagcaaaggcacaguaaaacagggccaugaacugauggaaaaaggggagaaggggauccaguuggauuuaacugcauucugaaagacuggaaauugauagcauaauguaggcuguuucaguacaaacgcaaagugguucuuaaaaacaacaguauaaauaauacaucaaguaagaacaggugaaaaaaggugauccaguaacauuuuauagguaaagaauguuacucugaauuaucacugcauuuagccuccaaaugucagcacacucaaauucauuugcucaaccaguaacagacaacuaagaauuucugccaagaaaauuguaggggaccagagggacuguuugaaaaaaaaaagugacaagcagaugagcacugagaugcuagccucaaguuuuaaaauaauuaauacaauagauauuuugaauaacuugacauuucuucuuuaagaagugcugaaauuauuauuauuauuauuauuuuuuuaccucauaucugaagugagaaccagggaagacuuuuaauuucgccaaacacccaccugguggaauucaugcaaaucaaauuaaacuguuaaccaaaucuuuucuguacuuucacaucugccuauaacaugcucauucuuaguaacuggaucucuaggacauucuuuaaaauaaucacauacucgccugaccaugcaaccugauuaauaaugaaugaacauuccugagaagaaucacuucgaagcauggcagaugucuguggggauaugaaggcuuuaaugaucaaaauuaaggggaaauggaagcugggucacacugucugguuauuuuaauugaaaccuagucuuccaaauuuacuuaacagaauacuuaaacacuccuucucgagguucauuuauacaagcagacaagcacaaagacaaauggcaaugcaaaagaacaacccagauuccuggaggaacaaccacccuauccuguucuguccuaauagugcagaaaaccccucagcaguuucagaaauccaauuuguucaauugaaagacugauaaacagguuaaaaacaggaacuaguacauugguccuuaauaguucuuugagcaccucucuagauucugacaaagagaucaccuugaauacccaccaauggacugcacacuaguucuuuuugaagaaacaucgccguaggcagaggauggggacccacgaaaugauagacaggccaccgagaccagacgguggguggcaggcagugcuggagcgguccugugugucugugagugcgucaacagugaaacacaacaggaaaaucgguccaacaauuccaggaaggccagcuccaccucauccacuccgccaggguugcccgaguugaagaaucaacugccuuuuccacggcccccgccacaacuucccuauccucuggccuacucaauguucaacugaacccaaauggaaagguagcucaggucagcucaacacccacugccugguccaaaaaaaugaggacuuggcaacgggaucuguacucucauuccuuacagggaccagcagcagcuuggccgaaugagacacuguccuguggcagaaggcugaaugcuagcuuucaaugccaccaauaggagccguccugcccagcuccuggggcugggaacaggcacuagacucauuugccuuuggggccuuucagugucguacugagcacaugaucacauuaugcucugcaugcuggcuuguucauuuaaaaaaauaauauacacauuauuuugugccuuuaucuucugaauuaauguauaaugucuggaagaaguuuucuucaaaguuauaucaggaagaacaaucuccaguacagacacaaagaacagucauuuauuucuuccaaaaauagugaccuaaauagcaaucuaucauccugauaaacaauuuaaaauauauguauauacacacagguuucacauacacacguaugcauacauuauguacacacauauauaaaaacaucguguguguauauauauauauauauuuaauauuacauacacgguauauauauaauagcaaaucugugauggguguccaaaauuucagucuccagaauggcaaagaaagggugaacugagaauggaaagaaguaaucuuuuaaaauuugauugacuaaaggaggaaggggaaguagucuuccuaaaagaaaaaaaaaaaaaaaaaguccugcgcugcaguucuuugaaggauauugcuuaucaccaugcaagacaagaaacugcaaguaaaguaaaucaucaggaaaguguuuaaaaaaagaaucuugcacaauucaauucauaauccagacauuuggacuccaccaaagguguuuaaggaacauucaugauaaaggggaagcagaggcaagaacugcuuccucgggcugcccagucugcacgucucaacaucuacuuuauugccauugcaacacuucacaguaaaucaaagcaugcuucacauguuaggacauaaaaaugcaaacauagauuuuuuggcuuaugucucuccaaauuauaacuucauuugucuuuuaacaaugaauaaaaggauuacucaauuucacauauagaugacuuccuuaagaaguucucauuguccucggaagagacacacauagaucaucaaguagaauucuaaagaacuuuucaucaagacauggcuuuuguuaaaacaacauuuaaauugucaaaauucuacaggccuaacuuuucccuauuuuggcacuguaguggaaaauuagccugaacaucugaaguugaaacaucaggaaagaaauauuuacuccaccccucaagagaaaaugauaaacaacaaaaaaaauuacaaucuucuaaagggcauaaucugacaacuugcagaugaaauuucccacuaucugaaugucucagacauuucaugucuuuuacaguuuaagaaauaaagcauuuaguuuuaaaggcacacagaaccuauuuuacauuauauugaaaaugaccgauguuuuccaggucuaugcuguacuggguaucaugcaagaauuugguucugaaggcaaugauagcagacuggacagagaggaagagggugagagauggccacaccuagucuccuggcagaagucuaaaucaacccuccuggugaacagaccaacagcgugaugguagcagaaauggaagucacuaauuucugugaaaccagucacagaugaaaagcuuuuaacacugcugucccugaaugcuuucucaaauguauuuauaguuugauagguauuucuauauauauucauauaacuaugucuguauaaaguccuauauauguccauaauggaauuaguuuuuguaguuauauacaaugugcauguauacauaaguacacauauacauauacaaaagcaccuuuucagaauuauuugagacuggcuagaauucacucuucacaaaccccucagucauagcaucccuucugcauuacagaaacauuccuuccuuagugcagaaacagaaaccuguagauaauguuuauuuaaaaacaacugccugcucauaucugcaaaaggucaccuggaaaugagcaaaaugacgcaagugaucuauucucugaaagaccagucaagugggauuuuugcagcaaguauaauagauugugcccuggagaaaagcuugccgcuuggggaaacuuuuucucacuuuauuuauauaauacucuccuagaaggcagagaaaguacacacccuccccuucccaauuauuaccaaccaggagcaaaauaguuauugaugauggccaaugcaacauuucacaacuguucucugaacacuggaaagcuuaaguucaaagacaagaacaaauacuagucucgugacucauggagguaaugacgauguuauagaguaacugauucccauugugugagcagauuggaaauucucucaaauaugaugccuccuuuucucaaagaaaaucgcuuuuucccucaacuucaaagucagccacacacaaaaaccuuuugcucacaauacccugaagcuaccuccugaucuuaaaaaguaaggaaaacgaacccuuauucacaacuccugguuaacuauuacgaauaacaugcuuuaaacauuuccccugaucacugaagcucugcagucaggggaagaagucuuuuuuuuuuuuuuuuaaaggcaacagaaagaggagugacucuuuuguucugaauguuauuguaaagcaccacaugaaagaagaggaaugaugggaacauggcaaugaaaaggacaacagcgcugacaaaugaaaacaggauauuaagaacagcgucgggacugugugucuguacagaacaaagccgggagccuucucggagaaauucaagcaaaaauacucuuaacagauuuacaugcuaauggaugaacuguaguuucuccagguggcacagaucuuuaagucugggacaauaaaauuagguuaucauuaaaacacauacacacacacacacacacacacacuguaaagugucauaaaauuaaaacugccuucaaaucacauucaaucacaugcccccccccgccccgcccuuucaaccagugaucugcuucuggaaauuucuagaucuauguuuuucucuuuguaaaauaagauacugguucugucaaauaacugagcuaacuuaguauauagucccaaggaaagugaauuuuuuacaaaaagaaaaacaauuuucucuccauucacagcacacucuaacuuacacuuuaaauauaacuuuucaauagagcuuucaagaacucccagggaaacuaggcaauggguacugugcugagaaacaaugacagcaacuaaguggcuaacauuaauauaguauaccgcuuuugccaagucauggugguaauaucuuauacuuuucuucugaugcaaauucugcaaaagcugcuaguaugaugguacauuuaauaaaacaucaucauagcuuauuggacuuaucacauaagaauuauuauuguagucucuaaagaaguucaaaaaaguaaaaaaauaugucugauuuugcgcuccauuaaaaauuucagucuuuuuuuuucucuuuucuauguuuugccacuauucuccuuuuccccacuuccugaucaguccuuucuauugucagaugagugaugagcugaugugcuuucuucuuuaccaaagcauuucauccagcuuucccucuggcaugcuuucagaaaacuuugggcuaagcccugagcucagugugcccaaguguucuuggucuaguuuugggcugacacugucaaugugguguccuguaaaaaaaaaaaaaaaaaaaaaaaaacauguagaggucaggcgcaguggcucacgccuguaaucccagcacugugggaggccgaggcaggcggaucaccugaggucaggaguucgagaccagccuggccaauguagugaaaccucaucucuacuaaaaauagaaaaauuagcuggucaugguggcgggugccuguaaucccagcuacucgggaggcugaggcaagagaaucacuugaaccugggaggcggagguugcagugaaccgagauugcgccacugcacuccagccugggugauagaguaaaaaaacucagucauauaaaacaaaacaaaaacaaaaaacaaacaaacaaacaaacaaaaaacauguaguaccuugaagccagauaaccugaguucaaauccuggcucugccauuuccuugcaaaggcagaucggagccagauacuguacauaucuuauacucacagaugcucuuccuaucuucuaugcaguuuccuuaucugagagcaaucuuaaggguccuuugaggauuagugaggugaacuuuuuaaaaugccugacaaaauucucacucuuauggaaggacagggugguaggggaugggggauugggguccuucuucccuucuuguccugaaucgccucuucccacucuucuuugaauaaauucauuaucuguguuuuuuacuggaaaccucuucauaccauuuuugcaagcaagaaggauauaaauccauuuauucaauaacauuuauggagcaucuuaugugaacaaacaguaugugaaugugaaaugaacuagcauuuuuauucuuaacacuaaugacuuaucuucacauuggcaauuucaucuguuuccuacacuaugacauaccucuguucauuaccacugaucucccaccaugaacuuggggcuucacuuccgcuucccagugaaggucacccugucccauaugcacucuuugucagaauuuuuuuauuuugcaggaaauaagggacccuggcauggauggagcaugugaaacuaucaagaacagugaaauguuucagauuuuugcuauuugccaguuucguuucaugaaugcuggcagaagacaccugaaucaaagauaaaggcuguuuuuacucaaaugguauguguuucauguucuguugguuccccuuguucucgaaguccuacggagcauccuagguccauguuugcacacucaggagauuugcaucauaccuaagcaacuccaagcuuaggaaaucugaaucuuuuauaauggacugcaaguuagccugcccaacuuuugcccuggaggaagacauugucuuuaauauaaugaacaacaaacaaaccugccuucuccccuggcgcgagauacuaccucuaucucccaagacuguuugcuauacaaacauccuggggaauagucuggaauaaaaucauucagugcuccagcucacaagagguacaaaaaggugauagauccauggaaaauuauuuccuaauagacacaauucuuaucuccuccuggggauauggccaauaguuguuacuagaaaucagaucaucacuggacuuucuagcaguuaccacagaggcagaauuucauuuggcacugaaugacccuugagucauagaagacuagagguaaaaggagccugcaagaaagugauaagaacuuccuuaccaacggcuccaagcuccuuauccaaccacccucugacaucagcuguuguacaaggaaaauuggcagaaagcagguaagccucacccauagauuuugcucaaauaaacagagcccuuaauguccuucauagucccaaaacagcuugggucuggucugcaacuucagcucuucacucugaaccuaagcuaauuuuaagaguuuggugcuuguuucagcagcacauagacuaaaacuggaaugauacaaagaagauuagcauggccccaaugcaaggaugacaaauucaugaagcauucuauaauuuuuuauuauuaaaaaauauuaauaaaauaagaguuuggaagaguaagcuaauuuuguuacuuuuaugacacuggaaauccuauauguauauccauuuggcuuucuuuaagcauuaaaaaaaauuagaacuacuucuuuuggaguaaaaccagaugagucauuucuuucauuacucuuucauuccacugguauuuuuugaggucauucugugugccaggagcugcucuaggcagcagcaaauuggugguaaauaugagcauaaaggccugcccuuggagagcuuacauuuuaaugaaggaaauaaaaaaauaaaagguuuuuaaaaacacaaacauuucaaagacucauacauaaaaugaaagaaauaaaaaggaugacaugauagaagguagauggguggugcaaaucuauguuagcuaaggggauauuacuacucauauuugugcuggcuuucuugauauuuuggcuuuuucccugccaauaaacaagcaaagaguaucugaauuucaguauaaaacuuucugguguuuggucagaggguugugaucuaauuuuucaaguuguuaaaugcuuaguuucagauugccucaaggauagaguucuuuuucaagggcauagaaauccaacuuuuacuauuucuuacaaaaaaauggaaugugaugaauuauuguaaaguagugacaucuuuauuuauuuuagcaauaaaauuuugaaagagaaaagccacgaacacuuagugagccaaaaaagcaggaaccaugauguuuuaguccauuuugugcugcuauaacagaauucuugagacuaaguaauuuauaaagaacagcgauuuaggccagguacgguggcucacgccuguaaacccagaacuuugggaggcugaggcggguggaucacgacauuaggaguucaagaccagccuggccaagauggugaaaccccgucucuacuaaaaauacaaaaauuagcugggcacgguggcagacgccuguaaucccagcuacucgggaggcugaggcaggagaauugcuugaacccgggcggcagagguugcggugagcagagaucacaccacugcacuccagccugggcgacagacugagacuccaucuaaaaaaaaaaaaaagaagaacagagagcagguuaggggccugguaucucuguuuccaaaauggcaccuugaagccuguguccucuggaagggaggaaugcuauguccucacauggcaaaagagcaggagaggaagaacccacuuccacaaacccuuuuaauagcggcauuaauccauucguaagggcuuuaccauuaagccccacaucccaguacugcugcauuggggauuaaguuuccaacaaacgaauuuugggagacacauucaaaccauagcauaugguauucagaauuaccugaauaucuuaaguguuugauucuacgauguuaacucaaaguugaaaauaaccauggauguacaguuaagcuuauagggauggacaggaaggaaaugaauagagacauuggaagaggcauugguuuugucaguacuuacucaccagcuuuugcaccacuggaagaggaaauuucaggaaggaaaggaaggaaaugagggaagagugcugggggaaauaaacacaugugacuacagcuuuaugaccggugagcaccaaagaugaguuaagacuagaucccacuggcugacagccaaugucuuuugaaaugucauaaugucauuugacaaugacaauaauaucaaaaagcaucucaaaauaaauaaauucacuggcuagguaaaauugcaauagcagcugaaucaugauuuuuuagagcccaucacuuuaagaaaggguuagaaggaaaauaaucgcagagaaaauuggguagcaggacgagccgcagacaaaacuccucagacaccaaguuaaagacggaagggguuuauucggcugggggcaucggcaagacuccugucucaagagccgagcucccugaaugagcaauuccugucccuuuuaaaggcucauaacucuaagguggggggguccacgugagagggucaugaucaauugagcaagcaggggguacaugacaggggcuucaugcaccggugguuagagugaaacagaacagacugggaaguuuuacaaugucuuccuauaaucuauagauaacaucaguugcuaggucagggguggaauuuuaacuaccaggcuugggucaggcaggcccaggcccgguuucaggucugguuccuugguuucacgucugguugcuaggcgccgggcuaccugccuuuaguuuugcuucucuuuccuuuucugaguauaaaacaauauaaaacaauaugagagggucugucucucuucucucauuuccccccuuugagacucucacuuuuuauuagugggaguucucacucuuauuuuugcuacuuaugucuuccugugcaauagauugauaaugauucacauauuuacacuugugcugauacauaacacgaagugacacugagagacugggcuauaugcucggcuaauugcaaaaacaaauuuccuguuuuuccuggaauuucugguacugacacauucaguucaucauagaagguuugaaauacuggcucaggagagcguuuauaaacuuuuccucaaaccacgacauuuacuugaagauccaguccagcuccaucaauuuuuaggguuacacguuccucuuuuuucuagugaggauuaaggggguugguuauuacuaguucuaagggguuacacugaccacugguacaggaagggccacuuuucccuugcugaagguggacaggauuuuuuuuuuuuauccaaguagccuaaaugacacaagaccaguauccacauuuauuuuuacacagucuuaauuuaugauaaauguacuuauuuucugccauauagccucuuucuuaauuaagagaaccacauccuauuuuuaaccuauuauuauuaaugacagcacaggcaucgaauuucaaggugacuuguuugggcacuucuuuuuuuguuuuguuuuguuuuggcuaacacuuuacuuguaucguuuaugagccuccaccagucuucaguccuuaaucuuauuuuaaaaacuauggucaugggaggcucagaugggucauaacacacaucagguuggucauuucccgggcuacauaccuuguauagaguaacauuauacaaacaaguuuuuuuagaguuccaguacacuuauaauaacuguaaaauaauaggacuguagcaaccuuuugucccacuucagugacuugauguauauacugggaacagcccucagucugaggaaggucaguugaaguccuuacuguacaaguccaaauuuuaaggaaaaugaguccugcgaugaguuuccucauguuucggccgugcauggaccaguuagcuucugggugugacugaagcagggcuugucgucuucuucagagucacuuugcaaggguuggcgaagcugcucccauccacguacagcucucggucuacugauguuuaaggauggucuuggagguugggcccacuagaauaaacugagucuaauaccucuacacaguuauguuuaacugggcucucugauaccaggaguaagguggcgggguuuagaguguugcaaacuucaauuguuauguggggauuuucacagagcaagcuuugguaucuaguuagucuagcauucauuagcuaaugauguccuuugguauuuauuaaagucaccacagcauggggggacuuuauguuuagguuuugccuaagaguuagcuuaucugcuucuugugcuaacagggcuguugcugcuagggcccuuagacaugcaggccagccuuuggaaaccccgucuaguuguuuugagagauaggccacuggccuuggccagggccuuacagucuggguuaaaacucuaacugccauguuuuucuuuuucugacacauaggguguaaaggguuuuguuaggucagguagccccagggcuggggcugacgugaguuuuucuuuuaacucaugaaaagcuugcugcuguugguuguaauagauguaguuuacuaaucuacauuuuuauuaacugucaucuaccaaaauauugacucaaauccuguaacuauuugauuucaagcuuuacauugaucugguauuccucaugggacuccaauugcgucuaaauggacaugagaguugaaagaccuacaaggggcuucucucgcuuuacaaugucuuauuuuuucuccugcugguugaugaaaugccagggugaaagggauagccaauuggacuaaaguauaagugccacuccaguuauucggcagagugcccaguaaagguccaccacaauaccaccacacauccgcgugaggaugaacaagggcugacugauugauaagcucuugaaaauucuuaagcucaucgcaucccuucaggucuccaaggaaugcuaaguuuccucccugucgugagagacacgaagugaacuuaguguugggagacggaggcuggacagcccucgggggcugacccgcagggugccggacuuugggauauagcagagagagcuuggcaugacuuauuacuccaggcuguagaauccuggaaaagaacuaccacacaguccaugccuugucgacuggaggaccaccuuaguggaagggggacaaucagggccucuggccugccaugugcacaagcauaacaauugcuuuuguuuaacgugcacauggaauauuugauccauuccaaccaggcauuugcaucuugguaugcugucuuaauugccaaaguuuguuuuaaguuuuuaacuuuuaugaucuucuaguaaaaugaauguuuccuuuagcaccuauuuuuauuaguuuuuagaccaaagaaagccaaauaccauuuuacauuuaacaaugcuuucuguaugauuuuuauacuagauaagccaaauuuuaccuuuauauuaguguuauugauguuaaacuuaauuuuaauaaaaccuuguagacauauuuaucuaauuuuuaauguuugaccauaagcaagauuuuauauacucuuuuuaaccuuucauaauuuuuguuaaagagcagguuggugcuuuaagaaaaaccuguugcauuuuuauuuuaauguccaguucacagaaaaacuggaugauaccuuuuuaacuuuagcuaauauguuuacacacagaauuuucuuuacaauuaacgucucaaaacucgcuuaaacuuucaaaacaauaauuuuuuuaaccuuuuaauguagguaaaaauccacauucuuaugccuccuuauaauccuuuuaccaaagguauauuuuacuuuucuuauacaccuugaacauaaacuguuucuucaauaguacugaguacuuuuaaauuauacaacauuuuuugcauaauuuuuuuuuucccguuagcaaagcagcugccgcuacagauugaaugcaucugggccauucgcggguuacuggguuaaggauuuuugauaggaaggccucagugcucuugggauaugcccuuguuuacacugacaacaaaguaguauuagaguguuacaggguuacugagaauaccuuuaauuauuaauuacagguuuuuaauuuaccuuggcuuuuaaaggaauaggguauacuguuguuuuuuuuuuuaacuacuuguauauuucucucuuucucuuuuucuuucucucuuugacuuucugucucucugucucucucugacuuuccuuuugccucuguuucuuccucucuuucugccucucucuuucugucugcuggucuuuccuugccucugccagccgcuuaugcugcuguucucuuaacuacuguggggggaaggggaucuaaaaccagcuguaacugucucuguacggaaacuggucugggugccuuggcuuacaggcuaccuugugccauaccuuugaaacaagggacuugucuaggcuuccuucugauggccaagccaccucuaaugcuggccagucuauuucacacaaaguuuuaaguucuccuggugucauaguacuccauagucuuccuuaaauccuuucuugaaauuuuucaacauaguuccuaguagggugggcuuauuugugccugacccaugcuucuuugagacaaaacaccaugcucacaccacacgcacaccacaaaacaaagaacagguaaaaagggcacacacacacuuuugcaguuuacaccaaaccagaaucaaaaccaaaauuagaguauccagaaaucuaagccaggucaaaaccaaaacuaagcaauccaggcaauccaaguaucaagcaauccaagucaagucaaaaacaaaaaccaaagugccgguacugccacaccgugggugaucaggccaugcuuccacucaaauggaguaggcaaguuccuacucaaauggaguaggcaaguucccaagaccaguccugugaagcaauucaaaccaagucaaaaccaaaaccaacaccaaagugcugauaaaggcacgcugugggugaucaggccacgcuuccacucaaauggagcgggcaaguucccaagaccaguuccgucaagcaauucaaaccaagucaaaaccaaaaccaaagugccgauaaaggcaugccgugggugaucagaccacgcuuccacacaaauggagugggcaaguuccaaagacuagucuuaccaaguuuuagaugucuggacuccaagugccaguuccuucccaguguucagccacugcguugauccuccacgggggccugccacacacggcucuggcgaggcgucccaccugggcaaaugccuacccgggagcgcucucaggauccgcgucgcuccggcugguuggagucccccgcagggauguuccacagggcaggcuaaagccaccuaaggagcugccucaaccgucuguuaaucaccucgcuuccuggucagggaaccaagaaauguagcaagacaagccgcagacaaaacuccucagacaccgagauaaagaagaaagggguuuauuuggccagaggcaucagcaagacuccugucucaagagccgagcuccccgagugagcaauuccugucccuuuuaagggcucacaacucuaagggggguccacguaagaggguugugaucgauugagcaagcaggggguacgugacaggggcugcaugcacuggugguuagagugaaacagaacagaccgggaaguuuuacaaugucuuucuauaaucuauagauaacaucaguugcuaggucagggguggaauuuuaacuaccaggcuuaggucaggcaggcccaggccugguuucaggucugguuccuugguuucgcgucugguucuuaggcgccgggcuaccugccuuuaguuuugcuucucuuuccuuuucugaguauaaaacaauauacaacaauaugagagggucugucucucuucucucaguuguaggagaauaaaguugcuauuguagcuauagcagagaccaagagaagagcuugggaagucuggguggugggugcccugugccacucuuccacagugaagcaaauaagguuugugggaagacagggucgcagcauuccaggggagggguuauaaagcaaguagucuucugagggugaguuauucccagcccaaagacuuuuuggccuaaaagccaagauuuaaacuguuuauuuggagacuugagaauucugcccaaaauauauguaaaaaaaaauguacucuauauaagaacaaaucccauaaacgcuaggaagcuucuaauggcuuuuaaaacauauucucaaggcaggcuaaagucugagagauucuucuuguauuaucaaaguaugcuuccuuguuaucuuugagauaaauuauaaauguaauuuguaaaacacgaauacaaggcaugaguuuggaguuaauaucaaaagguaugaccuuaucccuaagguuaucccuuauccccaagggaguugacuuaagaguuuuuuguuguuauuuugcuuugcaucuuauuuguuuauuuaaaauuuaaaggaaaaaaguuucauuuuaaacaauuuaauucucauugaaaugcauuuuaagugugaguuucauccuguacauuuuauccauugaaucaaauuagacaagaagcuggcuuuuaaacauuaaaaaaaaaggcaaaauuaaaauaacucaguacuuaagaugcaaucuagggcuuaaaaauucacuuacaaaaaaaucuagcuuuaagaacagugagcuuucaagguggcuaagcuauauuaaagugaaguuauacuuauuuugacuauaaauaugaauacugauuagagaaaguaucacacaacuauaugagaacacauuucauuuuugaaaaaacaaauuugaaugccugauuugucaucuucaugguaaagauauguugguucucucuuuuacguagcuccuuuagcuuguccuuauauaagucaacagggucucuugauucagggcauaguuccgaacaauucugccaguugucuaaaucuauucuuuccauuccaaauuccaagugacucuuucucuuugaaacagaugcaaauaguuaguuucacaacuuuagucauuuucauccuuagaauacagacugggaaauugcacacuccaggggugcugggcaaagggugccagaccauggcaaggaugcuggugacuucaccgaagggagcuuuauugugccggagccacugccagcuacccuccuccaagcaccgacugccaaaacaucacaguccaaagaggggugcuccguucccccuucccaccucccccccuucaccucccugccuaucagcauccagaagcaauucuuugcaugggugcuucuucauccugauccugacuggcagcuccaaggauuaaacucagguccuuuggagcagucgcuuuaugcacauuagcccccugggguguugaacuccaaaaccucuauuuuuucccccgggucuacccuguaucucacaaaacccuaguuagccacugugguacacagucuuucuuccauuccaggcuaucaaaagaaaacaaaacaaaacaccagaccuuacaacaauaugauggauaugguaaugaucgagcgucuuuaggguaguggguaaauuccaaguucuuucauaacugagacuugggaacucguuuucuucuuuaucauuaagacuucacauuuucaucagcagaaucuugcuuacaauagcacaaaugauaauuuggcugaaugaaaauggcuugugguguguguguguguguguguguguauauguguguguguccauuaaaaaaaguuccucaaaacugcugaaugaaaaucaagaccagugucuucuuaaucaaacaaaauuuccugcuuagggacugcguuaaaaaaaaaaaaaaaaaaaaaaaaaaaaagaccaucuggccucucucugcuauuugagggguuuuuuucuccuccucacuuccugguuaucuuuagcaaaacauuaucauuucucguauaaauuguuuuuaccacggugcauuuccuucugugcauuacuuuaauaaaugggauagaaagcauugcuccauuucuugaaaaauacuuuucagcucuaaauggcagguuuaaagggggaaaaaaugaaaaaugugcuuaaaaaaaggaagauggaagucaaaucacagugagggcauuaacuacucauguuucuuuaaacacuucugccaaggcaagcucuuucuuuuucauauauauauacauguauauauauagagagaguaauaauuaaauuccaaaaaugaaaagccacccuacgcacccuacccuacucauuuaaggugauaacuaugcuaaacacccuccaagaaauaagucugaaauggaauuaauuuccaugugggaacaaagaugacaauaaaaauaugaucaaaucucaauuaacuuaaaaaaaauccuaauugaaacauuucuacaaugcuugaguccacuuuacuugcauaacuacaaaucacauauuggaucuaauugaaaaguuugagguaauuucaaaucuuauuuuuccuugagaucaucauuaaaaagaccuuuuuucauuugaucauaaauagagaugacguaggagauugacuugaauguauaauuguauccaugaccauggauuuuuacaguaauucauaauaucaccuucuuccuuguauuucacaaaucuuuaggaaaaguauaauguagaaaacuugugguuaauaaagguuugacauuuuagcaaaguucagguaagcugagguuuuugugcauuuacaugcuaaacaaaaugacaaagauuccugcuuuucucacugcuguucaguaagaguaaaaaaugaaugauaauuuuaauauaguacuuccgaucaauuuuguuagcacaaacuaaagacuauggaauacuuugagaaauauauaaacuaauugagaaagcacuaguguuuaguuucccaguggaacacaauggcagcucaagacuggucccaaauguccuccuuccauggugcagucauguccaguccagcuugggcuccccauuccaauuucccacagaaauuuauacugugccaccugaguuaccaaauaaugacaccauaauugaaucaaauuauugcccaacaaaaagagaccucuagucuuacauuuuagcguuccacccuuugaugaagguuauuguagaagacgcuccuguauuggguaggagauugggaaaauguuagcuaagaucacuuccagcucuacaauuccaaauagcuugcauuguaugagggaagauaaggauaagacugggacucauguucucucucugaauacccacacacucucacacucugucucucuaccucugucucugucccucugacacacacacacacacacacacacacacacacacacacacaccacuuuuucuuuuggggagaggaagauaucaccaaguccucaucccccaaagcaauacuaggcaaauuuauuuugaaaucuuuuauaugccaagaacucugauagcuacugagcacacaguaggguuuucauaaauauuuccauaaaggacugaaugaagcucaggagaucugccaucucucacuuaugggccuacaaaagauauucuuagagggagaaaagaucaauaaugucagauuuagccgugguacugguguuugugccgaugacuauuuugaaaauaguacaguuguuacacacuaaaaauaggacuguauuguaaggcauauauaucuguguguauauauauuuauguauuaauauuaucaacuacuaugucuugggcacaaaugugugaagaacauuuugaggaugcauguauugaguauauauuuuagaucucaaucuguaacucaguuuagagcuugcaaagauaaaaucaguggguccuuauuuuuguucgcuuuguccuucuaucuguacugucuucucucaguaucuuuucaccaagccuugcccugaagaacgauaaugacaccaaaacauaggcacuuuuucuuucuaaggaccccucaagggauauuauaaacuuaaugucuuggggaauucugcagagacuuuccaaacugguauacucaaaaucagugucaaggcccugagggugauugggccccaacuucugucaccacagugauuuccagguugauugggugcacgugacauccuugggucaaggguauggacaaguagcccugugccauauagaaccaccaaacacucuuccagcccauagaagcagcauugggaaguacugcggauuauuaccugcugacugugugugaaguuguccuuccaauaaauacuuauuuuccuuagaaaagggcaaaaaggucucaugauacauuacuuagguaacuguuauacccuaauagaguagcgcacuuguauuaauucuucaccauacaagacaaagaauauauauaaaauuuggugacuuaauggaaauaauauuuauuuagggagugaugaauucuaggcaaaauaaagaaugcaucaauauuccuaacacccaaaugguugacaugugaugcaauuuacauaaggcuuccuuugaauuucauuuuuuggagcuuuccuucauauauccauaacuggcauuuaaaaaaauaccuacaauaugccaggcacuuuauacaaauugggucuaaucccuacccaaucccuaaauaguggguaucauuuucccccuucugcagaugaggaaacugagacacagaguuaaagcaucuucuccagggccacacaacuggcacauggcagagaccaguuuagaaucuggguuuuucugacucuuaaagaucucuuucuggaagugaaauuacuaugucgaagacacacccgcauauucauguuuauugcagcacucuucacaauagucaagauauggaaucagccuaagugcccaucuacagacaaaaggauaaagaaaauauauuucuuuauggggaugauuaggacaauggaauacuauucagccauaaaaaggaugaaauccugucauuuuuggcaacauggaugagccuggaggacauuauguuagguggaauaagucaggcacagaagacaauuacuacauggaacaaaccugcacauuuaccccuugaaucuaaaauaaaaauucaaauuauaaauaaaauaaaauaaaauuuaaaaacauuaaaaaagauaaauaccacaugaucucacucauauguggaaucuaaagaagucaauuucauagcaguagagaguagaacagugguucccagaggcugcugaggguaugggggaagggaggaacggguagagauuggucaauagguacacaaaguuagacaagaagaguaaguuuugaugugcuaucacacaguagggugacuacagcaaauaacaauguaauauauauucaagacagcuagaagagaauauuuugacuguugucaccacaaagaaauaauaaaugcuuaaaaugauggaugugguaauuaccccaaucugauaauuauacuguguauccauguacugaaacaucacauuguaccccauaaauauguacaauuauuaggugucaauuauaaguacaaauuuuuuuuaaaaaaaauuucuuuccucagcaacauauugcugcuacagcuucaaggaauuggaaauuuuugauaaacuaauaugaauaaaacguggacgcuguagauucuggcaguauuucaacuacuucuaaacuuuaauuuugaaaagacaaauaguuaaacauuggucauguguuccuucuucaccaggagcuauucagaaauuucacaggcuaaacccucccaguucugucuuagaaggacugacaucuggaucauauuggcaagggggugcuuuaaacauaagagaaaauuaggagaaagaccuaagacuggauuacuuccacgaguucacucaccgauacccgcccaaguacugucuuuuuucuuguaacuagcuugucacccauucuuucuacucagugaacaauggcuugugaccucacaguuagcgaguucauaggagaaauauaucaguuauaauuaauguuuacuagaauaaauguaaauauuuuaaaacauacaacaguuccaagaacaugugauuuccauuuuauuuuaugaaacauuaaaaauccacuuguccaccccauuaauuauaaccugcucccagcccugaccuguauauaauuccuccugacauaaauuggaacaaggugcucagaauagaagcagccuacaccccaacugggcuacaaaaugucaaguucccaaaccucucaaaaguguaaccugacauuuugcuaagauuagagacaguuuaugaauuuaaaaagagggcuuaaggacucaccacaguuaaaccuacaguaacuccugaaauauccaaaguaaauaggacuaagggagcccuggggacaccaaaacccuguuagaagagaaggaacagucuuuagugggugguauuucuuugcagaaaauaauguacaugcauucaaccagaauuaagaagaaugcaacaauaaacuuugaggcuugaagcccucuagagaucuaaaggagucaugaaugggccaugugaaauauuucuccuuuugcuacaugugaaugauugaauuuauacugcccauuaauccuaaauguugaaggcaaaaaaaaagagagagagagagaauggcuaacuuuuuaaauaguauucuucuugacaugaauauaauauguauuuauuauacauauguauaauguauauuggugaauauuuauaacauucccaaagagcaaaacaccuauagaaggaucuaaccgcaaagaagcaacauuccacagguugaucuuucuagucauuuucuguaccucuuagccacaaaaaugggaucagacuuuacguuuuguuuugcaaguuguuauuuuaaauauaauauauugggugauuuuucauguguaaagauucuucugacuuuucaagauuaauuucaaguaccuuuuaguacaacuaaaguauuacagccaccuuccaaaucaaauagacuauauaagcugaagauuuacuaaauauuaaaauguuagcaauuuuuccccauuauaacaugcacugucaauaggggcaauauugcccccaagagcgagaaaacuaguucucaguggcaaacaaacaaacaaacaaacaaaaaaccuuacucuuuuuaugcacaaagcacagauauacauaaauagauuuauacuauauuugugguauuaaaauuucaugcaaggagcaauuagcaaaaaauguuucaacaggcuccuugugacaggggguugaaaaugaaaauagguuguaaacacugcacuacagcaucagacuuguaaaaaguggccuucauauugcuagaguucagaagaugauuuuuuccauuuuaaauuuaucaaccuugaauacauuuuuaacucauuucuuaguugcagaaaccaagguuccaagcagcagauuuuuggagaguuaauguuuugugauaaccccauggucagcacaugugauaucugccauguucuuacuaaagacuccuuggggucuggguuaggaggcacauguugagugagaggauguuuugagggcagaugaacacaucaucucagaaagagcuagggccugcuaagucugcaucucaacauuuaucagcucuugcucugugcugcccucuugugaugucugggccuccaguaugccuugaucucaaaaccuucaguugcccuaaauugauggaccaccugccuuccagugcuucuuggcaccaacaccaggagauggugaaggaaagaagagaacaccaaaagcagcagauuuccuuagaggaagaagccagugucagaagaggaagaaaaagucacaaaacuucgcuuuggcccuuuaacccuaggaaagggugggccaauuuuccacaaagcugcuguuauuacaggucacacagcucaccaaggagcaaggcaggagcugagauucuucaucaccuucugugguaggcagacuuucuaaaauggcagcccaaagauguccaccugaagcccuggaacuugugaaugugacaucacuccuuggauuguguuguguuacagagcacaguugauguuagaaagggagaugaugcaggugggccugaccuaaucacaugaacccuuaacugcugagaacguuuccugacugaugaaagaggaauuuagagagauucuaugugugugaaggacucaaugugcuguugcuuugagguuggagauggccacuuaagaaggaaugcagaugucccuuagaaagaguggaccacagcuuauagcuaucaaggaguucagucuuacagcugccagagaguaaauucugccaacaaccagagcgagcuuggcagcaaauucuucccuagggccuccagauaagagcuucgucuggccaacagcucgauuucagucuugugagacccugagcagagaacacagcugggccacccagacuugcaaccuacagagccacgagcuaauaaaugggguguugguuuaaucuguacauuugugcuaauuugcuaugcagcaauaguaaaugaacacaccuucccuucucuaugaccauccugacgggggggauccuggcaaugucugucuccuagaucacagauucuggugagugacaaucaguucaaauacaguauccaaucccgggucucugacugacuucuuaacccuucaagaauccacaauaagucuugccagacaaguccuagcucuugaccucugcucugaccaacugucccuuaggaagauuuuaaucaccuuccgcuuaaugaucaauuucucagggcucuccgcuuucacacccucuaccaccuggcuuauuuagugcuuagcaucuucuccaagucaagcauccaucugguguauuucacucugguugucuuuuaccugcuuagaacuuuucuuucuacaucuagaacguguucauucugccucuucaaaucuccaaugcccuuauuuuccuauaaugggcugcucaaagauuauguaagaagaaaagugaaagucugaauacucuuccauguguuaauuuuccugaauuuucuauaggggaaacagaaacagugaugauaugccaugaucauaugcuaugguggaaagagaaggaaaaggauuaagcaucagacaugguugaaugugaaacuuucccaguauuuuaucaccucugcauguuuuuaaauuuuuccaggccucaugcuccucauuuguaaaagaauaauaguaauacuuaacucauagagcugcaaggaggaaugaaaaugguaaagacccacauaacagaaaccagcacgcacaaacacuuaaauaucacugugagaagaauugaggugguuguuuguauaaaauacuuccaauuuuucagaggcuguagcuuuguaaauaaucuuuuuaucucuucuauuaucauaagaacaaagccauugucacccuuccuuaagacaggguuuagccuugacaguuagaguauuguguaacauggaaacaaugauuugacauuagaaugcuguauccauugcucugagaauaaagaaagugaguuuuaggauuaggaauaaaguucuucaguugccacauuuguuaggauauuucuggguuuucuguaaaguugaguaaacccuaggccccaugaaggcagggcccaugcuuaauucauccugaguaucuacaggguuugguugaaaacuguguccucaguaaguacuuacccacuuauucauuuauuuaugcauugaaaaaucaguuaaagaguaaaauuuagcugggcacaguggcaugcuuguagucucagcauuuuggguggcugaggugggaagaucgcuugagcccaggaguucgaggccagccugagcaacauagugagaccccaucucaacaaagaaaaaaaaaagaguaaaauuucugcugaaaacuguggugagcucaacauuuuauuuuuuugaauucuccuuauguuccuauugaacauuuauaacuuuaauuuuucuucuaauuaauaaaucuuaauacuucucugauagaaccaaaggggauauuuggauacuuggggguuggggaaggugggacauaugcuccccaaaaucuccaaguucuucagcuucugacuugugcuccaaccugaaaauaaacccagaaagugucauauaaaauggccaacauauuuccaacuguuuucuuccuuuuguauuucccacucauuacccaggaugcauuuccaguguccuaguggcccugucuuacaccaacuguugcuuccugcuucugaacaucagggacuuuaaauuccagauuuaagagacuugcguguugaaaagcuuuucucuuucuguaaauuacuugucauuaaaauaacaaaggaugcacucauuagucaaauuaaagaucaucuaucuggaagugugucaaaugcagauaaaguauaaagaagcauuguugauacuuuuuuuuuuaaauguggacuuaaugaauaacuuugcuguuaaaauucagcagccaagcgcaaugaaaaauucccauggcuuuaaaauucacagcuuuggcagacuucuuaauggacaaaguucaagagauucauagcuucccuaacuuaaaauaaaaauccccaaaccacacaagguagcauuauuauacucugaauacucuuaagaaaaggucuuauuagcugaugcuucauaauuauuugcuaaaaaaguugaguguuauaauuuagccucucacuagcuuagccuuuagacauaauguagcauuauugcuuuaaguuuuauacuggcuuaagguaaguaacgugcuucccaacaaccugcugauuaguagagucccuuucucagucauuacccuagagcaggguucugcaaacuauagaccacaggccgccuauguaccaaauccaggccucugccuguuuuuguguggcccacaagcuaagaaugguucuuacauuuuuaagugguugaaaaaaaaauuguuuaaauauuauuuugugacuugugaaaauuaugugaaauucaaauuucagugucuauaaauaaaguuuuuuuggaacacaguuaccuccaauugcuuuauauagucuaugucgagcugagggguuuggacagagacugcauggccacaaaacccaaaauauuuacugucugguccuuuaugaacaagggugcugaccccuggccuagauucaugcucuauaagaaccguacaaauagcuugacacuuucuccccuaauaguguggggcuguccauagauccugguagucacaugauccugcucugacuacugcccuugucacauaugcacacagacauauacauacacacacacguacgugugcacacacauuuuuuuuuccaauuauugggaauggggaagaaggagaaugacuaauagccaagccuaccccuguucccuaggguugugggaauauucugcuuguucccuuuggcgaaauggaauuggaguuuuuguuuuuguuuuuguuuuuguuuuuuuuuuuuugagacagagucucgcucugucgcccaggcuggaguacaguggcgcaaucucgacucacugcaagcuccgccucccggguucacgcccauucuccugccucagccucccgaguagcugggacuacaagugcccgccaccaugcccggcuaauuuuuuguauuuuuaguacagacgggguuucaccauguuagccaggauggucucgaucuccuaaccucgugauccacccgccucagccucccaaagugcggaauuggaguauuuuaaucugggauaaaaucucuguaacaauuaagcaaauaguuucugacuuuuuuuuuuuuuuuuuuaccaccaaugaccacuuuuaaaaaaauuuuuaaaugcuuggaugcuaugcuuaucauucuuaaaaacagcuuuauugagauacaauucacacauuacaaacauccauuucaaguguauaauucaguggguuuuaguauauucagaguuuugcaaccaucaccacuacuuaauuccagagcauuuucaucacucccaaaagaaaccccauacccauuagcacucacuccgcauucuccccuccccuaucccccggcaaccacgaaucuacuuucuggaucuaugaauuugccucuucuggacauuuaauauaaaaagaucauacaauauguggcccuuugugacuggcuucucucauuuggcauaacauuuuuuaaaaaaccuuuucacuuuuaacuucauaaauccucagguuuagaaguauuugauaaaacaaucauugaaaaaguaauuauacaauaucuucuggguuuuucaaaacgcugaaaaaagcccacaaacuuuucuuacagucccuagggaugccuaugagucuggguaaugccauguaaggcaucauucugccaccacaugcucauucuaucauuuacuaagcaaauauuuacagagcaccugguauaugccaaguguuucucaagguguggaacaagacaugccucucaguuucagaucuaagcucuucgcaaccuuccuuuucauuagacacuggcuuguuuugccaaccuguaaacagcauauugccaacacacugugccugccuauauauuuuccagacuuuuaguauuuuauauaaaaaugaaaaaugauauuucuuaaauuauuaaaaaugauuuaaguugccuucaacuuuccaaguaccuggaaaaagcuccugaauccucauccccuucuuuuccuacuuaucugcccacauuuuugucuuuucuuccaucuuagaaccgcuuuucucuuugauuaauauccuaaauccuuuagcacaugacaauaagauauugcaaauagccaugggguaucagacaagcaaagaaacaaaauucacacuuuggucauucaugacuuuuuuucuuaguaucuagcuagaugucugucaucauuguuauugcucacucacuagcaaagguucagaauuucuauuccagagguaaacuaggcaaagucucuacaauccaggcagagagagcuuaaaauaguggcauuaaggucacuguguauuagaaacugaaugguaucucuuuccucuaaucuggugagucucucuuaugaacaguucuuuuaaauguuggacauuuguacuuacuaacauggcuugauccuaaaggauagaguccaaaucaagcacaucugggcauauuuaaccuggaaaaaaugcccccagaaggccauguuagcuuugucuuugaagagcugucagagaacagaguaacugcacguguucuguguuguagagagggggccaaacagggguaaaagcuauagggagagagagauacagauuucaucuaaggacaaacuuugucacugcaaaugaugucucucauuggaaugagccuccugaagauccccuguugugcuagcauuccugggggccauuagaaagggguugcuggugauaugacaggaauucaaccaggauaagguuugagaccaaagaucuuuaacucccaacgauauagauucuguggcaagggugaugauaaggaacccggcuggggagaauuuuuggcuuaaagcagcuacaaugguucaaucccaaagauuggugcacuuugguaaguaaaagagaugaugucuuaaugccaacgguaacauacuuuuuaaagcauuuaugcagcaauuuaacaaaugaaaaggaaagcauuaguuaacauuuauaguuaaauguuggagauuuuuaaccuguccagauauucaauauuauauuccuuaaaaaaaaaauauuugagccaaaggcuaaaaacagucuuuugaaauauauauauuucaaaauacauagacacacaugcauaaauaauuagucuuuaaauauagauucuucaaaaguauuauaugccugaacuugcuggaucauuagacaagagcggcaugagaaaaccugaaauuuaaaaacacaggcaguauguacuuuuuacaagaaaauaaugagccacagggaggaaccuaucuugacauuaauuaugaagaauauaauacuuuaaaaucuagcaggacuucacugccuuagacuagaauuaaucagaaguucucuucauuucuugaaauuauguuuucuugguucaaaguuauaaaucucaaagcuguauaguuugaaaagcuuuuagaaggcuuuguugucagaaaaaaaagggauugccucugcuauauacauuuuuaaggcugacaauuaaauauuuucucauauugaauaugcuaucuuauguuauaacuugaagggcucugaugagauuuagugccagcuagaguaucugaaaaucccuacaauuucaguuaugacauuccauuacauggaagugccauuuuaucccaaauaaccaagguuacauuuuaaaauuuuacuuuccauuaauuaauucagcaaugcacauaugcaacagauagguaaguuuugugccaggcauugaggaaaauucaaaccuuccacuguacaaguuucaaagacuuauucacagaguuguuuaacaggauugccaaaaaauugaagucuauuuuuuuucucuacuaacauuuuauguacuugcuaaucugccugucggcucaaucugcagcuuuugagaaugcucagcugcuguuauaaccucagugcaucaacucuaauuuguaagaagauacuguaaccuuaaaaggucaccuuauauauuccuugcacauauuggaagaaaggcaaagaugagcaugacuggggauuaaagugacauuauuagguuuauccuaagaauaacauggcuucuuuaaaauauaguuugucaggcaauuuuggaaauuagagauauguuauuugggguucuggcaacucuuugcuauauaacucuaaaaauuaauuaaccucuuggucuauagagaacauaagggcucuguaggaaagggaagugugcaugauguuacuacaucacagacuuuaaaugaagucaccaggagaaugcaugcaguuauaauguuaucacuucacagagacuuucuggaggaacauaaacuauaugaagaaaauuuguaccauuuccucuaagaagggugauuuuagccuacacaaguaauuuguauuuucacuuuagaaguuaaaauuccucuuuguaauccuauaaacaaaggaggaucauuuuccugguucuuauggcuauaauguuucuuccuccaaugccuucucucaacauaaucuacuaaacccuuugggcauuuuuaaaaugugcauuuucaaaguauuuuugaguauuauuugccaugcuaugaaacuaauacauuuuuuaaaaaguauccuauuauuuugggggucagucugcauuucaguguauucuuucuucauaaauuuucuuauuaaacucauauacuuccaagaggcuuugcuguauugaaguguugcuugaguuuaguaggcugggaucauaaaugcauagaaaagaaugagaauacuucaaggugcaccuuccucuagaaauagugauaccuccggucacuuuauaaaucucuauuccugagacaggaaugccucauucugaauuggcuuagcguucccgggagauucauauuacaguacaacucaauggcguauuuuacugucagagccauagauaacagugaguucaugauaacuacuauccaaaucuuccaaauguaacaacuuaaagaaugaaaacuaaaaccggaauuuaaauugcacaacugauacaggaauauuuuauuuuuacaugcgguuauaauuuauucuuuuuucagguaauuuguaauuuauauauaaauauaagauacauauuuuaauucuaauacagguaagaauaugcaacuuaacaguauuucaaaaaauaacuauuuucaccuuauuuuaauucuaaaguagaaauauauuuauauaccaaauguaauaaauacaaaauauauuauuuaucaaguagggguaaauuuauaaaguuaaaaaauacauaacauuuucuauaauuuauauaauaauuauuguugccauguagacauaauuuaaauuauaaaacacuaucauauuuuccuuugccuguuuugcaauucuuuaaaugucuuuuaaaaccuauuagaauucaaagauaaacacauugaaucagaggaagauccaggaauugugccaauuucucuauaaaauucucuaugcauauggagauauacccuauuuuaugagguauuuuauuaccuauuaaauuuuguaucuguuaaaauaaucaugauaucuaauauaagugauaaaacaucauuaaaaguaaaacaaaaccagguaugcaugaaguuugcuuuucaauuauguguguucaauuuguguuuuauuuuauuuuguuuuguuuuguuuuuugagacaaggucccaggcgagugcaguggugccaucuuagcucacugcagaacugaccucccagacucaagcgauccucccgacucagccucccaaguagcugggacuacagguuugcaccaccaggccuggcuaauuuuuuauuuguuuuguagagauggggucucaguauauugcccaggcuggucucaaacucccuggcucaagcaauccucccaccuuggccucccaaagugcuggaguuacaggugugaaccacaacagugccagauccaauuuguauuuuaaagcauugaauauaagcucuuuaagaaacaaaggcugauaucguucucuguuaaccacuaaucuucagccauaacuugcagaaacagauuuagagauugguaguuaucagaaaugaacaggugggcaccaaaaccugauccccgcugguaaggagauucuuaucaaguuucagcaaacccagugagguaaccugaagccugagauucuccuucucuucugucuaccccagugauucucaaagggagguuuauuuugcccccaguagacauuuugcaaugugcugagacauuuuugguugucacacuuugggggcaugggaguguuacuggcauccaguugcuuaaggccagggauacagcuaaacauccuacagugcacaggacagccccacaaauaauuaugaaaccccaaaugucaauagugccaaaguugagaaauccugacccgggagaaucuagacuggauguuggggaacauuugggauugacgcccacagagccaguguauguaugucuguguauauguauguuuguagauuuacacacaucuacauguauauugacaaugaagacagaucaugccccuauuuaauuuaugcaaaugcaaaggcaauggaauauguuggaaaaggggagaggaauuuaaauagucuuagcaauuuuuccugauaccuaaugugucuauuccuaaagugaaguuagguguuggggcgugcaucugccaugucuugagcaaguaacaauucucugagugucucagaguauaaauugaagcccagucuaauguucggauauauuuugcacaacacaguuucuuuuuugcucucaauauuucaguuaagguucaacaaaaaaggcagcaaucauagauauuuuugacaauucagucauguaccaagauaggcccauauuaugugugagaauuuuaccugggagguauugaacacacccaaacuggauuaugaaguaucuucugcacuuuuugaaaaccaauacaaaugagacaccacuacacaccuaccagaauggcuaaaaugaaaacagggacaacaccaaaugcuggggaggaugcagagaaagcugggucacugauacauuucugguggggauguaaaaugauucagccacucugcaauacgcuuuggcaguuucuuacaaaacugaauguguacuugccauaugacccagcaauugcacuccugggcauuuaucccagagaaaugcaaacuuacagucauacaaaauccuacacacaaaugcucauagcaacuuuguuuguaauagcuccaaaguccuuaaacaaguugaugauuaaacugucauauauccacaccaaggaacauuacucagcaauaaaaaggaaaaaacgacugauacaugcaacaacuuggauaaaccucuagaaaauuaagugagcgggaaaaaaugucaaucucaaacaauugcauacuguaugauuacguuuauauucuugaaguagcacaauuauagagauggagaacagaugauuacugguuucuggggguuagggaugggguaagggguggguaaagggugcagacugcccaguacauuuuuuugcaacuuccuauggaucuguaauuauuucaaaauacaauuuuuaaaauuauguuucuguaacaacacagcccugggaaacaagaucacccaaauggucucauucacagugguagaguuguuuuaaagaccaguguuauauucucagcccucagcaccaugcccucuaaaaugcauuuuuuccauuucuaccuuuuguauuuacugcuguguuuauuuuuuuguuuuaaagacagaaauacauaaacaugaguauaaguguaauuuuauuucuagguauagcuguaaguauaagguguguaacauuguaaaagaguuuaauuguuguaaagaauaagauagaugaaggaaaaauaugcuuuuuuggauuauaauaugaaagguagugauaagugaucauguccauuuaauacuauuugguguuguuuuagcauauuaggauaauuuguccgaaaaggguacauuuuuagcaacaaauuaguuuucuuacauuacagggauauuuauacauauacaugcacacgugcauacacacacacacacacacacacauuugucuaaagagaugcuuuugaaucauuacagccauuucagauauuauuccaccguguguacauauguguauauuuacaugccucuguguggguggauguguauucauucagaggguaagagguagaaauguccauaaaacccagccuucucugaaaccuuaaguuuguaccuaaaaaaagagaaguuaaccuaacauuuuuaagugccuaguauguaaccaauacucuguuaagugcuuuauauaucauuuauauauauaauccuucauuuagugauuauucuauaaacccugugaguuguccacaucauuucaauuuuacaggugaggaaacuugggaaguuuaaggaaucaacccaaggucacagaguuaagauguggcacguuagggucuuuacucgagggucucugauagugugcuucuaagucuacugccgggagugauucucuuacuaaauaguaguuuuaucauugucaaaaaaacccaucaaacaucguuguacuagaccuggcauuuucuuucuuucuuucuuucuuuuuuuuuuuuuuuuuuuugagacugagucucgcacuuuggcccaggcuggagugcaguggcgcgaucucggcucacugcaagcuccgccucgcggguucacgccauucuccugccucagccucuagaguagcugggacuacaggcgcccgccaccaugcccggcuaauuuuuuuguauuuuuaguagagacgggguuucaccguguuagccaggauggucucguucuccugaccucgugauccgcccgccucggcuucccaaagugcugggauuacaggcgugagccaccgcgcccggccuucuuuuuguuuuucuaaacagaggauaugagcagacauugcacaagaaaugcaaauagaccuucaacacaugcagagacacucaacgucacucagaagagaaugcaaagcuacacagagaugccgcuuuucagauaucagauaggcaaaggugcacaaguuggacaaugcucucuauugaugaggcucuggggcagugcucucacacaggcugguuagacaauguuauuuauuuaucaaaauuagaaacugcauuugcccuuuggcccagcaaucccacuucuggggauuuuuaauacagauacauccgccccauacaaacugaugaacacaacguuuuucagugcacauugcuuuaauggcaaaauauuggacacacuccacgugacuaguaggggaagggucaaaucaauuaugguacaucgucauagugcaaugauaugcaguuuuguuuuguuuuuaaagaggaagcucucuguggacuguuauggaaagaucucuaggguauacucuaaagcagaaaaaagccagggugaagaauaauguaugugaaaggccacuauuuguguaagaggagggaaauauauuuacauuugccuacaacaagcagaaaaauugcuguagaaauugauaucacaacaggagacacaugguauacuauaauucacaacuuugggcagcuugggaaugacgauguuuacauaccaauuagggacucaagaaauccuauaaaguuuuucuucaggauccuaguauucaaauuagcauaaggaucagacauggaauauaaucucugaggugaauguuucaaacaauguuugaagcccccugggaucacacaauuaggaguugugccuaucucaauuacuuucauacuguuucuuuacaugauccaaugcuaaucaacaauuuaccugguuaaaauuuaguugguuugguuaugcucugaagaggacacucccuucuuauguuuucugcacucaggcaggagacuuguaaaggagcuaacaacaaagggauuuuuaaccuucaaagccuuaauuagaaaauaagagcaaaugguacauuuuuaaagaggaaccaggaauacauauucuugugggcuuuugccucauuacauuuguuaauaaggaaugccaaaacaugugcaccaaaaagcguucaaggucuuuugguaguaaauuauacuuguaaauuugauguaaguugaucacuugaagaacucacacucuuugaagauuagaauucauaaauguaugaaagaauuaaaugguucuuuccucuagugauauaaaguauuaaaugacagaaaaaaauguguucgaaaucaacugcggaaauaauucauuuugaaaaguauucaauaaaaauguuaaaugggaaaaauaugcuaagcccguuucugcuggaugaagaaguaaagcagaaacaugaaaagggcaaauuuaaggaugaugggcugggaaaugucccaucagccucacaguuuuacuuuuuguuauucaacuauggcaguucuaggcccaguaaucuauuccauccccauaagacaaagaaaaaaagacuaauucugaucagcagaaaacuggauggccucuaggaaccuucaagagggcaguagcuccggaucaaggagaaaugaaugccuuuaaagaggcaucuuagauuguuuuguuaauacauaaaauccucucucuuuaucaugcagaagucucauuucaaaaggaaaaugcaagucaaugaggauuaguuuggcuccucagaggucagaacuaaauauacaaaaacuaauaauaugacacugaaauaaacaagaauguggaauugcucauccgaagggaugauguaacuaauauugacauaauuuccaagcagaaaagcaaaacuaggucaaagcacgauggccuaacauaauaagcauuuuuguuuccagauuuuuaccauguaggcugugucugcaggcauuaaugucuucuguuaucaauguucggggcugucacaaacaauucaugucuuaucacucuuuguuaguuaaaccaaaacaauguaguuuauaugugaaccauucaauucugacagcugaaauguuagaaagcggagaaauauucagaaagugucucuuccagacugagaagcaucaagcaauaaauauucauuaucuaauagucuaucauguuuuuaucuacucagaaagucauaccccucucaauuaauuauuaugacuguuuucccucuuuuagucagagccguacaaaaagggcagcaacaaucucauuaggauuucacuuuaaacauugaccacugaaaaggaacucaagugaaucacucaccaaauagccaauuuuucucuaccgcuuuccccaucauauguugacuaaaagaagucacgcuuucuucucucgucuauuuguuccauuuuaccuuccugcacuauuuccucaaagcacagcugauuaauucaugggcuaaaugacucaucucauucccuaaacuuucuuuuauauaaauauaauccuccuaguuuuugcugucugacauuuucauacuuaacuaaaaucagagcaaagaauauacacauaaaagaagcacaaaacccaaauauaagaucauuuaacuauuuggauuuuuuggacaguauuuuccacuaaagaugauguagucuuuccugaguugccucauuauaaaccaacauuccauucaaauugccuuggaauuuauuagcauauugaauuauagcacaugaccugaaaacauccaaauuauaucuuaguagaaggcaugugguacagucacaaaagagaaugagauggggagucuagaagacuuagcuucuagguguagaaccuaagucucccucauaccuugcucccagauggaggguaaaguguuucuugugcuaaaacgucaacccagaaaugcuaaacuuuaaccaguauucuuagucuggauuccuaauguauuucguacagaagacuugauccuauguaaguaaauaaaucucuauuaauaauauuugguggugccguccaucuauauauugcuuuauuuggccauucaucuacuuauuauuaacucagcagggcauucaaugaauuccauuuucccaguaacaucccccuuccuccgaauuguuuggggaagaccacuucuaaauacacacaaccaaagcaacacuccaaaacuugacauaggacagauaccacagucuaccgcauagacccuuugguaauauauuaguccuguuguuuccauaaacuauuaaaugucccugaaauuucuauuuugucauuuuuaacuauaacuucuggucuguuacaccuaccagcaaugaaaaugcuuuguccggcacaaaucuugaacuucacuaugaaaaauguggccaccaucuacauggagaaggcuucagucuucucucagacacgcuaucucaguucuggaguaaccuugggcaugccacucaccugcaaaauuaaacaacugcacauggaccuaaggccuaaacuaucaggcuggguucaaugagagaaagcagcagauucuaucuuggcgauuaggcuuugagcuauuggagggcaugacccauuucguaaucauuucugcagaacaaucaaacagaggauaagccaagcugcuuaccauguuuuggguuguguucuugcccagaacacaacugaaaggaauauauauauauauauauauauauauauauauauauagagagagagagagagagagagagagagagagagagacagacagacagacagacagacagagagagacuauguguauauaaauggacuauauauauauaaaaccauauacauauaguucaguaaucauaaccuaugcuaauuuucucuacuacugaucuauuuaguccuugcuguuucccggaccuuucuaaugcccuuucuucuucauaucccuucggauuuuaaggagcauuuuccauucucuuuuuuacuaaaauucacccagcaugugccuguagaacacuuaaugauucuuauugugugccagacacugggcuugggucuggggauucaaagguaauuaauaugugacucuugcucuggaguaacucaguuccaagauaagcagacaaacgaguagaaauauauacaccaacucaaauacucguguggauaagaggaugcuacagcuauuuucuuuccauuuauucuaauccaaguagacagugcucagcauacaaagagcauacuuacaaacaacccaaacccacaaacgccauaauucccucucaacugggggccuguggcucccuggcuguuacucacaaagacccuaguggguccagaaguucaggcagguugcugagaaagaacaaaugaagaggucugacccacgggcagacacaccagcaaguucugucugccaaaggcauggcccugcccccaaauauugucccugaaaggaaaaucauguguuuuguagcuccaggcuccacugcuugaaauuuccccaauuaaagauucauccuaaggguuaaagggauaagagucaugagcuuuggcucacccauauuacuucuuuccugccaugugguagagaccauugacuaaaggaaacaggagagugguuuggagguggggaagggaagggugggaagaugaacaauuaugaauucacuauauauuaggacaggccugggggagaugccccagugagaccagaagacaucagaaggauggagaaagaaaggugaaaacuaguacgaacuuccuauuucaaauauugccaugacuggccuauuaccaaaaguaugccaauucuuucuccuucuguuuccauccuguauaacacaguggcauguccucaaaacacagaacuugaucucacauuaaucagauugauuauuuuucgcuggaaaaugcucuggguuucaaacaacaaacuccuaaaacauaaaguauuccuagauuggggacuaccuaugaguuacuuuucucuauugagaaaaauaaauuacuauuuaauaauuaugagaaaucugcuuuauguaagaagucauaaauuucuacaaauggacaugugggcuaaaaaucaacuaaauuucacaauuacaaaucacuucucaagucuccuaaguucaguaagguuuuggauaccaucaguuuuucaaguggaucccuacccauacaaauauagauauuaaugagcauccauuuugaccauggaaaaaccuacauuaugcuacugguacaauaaauuguacaccagaucaaaaguucuuugagggcaggggccuuaccaaagucauauuuggaacccagaaagugcccuggcacauuaauaaucacguauaauguggcagaauauauuaauucugugagugcucaguaaaugucauugaaugauauaagaaaggaaggacagccuuuauauuauauucaucauaaacacuggacugaauauaagaccuucaacauccacuuguacuacaaaugaucagcaccucuuccauguuuacucagaaccucucuuucauagcgcaaagcagguaaguuauuuucuuuggucugguuuguuuuuucaggaaaguccccucuuggcauuuuguucugcgccucaauuuucugugcuccuacuaucaccugaccuccuggaggccauuaaccauccugaucuugugucaauggaauauuuuccuccagagggggaaaaauauuucggauccagauggcucccuaauauuguguccuuuuuaguuuaaagaaauuuuuauaacaugccagcucauaaaacugggcaaacaaauuucuagaacaaaaccgcugagcucacuuuugugugaaaucaaaggaauugauaaugagccagaaucuucccgauaaacugccuuacauguaaacggagauuagauugcuguuugaccuggcuuuaucgcccuuucuuuaaucacagcguauuugauauucucuuccuugaaugaacucauuuucauaguagcuuuggucacaagauuaaagaaucgcuaacuaauuguuccaaauaagcagagcaauucucucugacucugccucgggcucccugcagugaaguccgcugccugaucuuccgaccacgggaacuucaagccugaccccugcagguagauaacugaaaugcacaccucuaaucagauccuggucuuucaaagucccaucaaguucugaaaauaaaaacguucauacuuaguacaauagggauauugaugauauuuauaugauauauuguacuuccuuuucauuguauaaauugcuuuuggaaaguagcaaccacuuguuuaaaaauaauuaaauuacgucugcaagauacucuggugcgcuuagccauuacuucuuuuugccuauugagaaaaauccaaaugauuugauugaacugggauccucaaaucauguggguuaaaaauguccugauuugccccuaccuuuuucuaaucaaacaaauuacucuuuguccaguaacuaaauccccuccuuucaccaacgcacagcccagguugccauagcuaccuuggaugucuauuuaccacacaaacgaucaaagccaggagacauccacauaugcacuuagccuuaaaacuugcuggaaugucuguggauaacaugcaacuaccaauuaacggauuugcuuguagccuaugcggucuacagccaagcgaacuaaaaacaugacucaaaaaaauuauuucaaaaugaccaacaaggaucuuuaaacugacagcaagucuuaugauuauaacauuugcugaaagagagauagcagagaagaaauuaaaauuuuaacauauguugaagacacugagcucuauaaaccaugugcaaaaacuuaaaacaucuguugaaagggaacauuucucagaugcauauuuaaaauuccaguuaguuacuguaucuuucuauuagauuucauaaaagcugccugaucucaauguugggagaaaugagaacagaacugccuuuugaacuguuaagagucuggacuuucaaaugaaggaaaccauacaacauacuugggacacaauauacuugccaguuacagaaugauaagaaaaagaaugucguaagagagauucuguuuuaaucccuagaaugccauuugagauccuaaaccugcacagguagucuuucugggugggugaguauucauccccagacuugccccuaacuugcugugucucuuuauacuuaaccuuucucugccuucgucucaccauuuguucaaugaggaucaaauugccaccucauucucuccuggggauguggcagagaauaaauagaucguguuuguaaaggacuuucuaauccucagaggaaagauuaauacgaagacuuucauuauuaagccagauguccuugggcauuuuaauuccaaucuaaagaaugcagaacgggcuaaccaaacagauucacggcuuccuugaaacagcagcauccuggccuugcaagaauuuagcagcuacgugacuuacuuuguuuuaguagaucagaaauacaucaugcaccuucuucccuuagaguuuuuuuucuaaaguuaucaggauguuaaaaacacaaaauaugucuaguaggcaauuuugccuagagaaucugauuuuucccccagcucaagaaugaacuauuuguucuucuuguguguagggacaauggguggcuugccauguggggaggauauaugcaguugcgggaaugccacaggcaaaccuguuguuuucggccaggcuucuagaacagguggccaugcuuuuccuuuugccugggaacagagcaaauuccuucucaaggaagguucauaaaaguuucccguuuaugaucagagggcagagacagguuggcacauauuuuaaaauuacuuccugaucaaggugaaucagauuuacacuuuucuuuggccuaacucagccguggccuuaggaacccucaaagaauacuauccuucuacaccugaagugguggcuucaggaauguuccuuuucugccaaccuggcagaagcccaaaccccucugaaucuuauagcuaggcaaacagccuucuaauucugcgggcaauuucuggcuacccagaauuucuggcuaucaguggcaggcaggggucucuucugggcugccacaccaguguacaacauuugugcagcccuagggacagaucacucaucagcaaagagauccaauuucauugcugagcugaugacacacaggucuguuugauaguuaacccuguaaauccagcuggagcugccgggcugagaugacaaauuggcuggugaauucgacucacccugccuggaugcaacagucagguuuccccaagagaaacucaaauaaaguagggauuaacccaugccaauaacacugccaucucauuccucccuacauucuuguucugacugcaguggaacaacaugcuagauucuggaaacuguccucguucuuuggaugaacaaugauccugucucucuccuucaucuccuccccuguuccaucccacccucuuucaaaguucugaacaggccaaaaaaauuaguagacauacguagcugugagaugaaaaguugcccauucauuaaauaacuaaggaguucacuauauguguacuuguaccccuaaaauuucaauacugggcuguuuuccaacuucacguaaaugccacaacaaacuaggcaugggaaaaaccauuccaagcugggggaagcaaaccuuaggcauaaggcacggagacugccaugguuccugaggaauugugugggaacagggauucuggaaauugagcucagacaccaccgaggagaggacagguggcucugcacaggaucaaauaacuucuuuguuccagcuaaggaccuuugucaaaaauguuuugcguuccucuuuuuccuuuucaauccuuuccaauuacccuucuccuuccuuuuccucaucccacuuuaguagacauuaaaaguaugagguuggacugugaguuugcagaacuuaaagacguccuccccacagucccuaccaaggcaagggcaauucauugcaagcagacggcacuugcuccuccgcaaguguuuuucugcacucacugaaacuugccaagccugcuugcugagcgaacaagcgagggggcaagaaggcggaggguuugcgcugaccauucgaagggggcucugcuucaucucccaaggcugugggaaagggacagaaaguucgaaaccccuccccugcgcucuuaaauggaaagcucacuucccccaaagugugcaggguggcgagcacccaacccacuuagaagaaaaagugaagagcuuuuccgguugcgauacagaugcuaacuuucccauccagauuuauucagagcugguaaaagcaauagcauuccucuugaaaucccugcccuuccaagccuauuggcauguuuuuccagccuuguuuucuccuuauaugaguauuguucuugauauuuaaauauugacauaaaauucuuccauaacuuugauugaguuguaaaucacacccucuccuuggcuuccuacauccacuuuuucuuuccuuuucuugcuuaacagcaaagcuauaaaccucuuccuggacugauaaggaauuuuaucaucaugccccagagccacagaagaagcuguugguuuagaauucuuuucaaagacucauuuaaguaaucccccagcccuuucuccgcucacuacuuucagggcugccuucucacguccagaagcaauacaguuuccaaacugcuagaacagaaaaacaaauuugcauuuuucuggaaggacugucugugcucauuucaagcugguuccgccuucuccgccagaaacacaguaagugcucagaaugcgaaaccaaaaugagauaagaggccccgugaaauucuuuuucaggacauucagcugucuuuauucuagcccaaagcauaggguagaggcacuaaaagcucgagauacauccugcacgauacauuccagcggccgcaaacuggaauugauuuacauauauucuacaaacugcuuguaagcccuuuacaacgacugccugacaucaaccacaauuagaggcaaaagugggggcggguggcgaggaccagaccgggguggcucagguaaaaugugcuucuuugguugucuuaggaaaaugcagccccgucuuuccgccaaacgcaucgacuacggccaggcgccugcuaacccagcaagcucuccgcaguaacacgucgcaggggucccgggcggcgcccgcccccuccgccgccagcgcaaccgccugagcuuaccugccucauguuuagaaucccaugacccauccggcagggagcgagcugcaucggagcccgcgucgcagucuucagagcggaaacaccgaacccgacaggagcccgcaagacaaaagcaacccggcgaaaucuacgggcagcaaagagcacguuuucguccucuuuuucuuugaucuguugcuacacgcacucugcucgagacaaugucaaguuucucaaccuuuucucccccagccuaugaaaagucggucgcagggaagcgaggaccgccuggcucuuauuucaaaucaguucucagagacguuguagguggcuggcuugggccgcggaggagcuucgccaauc

SEQ ID NO: 192874 - RNA, 83637 nt, Homo sapiens
ucauuggaacauacacuuuauuauguuacaaaaacaaaaauccccacugaaacacagcuaaaaaaauaacacauuuucccaagauuacauuaccaaaaacaguuguuaugucauuggagggcguccauuaauacugcucggagaagcacgaucuuacacgaaaaacacggaugggauuucguuuucaccuuaaagcauuaaagugcuuuaacugguaacagaggaguggauguuugugcguuggagacacugacuguucugagugacaaguggcucugugccaggauacugcgggucgggcuccuggguacagcaagggcuucccagcagcccaggccuggugggaacgcugggggaaugggggagagucgcuguuucugaccagagcgacuuggacagaugugagcugaccugccuggcgagcuccuucugccuugccucucugagcagacucaggaccacugccugucccccuuggccccaggagugccagcagccucccuccaaccccugcacugcugggaaaaccauccgccuucaagauuuauuuguugauuuguuuaguuuuauaaaaacauaucacuuaaaggauucuuguuccugggaauuugcauuuucuccugaccacggcgaagucucaacucugucuacuuucacagcugcuucuccagugcaaggaggcugcaugggcucccuagacaggugcagcuggggccaucuggcugcuccguguucuggccggcuuccuuggacaucuggcugggguuccagugacagcugccccugggccucucccagcccccccagcccccccagcccuucccaggagcacacuacaggggcucuugggacagccucacuggacucaggguggacagguaacguaccuaagaaacaaaucaacaagcccucuggaacugaagcacaucugcgcugggcugaggaaccccgggugucaggaugggcccccgcggcuccugaaguggaacaugggggaagagugggggcuucaggagguggccucggguagcaggugcccagcccccaagagauggguguggugccuggggcaugggucuuagccuuucuggucucagcuuccucaucuacaaaauggcaauaagauggagagcugaggugacaugcagcugggguggcugcgccacccugggaaagccccgagucugcugcugcugccgcuacugacugaugcccugggcgugggcaccuuucuagggagauggaacccuagaagcuaagcggccagagcuuccugcccuucagcuggaaggagccggaaggagcuggaaggaagggccaggcccucgcccuggcugcagccagauccccugagagccgacagccccguuccugcugcccccacaagcgugcacccaggcgacugugcugucagcggcccccggggagguggacggugggagagggaugccugcgucuucguagaccagguaccugcggcaacaccagucgcugcuuuuaaauaaggggaggcuggugacggugaugccacuuagcaagauggaguccugaucuggggaugggggcugugucuaaccuugcugugcccugaggggcuuaacugcuuuuucugggagauguuaguaggggaagcuccuagcccuuaggaccacacauacccuaggcaggggguguggagcuggccgugccagaaggggccaggcagccugcacucuggguggugucucggcuugcgugggugagggcucccauuggcccaccugccugcaaugaagggccucgucacacccgugaggccccccaggggcuccgguucccugcccugaagcugugcuccgggacggucaagguucggccaccaaggcucaggcugcuccucguggauggagguggccccagaaagggccugugcagacucugucuccccggggccuacuaacucccuggggugcuccacgaaggccuagaccccccuacaccuaccucagucuguucccugacugccaccgccuagaaaggaaagcaaugcccuguggaccuugcagugcuagagaagguggccguggcaagggaggagcugcucccauggcagagcauuccugcagauuugccuggauuugcccuuccugggguucccucuaggcuuccuccccacccggccuuccugggaacaagucccgcccaccuggcuucucacucagcuuccucagccuggcucaugggcgcuagguugaacuccaaagagaaugcugagaaagaaaguuaaaaaaaaaaaaaaaaaagcugacccaccauguagaaaaggguaucauuuuaucaaauauugacaauuuccaguccucuaaggacaggcugucccuuucugcugagggguccccgaggagaggcgacuguggccaggcugaggggcacuggcugaggcgguaccacaugcuuccccgcgccugggggggguugcgcccuccccaguuuucuccaauuucagcaacacugugguuguuguuaggggcaggaaggaggcgguccugcagaauacagcgugcugggggcagaggccagucccaaguccagcagagagaguccccagcccccggcgcgggcaagacgcaguuagggacauucccugaaaauacacugguguuucagacacagucacuuggcugcucacuacuauccagaaccaaaagaugucgcaaaauacuuuuuggcaguccaucagcaaagaggauccuuuccuuuggaaggaccucgccugguugggagaugacagucucuaggaugaagccuggaagucggagccgacgcugcgguccccacccacgccugccauggagcacgccggggcaguggcagggcugagagugggccagcccccgccccacaagcccagcacuagggcagcuccagaagguucugcaggugacucaggcuguccacaggcggcuucgguggcugggccuuuccuggggccugugaggugccuggggaugggccggaccuugccuuuccccgggcacagcccgaagguccugccuccugaggcaguuuuggacacacaggaaggagaggggaggcagcuugggucucugggcgguggcgcaggcugcagccaggcgaggcccucaguggaucucggccuccgugaacuccuccuugaugggcugcuugcgggccuugcagucgggcaggucgaagccgaaguccgcccacucgucagggccgccgccugggccgccgcgguuggggauggugaugguguggcgcacgcggaagugcacggccuccaugacccgcuggcgcugcaguuccccugagccgccgauggagaugguggccgcguugcuagagcggagcagcugcugcgcggugcuguagucguggcccugcuucagguccugcaggccccgccagauggucaugcgguacugcucggggaucuucagggcccccagguccugcgagaggccggcgcauuaggggcagggggcaguggagcagggagagcagggggggucgcccugggccuggaggucuggccacaccacacccuggccccuacacccccaaccagaguaggcaggagacgggggagggggagagcccaccagagucacuccuggccugugcggggccugggcccugaccugggaguguuagacauggagcccccugagcaucuaccuggcccugggggaggaacugccucccagccucagggcagggcccuccuuggucuccaugucccugcccccuggaguggacccccagcucaucccugagcucccaacacccucugggcaccacaccaagcacacacaucacucaggggaggcaaggguuaacgugaccuggagcuggcucagcgugggucacuggggacagguugcggggagggcgguuaguggacacagacgcggccacucucugcacgagggacaguuaggcugagcagcuggcccuagcucgcacugacccucaucucugucugcagccccaggcuggggauggucugggacgggccuuggaccugggccgcggcacuggcuggggggcagguucccaccagagggcuugcucuuccuugacugacggugcccugugguucacaccguccuaggcuaccagcaggcuuuguacuccacuagucucuaacccaaagacaagccguggcuguuuaaucauggugccugcagucagcugccaugggugccaagagcuguguggccucgggccaggugcuugccuucccuagguccccuuuccugucuguguaaauggcgcugaccucucuguaaauggcacugaacuggacugacucccucggggccuuacauucuucuguucuuugugccuuggaaacagcccauccccuaaaaucaaaggcacacuggcugcugggaguccaaaaaggcucaaaugaccaguucagcauccggaggccugggccugugucccgcgccaccagccacgugccuggcugcaucugccuaagcucucaagagucaaaucaucgcaucugcuugcccgugggaaaggguuuccaaguuucccagccacgagagcaaggaagagaaggcucuuugcccuccggacaggggccccuccagcuacugccucugcagagcgggguccacccgggcguuaccucaauggucagguucugcaggugguaaaugcucuguaacccuugggaggugaaauacucgaugcaguuuggacaccccaauccuguuaaaaaacugcagagagaauuugagaaaggaagcagcauuagcuuccgagcacagggcugcgcgagcccccaucucugagaguggccuggcuggggcggagacugccgcugucuccgaaggguggcuccagcccacagguggccacggcaucccucagggaggggacgugcucagcuggggacaggucaguggaggaccccggcuuuuugugcuuuuccucuaaguggaccauuuccccagcaucugcagaugcuccuggccugacugcccccgcccgccugucugauccaggguugcgaguggugagcacacaggguggggcagggcagcugacauggccagaaggacagaggugaacagacagggugacagcacaugcucaggcccucggcagcccacgcaccugacgaggcuggggucggcgugguagggggguggcggagugcagugggaccccgagaccauggacugggcgcuguggcugcugcucaucucgccguuggcuggcacugcguggccaugguuguugagcaucccggggccugggugagaggcagguggggccaucagggcagccaggcugggcauccaggugcagccuccacccaggcuccagacaccucuggacaccagggagccaucccaaggccuggcgaugugacgcugggcaucaccccugccagcuagaggcuugagcaagggcugaacaccuggggcccugucuccucgccccgccuaguagggacgggggugaccgugcguacggggcacuggguuguaagggcaaucgcagcuggcacuggagugcuggccacaucccagggccucaggaaacaccugggggugcuugcucacggcacugggaacaugcuugguccugcccacaugaggaccuuccaggggaagggggcccaaacucuauccaauggagcccccggcuugugcuggggccccugaugaggucuugcaccauuuauuccucacaaggagugagccugguacuucuguggccauuugcugauggggaaacaggcuguguaauguuaagagccuuccccaagcucccucgccugccaagaggcagugcaugcauguggguuccacgcucuuaaccacgccccccuccaccucccacagccaggagugggcagagagggcuauccguggcugcgccuccugcccagaggguggaaccgcuggaaggagccagccacagagacaccugcccugggucccgagcugggugguguguccugagcuaggcgcccccagugggccuccccgcccugcccgugggcccgcacugcccaagggacucacccacgggccccagguuggguguagcugccgaacugugcgggggaggcuggcccaccagcugguugacggagggcagcuuguucaugcccccgugcaccuuguucaugggcgagaggaccggcccguaggacgggggcuguaggugacuccugcucagaagcaacggcucgcaugggugggaagcaaggcagccucgugcccaccgaccacccaugcccgugaugcccccaugcugcgaauggguggagccucugaugucagagaguggcuucauccucccccagccucccuguccccaaccauggccaugcacggccacugggccugcgccugagaaggacacuggccauggcggggccgggaggcagggggaugaccugugccacuggaaucggacucuggucuuggugggucauggucacucuggccaccccuccuggccuuuccacucagcagacauuuacaaggccccucaguggcagaggcauagcaagggccaugacccagggucccagggcagccccaagugcuagaaggcuuccuggaggaggagauguggggugggcucugcucuggacccugcugccugucccuggcagaugaugccuucuggagggguuucugguccuccuggccuucuccugggggguuaagccauguccuccuuccccacacugauggugggcuagggcugacucacggccucuguaggagcugcugcugcugccgauaggaguccaccaguggcugcggcaccaacuccaucagcuccaggcucucuuucagcuucaucaggaucucaaaguucucccggccucgcaccugagcacagaggagcagaucucugcccacgugccccagacccccacgggagggggguggccgcagccucaggaggaccugggcuuggcaaagcaucuguccuuucuggggguuccccagcaccccagaggcucaggauccccugaucuucuuuccucuucccaagaagcaggucuaaccagagccccugacucagugggcagguauccuguccccaagaaccaugccugcuccuuguggcccccaagccucccucuuccuccccuaccaacagauacuggguuuuuagaaaccaagucugucucucucugucucucugucucucucucucucuuucuuucgacagcgucuugcucugucgccuaggcuagagugcaguggcaucaucauagcucgcugcagccuuggacuccugggcucaggcgauccuccugcccucaggugauccuccugccucagucuucugaguagcugggacugcagcugcacgccaccaccacgcccagcuaauuuuuguagagauggguucucaccauguugcccacuuuggucucaaacuccugggcucaagugauccacccgccucagccucccaaaaugccgggauuacaggcaugagccacugaccccaacuggggcucauucuggagcucaaaaaacagaaaguucacaucauggaagaugacucccagccaagccugugccgauuuaauucaccuguuggaggccacaugugagaggcacacucaugggggcuggccguggccacggguccuggccaacguuaggguccuggauucuugcugaacuucuacccugguggcacuccgcaccacccuaccugugcuauguacacauggcuucauuguaaauggcaugacgcuggguuuuugggacugaggggacucucaggaaugcccugcaguuggguccugcuggucuggcucuugcaagcagguucugcccucuggacccucucacacagggcugggcuccucccgcccccuccaccauggucuccagagucccuccccauggcccagccugggcucagcagacgacagaggugaggcaggucucccggcugccgugcaggagcacacacucaccugaagguaguacguguccucgucuccaugccgccgcuucuucacaccggcaccaagggcggggacggcaggggggcucugcuugaaggcuggaaggccaggcagggcaggcggggugagcaggcaggaccagagggugaggccuccuuccgggaggagggagaccugccccacccuuggggccaaucgauucuccagguggguccgguggugagcaacccacagggacgggcaaaccugcggugccacccaggccucugaggugcccuuggcccaggacaagcgacuuauaugggggcugcucucaggcuccgucagggaggagucugggcguggggggccguucagggacuggcccugucccugggacgcgggcucacauuguguccugccaauguguccccuucuccucccacacgcguccaguuccccuggccggccgcucaccacgcuugcuggcggccccguucuuggcggagcucucguucagggccugcugcucccgguagugguccucaucagcuuuucggucgcggccaggacaggcgcagaugcggcccucaaaggaccggcggcccagcaccugcccacugucgggugggcacagccagaauugugagcucaacccugcccacccucaaccugcccaccuuccccacccaccucggacccugcaggaccggccuugagagcccucggucaccacagagcacccagugccggcagcgaguguucccgcuagagggagucagaggcucaaagcugugaggcugcccugagaccucgccggggacucccaccucccuccggaggcccagcuugugcccaggcaggcccugcaggccagggggcgguuccuuccuccagcagcacaccccaaagucucuuccccaagcuagccuuggccugcaggucuccaugacagcuccccuucucccccggccgugccugcccagcccugucccaccuccaccccgugugcccgggacucacucccgcaucuccagggugaugaugaugaggaugggccgccgguucaugcccccuacacagcugcuguuacacaugaaguuguacaggaugguggugaauuccguccccaccugcacaugggggagcagggagaggggcuagcaucagcacgcagccccaauccacuaagguggcagcccccagcuccaugucugguccuggcuccacguaggcagggggaugcccugcucuauaguuguugccauuuguauaucuguccacucauucauccauccaccaacccaccccauccauccauccauccguccauccauccauccaucgaacccauuuaucuauucauccauccauccauccauccauccaccaaccccauccauccacccacccaucuauccauccauccauccacucccccauuuauuaucuacccauccauccaccuacccauccauucaauauccauccaugcauccauccaccaaccccauccauccacgaaccccauccauccacccaccccauccaaccauccauccacccacccauccauucaauaucaaucaauccauccauccauccaccccauccauccacccacccgucuauccaugcauccauccaccccauccauccauccauccacucccccacuuauuaucuacccauccauccaccuacccauccauucaauauccauccauccauucauccaccaaccccauccauccacccacccauccauucaauaucaauccauccauccacccauccacccacccacacguccacccccaacacccaccccauccauccauccauccauccacucccccauuuauuaucuacccaucuauccacccacccauccauucaauaucaacccauccauucauccauccacccauccacccacuccauccauccauccauccacccacccacccacacauccaccccccacacccaccucauccauccauccuauccauccauccauccacccacccaccccauucauccauccauccacuccccccauuuauuaucuauccauccauccaaccauccauccacccacccauccauucaauaucaauaaauccauccauccauccacccacccacccauucaauaucaauaaauccauccauccacccacccacccacccacuccauccauccacccacacauccacccccacacccaccccauccauccacccaucccauccauccauccacccauccaccccauccauccauccacuccccccauuaucuguccauccauccaaccauccauucacccacccauccauucaauaucagucaauccauccauccauccacccacccacccacuccauccauccacucacccacccacauauccaccccccacacccaccccauccauccauccaucauccuauccauccauccauccacccccccaccccauccauccauccacucccccauuuauuaucuauccauccaucuaaacauccauccacccacucauccauucaacaauaucagucuauccauccauccauccacccaccccaucuacccaucccucuacccacccauccauucaacaucccucuacccaaccauccauucacccacccacccauccauccauucacccacccaccccauccauccgcccacccuauucauccauccguccacccacccauccauucacccauucaccacuccauccauucauccacucacccacccaccccauuuauccauccauccauccacccaccuaccuacccauccauccauucauccaccccacccacccccauccauccacccauccacccacucaccccauccagccacccauucaugaagaucacugaaccccaagcacugggcugguucuggguucugggagggcucagaccuggucucugcucucagagaagcacagaguccuguggucuguuugccccaaccuucuccccugacacaggcuggaggucaagcccagaugcugggugugagugugccugcacagauuuuguggcccuacguguguguugcaugcugcgggcucaccugggcagaaagaggaaccagagcuguccccagcgaacccacccccagcacacuccuguuucccagggauuuugcaguacagcugagacaugaaccaaaacucuuuuuuuuuuuuuugagacggagucucucucugucccccaggcuggagugcaauggcgcgaucuuggcucacugcaacuucugccucccggguucaagcgauucucuugccucagccucccaaguagcuggaauuacaggcaugcgccacgaggcucggcuaacuuuuguguuuuuaguacagacaggguuucgcccugugggccaggcuggucuugaacuccuaaccucaagugauccacccgccuuggccucccaaagugcuuggauuacaggcgugagccacugcgcccagccaugaaccaaaaccguugaucaaugaguguccccagaccacaaugugggcaguuuucaugucacccuggggacaaauacaaaagcuauuagggguuugggaaaaucuuggccuuucucagaacugcugucacacggcagccaccagggggcgauagagcucugccuuccuggcaggccuaggcaggugagggugggacauggguuucagggagcccucccgggcccugguucugcugacauaaggggcugcucuuagaggauggugggauggggacgucgaagggggccuggguacaggguagaggcuuguggaggaccuggagacuggguacaggagucugggguguccugggggucugguacagggauggggaccuggugggggaggcuggggcuggguacagcauggagccuggucucagaaccagguacagggaaggcagaggccugccauugccugccuuccccugggggccugguacccacuccucaccuccuguucugccccugccccaccaucccgcaguaacuucaaacccucuguuucccccuaccccagccuuucacaccaguugggccccacaucagcuccagaauugugucccagaaacuuaugcugccuuugggccaaaagucaaagcccccagccucuccguguccccuccccuccagccuauaugccccccaguccccugcaccccccacccacguggugcccagcggggccucccggcucuccacccugcugaccagccucagccuccugcaggccaccucuccugggccccuggccuggccuaggagucuuuccaccaucccucaacccccuuuguagaauuugccaccccuucaggcgcuguugcugguuugguucugccccagccaauccagggucuaaaugggcggggaccuccccaucucccaaaucccugugucugggagccccaggccggaaccaguguugggcaccaacagagggcaaggcugaagacccacuccccacuauggagcugggcacacugaggccccgagagugcccgaggcggauguggggacagagcagcagugugcacaguggggcgggugugggugaggaaggagccgccgacacagacuuaucacagagcagggagcccuggacagaugccgacaggacaggcaggcagaucagccaacugaggagggacaggggcugccucaggggaccccucccccgacccguacagcugacugcagggcccugggcacagccuggcuccuggccuaccugugguggcucauagggcaccacgacgcucugccugccggugacagggucauccacauacugcgagagauuauugccuuccacgcggaugagguggcuggcuggagcagacuguccugccgggaggggucgacacuucagagaggugcauagaggugcccaccccugugcuaggugcagagaggugcccagcccugugccggguucaaagggugcccagccccaugucaggugcagagagguacccagccccgugccagguucaaagaagugcccagccccaugucaggugcagagaggugcuggccccgugccaggcacagagaggugcccagcucugugccaccugcaaaggugcccaccccuguuaggugcagaggugcccagcccagugccaggugcagagaggugcccagcugcaugccaggugcagagaggugcccaccccggugucaggugcagagaugcccagccccaugccagaugcagaggugcccagcccugugccaggcacagagagguguccagccccaugccaggugcagagaggugcccacuccugugcuaggugcagaggugcccacccugugccaggugcaaagaggugcccagccccaugccaggugcagagaggugcccggccccaugccaggugcccaccucugugucacaugcagagaggugcccagucccaugccaggugaagaaaggugcccagccccaugccaggugaagagaggugcccagcccugugccaggugcagagaggugcccaccccugugccaggugcagagaggcgcccagcugugccaggugcaucgcagcagaacugagaccaccaggcccaguccugugggcuuccaggugaggcucaggccagcuggcagcccuugugcucugggggugccugcccaguggcucugcccccugauucuccugcuaauccuugggguagcccguaggcccugccaggcacacuggagagaggggcuaugacucauaggaucucuggggccccagaaggccgcugccccucagacucugcccagaccacuugccccugcccaggagcaugggcccccccaggucccacucagaacugggaaaaugggggcugguggaggcacugaaagcccuccgcaggggaauggcuaagcccaugcugucagccccacucucucccaguuaggcagcccccggcugugcuguccgggaugcugggcaaagugccaccgugggcagaggagcugggggcccucaccuucguugaagucccucccgagcucgugguuggggcagcguuucacgacgucggucacgugcuccgcuuucuuguaaacaggcauggcccggauggcggugccuggggguggcgggguggacaccuugaucuggauggggcaugucuuggcgaucuggcaguagaguuucuucaagagcggggaguacuggagugggggagagggagcgggugagaccaguggucccaacugcaccccuguccaggccaccccccauugggagccacguccuccccaugggugccccuuccacaacccccagaugaagacugccccaagcagccccucugcugaaucccuccaggugucuguccuuugaggcgugaauccaggcacagcugcccuggcacccacuccacagccaucgggucauuugggcuccaugacagcaggggugugagugccgguggcagucaggcagagaggcuuuagguuuauggauggggacaagaaaggccaggagagcaagaaggggcugcuggagagugagggcgggaacgggggcugggagccaggccuguggaagccaugucccugacugcggcauuuugaagagguggguuugcagcauugaaucuguuuuuaagaccagagcuaggcuucucuggcauuugcacagagcaagugguuaaugugugaugggcugguugcccacuaugcauucaagcuuccauagagagcucucuggguuggugugaaggccucucauggccucagcagcccuggugacucugacacccucuccugcuggggccaccaagucugagcagccgagcuguguggcuuggucuuggccacucugggggccccucugggcucacagccccaguauccccagcuugggacucgaggagcuaauaggucugucuggagcuggcgugggcccugcugcaggaggacuggaugacacccuuccugagccagccccugcagaggccuccagcuucuuugccucacagggcccggcugcccaucugaggacccaggccggcucucaugaguucuaaaagugaccccgcugaggccgcugcaggggcguccacucacuuccaagcuggcugauuucccaagcgucuggcuccuggucaccugcugggaguccucaugcucucuccccaaagggccaucaggaaugauccccagucucaggcucagagaaugacuucugcugccaccccaugcccucugugccccucaccagcccccgaugacucagaaucacaagucacugcagccgcaagugcccuggagaaugucccaucgcacuccaccguggaacaguuggggaaacugaggucagagacagggagcuacuggcagaaccagggaagcugcagguggagucuucccuuugccaaggaaguuagggggcccugacccccugacccccacuggccaccaguacugccucucuggccaucaagggacaugaggggcucucaggagccacauagguccuuggcaggugcaggcacacgaaaagccaggaaggaaaaaggaaagagacaggggagauggagcugacggaggcugcgagccaugguggguggggccuggguccccggcacccugagugcccuuguuccugugcagugggagcgguccccucucuggugagcuacuugggcuccccgaaugagacccagccaggaacgcuggucugucccugccaugggugugagggggcuggagggacaaguggaaggggguccuucaguggccuccucaggaugggaauuggauaccaaagagcuggccccuccuagguccuccguccaccuggagccccuggagccagaguggcuccacugccccugccugcgacccccaccuugggcacagggccuuaggcaggaagccgcccauccccaguccuguuuaaaacacaggaaggaaccaucaugcacagcccugcaggggaggcugggcgcuguuuagaaaagcaggaaacgggcugagggcgguggcucacgccuguaaucccagcacuuugggaggccaaggcaggcagcugaggucaggaguucgaccagccuggccaauauggugaaacccugucucuaccaaaaauacaaauauuagccaggcaagguggcgggcgccuguagucccagcuacucaggaagcugaggcaggaggcaggagaaucgcuugaacucgggagguggagguugcagugagccgagaucgcaccauugcacuccagccugggugacaaagugagaauccgucacacacacacacacacacacacacacacacacacacacacacacaaagagaaaaaaagaaaagcagaaacagccuugcagagcuagcagcccaccccugugcgggcgccugcccuggacugucggagcugcaggcuugggcacagcgggaaguacagcagucuccuuguuguggggucagucuggcuucccuggaggugaccacugauguacaguguccccaccauuacaaaugcccccuuugcuccccacagcaucacuuggaaggauaagcagguagcccugcccccagggcacaugggaacagcucgcagcacagacccucugggacucggacccucaggagacucagacagggagggcucuuggcccaaacuugcaguggccuguguccaggcacuggucucuuggacaaaggcccugccugaagcuacacaccacgccuggucuccaucugugcugguuggggacagaaggaggaggggccaggugguggcaggcucuugucugccagugccccgagcaggggagaggaacacagggccggcagccgugucgccaggcuucuccgaggccagggcagccugcagggcgagcugcccauugcugagcauuuauggagcaccucuugugugcagagcacacaggcccccuggaauucaggcaccuggcucugucccccucgucucuccucaguaacguguagcagauggagguacacaggugguacucaacaaaugccauccauccuagccgcucccuagggaaaccacagagcagggagggcgcggcagaccccccuugaaacagaccccggccgggguggcucaggucagagucucaggggcggcaaaaggagaagggccucugagguccggcccuguggguggcaguuuuggcuuugugcucgucagcugggaugccucuagccacugcacaagccucuccaccugcaucucugacucacugcguguccccugggaacacaguggccugcagguguuaguggcuacugcgcccucguuauucucagcaccaggugaggagguguugguugcggggggcuggagccacacaggccccgcuucccuacaguucccuuuccggggcugagucccccgaggcuucuuccacccuagugccacagcccauggccugagaugggggucauuagauccaccaaggagccccagacacucagggggaggggaggccgccugggcuccucagccaguuggacacagauggaguaaggcucugggugcaaccaagccugcgggcagaggccccggcagccgucgcucccugacagccccauggagucucaacagcgugagggguuucacagcuccugccuggccccugcagccccuccccuaggccccugccccagcacccccggccauaguccucugcggagccugagcucccgcccgccugggccucagggucagcagugcucccauuucgcagaccuaggcagcggccucucagcagcgcccugcugagcccgccccacucccucugggucuccgggcagggugaaguggcgauccuugcucuggaagcugcgugguggggcgucccaggccagggcgcuacgaagugggugcagggcccagugcgugcucccgucucugcacugucugagggacucccgucugcaagagguccugggggcccaggcgcggggagcacuguggaugccccgccccgccccgccccggggaggagcuugggcgcgccgggagcugucccugguacucggugcaggcggcggccggaccacccaccccgggaagugggggcucggacuggaguguggagcggccuagaacggacaggucuucgaccugggccaguggcggagggaggcccaggccucaggguggagagcaaggaggccccuguccucaggcgaugugagcacuucuccuccccucuggccaguaaggccaccaagguccugggccuggcucuccuccccacagguguccccagugcagugcucacauggccuuuggggcauacaugccuggcagaccucacccuggcacuaacuggaccccaggugcccagccgggccggagcuggguggccucggggaggaugucugugauguccccugcccuggcagcaucugggggugggugacacagguggccacaggagggaagggagcccugagagauccagguccuucuagaggguggcugagcccaggacggcuccagcgcucccccagcuccuuccuccugucuccccagcaggccucuaggcuucaggccugggcuuggcccuguggaaaacgggcaggaggaggaggacuccgguggagccuauucuauaggaaaggucacguggagacacuuccccuccgccgccccccuccugccuucuccuucccuagaaccgcuagauggauguguuucaacagauuccgagcugauaaaaucguauuuaucuucggcuguugacacggagccgccuggacuugccugcccagggugcgugcaccguccugcuugcaggaaaggguuugcccaaacgccacugugcccaucccuccccacgcugccggcuccucuccgacccuccucuccuuccccuccucccccgccccaguacaacaugggcccggccuggcugggagcccugggccuggcagggcuggugcgggggugggugaggggagggugcagcggggggcugcuaauuuccuugugcccgcuccucgcuccccggcagcugggugcccggcacgggcagguuugggcaggaggacagcggagaggugauaauaacuugucugucauuuuccugggacguguagcaucuugcaaaccgcaaauaccguuaaccagcgugggugaaucuguugcaacagauucuggaagauggggccugcagugggggcuuuuauuuuuuaaacgauuuuuuuuauugcucacuuuuauccaguucccuugcuugugugugcgucuguguguuuaggggugcaucucucuccucucugggguuacgggccucuuugagcccacccucugccaaggcccuggacccuuccucucccuagaaaagcuccuggggcugagccacagaacccuuuccauuaaauucguggguucacagauggacccccuaaaacacaugccugagccagggucaacagccuguggauuaggguccuccugggucccuuucuccuucugagagaggaaggguauccucagguggcagccacagggcccccuuggugacagcccccuucgugggaggcuguggccuucacuggugcacagucacugucgcccucagagagcugcugggagcacaggcugggcucugacagaugucagggaggccuggcaggaugucacagggcuggucccucccugccccagggaagccacuagccuggggagggggaaaggacacauguggcaaucgccccuguuucagaacaccuugguguuaagcuggggcucccauggucgaggcagugacggcucacucaccaggacauccacagcccaugggccaggcagaugagaggcccaagcgagcuucagaaugccugugaggccacagccagugccaggcccagcgcugcccaagaaaagaggcugcugugaaagagcuccuggcugggggggcugcaggagacagaugugucugcuggcacccccaugcuggccagccggggcucccaggccaggagcucuauggaggaugaaccagaggcagaaacauccucugcagaugccaagcgauccucagcccugacggaggccugcuagagccccagaggcuguggacaagaaacugcucacuggggagggcaggccaggggcaagugggaacccugaggagcugggcagucugccccaccacgaccuugagccauguccuaaacaggugagcaggagccacacgggggacucucaacggccuggaagcgcggcucccugggagacacugagugcacccagaccacaggagcuggagccugcucgauccucgucccaugcacggcugccucuagggaucuccauccugggcuaugaucgggguaggggagggaagcagguaugugcugagcccaggauagacuugguggcuuugucuccagugcauagugaaggcccagggguccaguaggagacgagggccacaggcagaggagauaagaggggccuaguguugggggaggcugcgaggcagcguuugcccaaggugucugccucuguugguguggagaccuggggagacagugagugcuguccaccugccagggaauggggcaccuggguccacccucauggccacauccacugcccacuggugccugcccugcgcggggcccucaccugaccuuggcccugggaggucaggcacugucacuccguuuagugacccaaaccugccugcuaagcugggguggaccagcacccagaccauagcugucugacccccaagcuccaucucccagcccuuugucacugcugggcuugacuuggguccuggggccuggggucggggucuaggcagagacccgccuuaagcaccccuggguuccaggaagacggcacugcagaggcgucaccccuggguuccaggaagacugggcacugcagaggcgucaccccggguuccagaaagacgguacuacagaggugucaggugggacaugggcuucuuaccccguggcuggacuuaagccccuuagggguaaggggaacaacagccaggggccucaccugcccugguccugcuggggaugggucuccauggacaauagagacugagacucacacagacugccuugugucuggcugggauuggguggcccagccuggacagcuccagccuccacuuugcugccgagaugcugugugaggagcucagggcccaguccccacccggucgccgcuguccugauucacugagaccgcgugcgggugcccuguggcugcuacuaucacugucacucugcccaagcccgggaaggaaugagcugcccaggcagggcgaggaacuccaucugcucuuauuccaggacccagguaccccaucuggggccuuggggacagaggggguggcagggcagugcccuggguccgcagagacaaaagcuggggcuugcagagggccccggaaugcccaccagcagcugccccuccgcucugaagacacagaguguucaaagcaccacacucagccucugcccugggccgggaccaagcgcaggguccucugcccgcaacuugcuuuuugacagcgccagcuggagggcccguugccaguagccuggccucuccuccggccucuggcaaggaccuagcuagcgggacugugggccaggcccuggagcugucccacgaggggcccagcaggcuggcaacaggccugcucugcucacugcagagagggccccuuaacuccuggggaggaagcccccaccauccuugcccccaccauccucacccccacccugacugguggcuuugaggagaagccaggauuaacccagccuuuugaggcccggcuuugucagcuguggggauuggaagggugccccagggucagugggugcccucugcucacaggacagucccggagucucuggccacagcuuccugggacagccuugggggcuggaauuggcagcagcuggagguggccggagacagcggagggaggggaguaagcuguggacauggugggguggucccucuucagcuuuuaagguaauaguuggcuagaaucuagguuuuugcuaaacuuuguaaaucuucauugaaaugccugggggaaggagaauuuuggccuccgaaucucugaccccugcagagaguggugucuccccaacgccaggugcaaggagcugggugccucgcuccaguggcauggcugggggagggguggguuugcaacccuugggguggcucugggcuuuagguaaucccccugugcgguuuccccaugggcucugacuucugccucacugaagccuggagugcuguuaccuucuccaaaagggucuuucugcccuaaaaugcccuguuccgcucacggccucugcagccccaucguaaccccuggcuguggacaccagccucggccgccacguaaucucugagccucacgcuguccgccuggagugcagagaagaugcuuuucuuuccagccgggacacccuggaauugucugucccccucuuccugaggcuccucggaaaagggacagaaggucuggaggucgcucagggccuucucuacccagaggcaggggcugggccuccaggguccgggucuccaggguccguggcuucaacuuuuggaaucucagaaaaucccagaagugaccacuggccugggguggcagaaacccaccagaccgggaagcaaaacuaacucacugcccagcugagccccccaccuugccccgagucccacacggcccaagguccaggucaccuacgaccgcaucuuggcgucagcacuggguccaggagaagccugggacggcccuccccugugggccucucuuucccccugucaacgggaguuaguggcagugaggccaggccugggaggggugaaggcagagggggcagggaggcaccaggagaggccgguccccaagcccagcugccuggcuucucgcccaugaggcucgccagccucggagcacuccagugauaaagcguucuugagggauuuuccuuugucaacaaaaccaagcagugaaagcagacagggacagcucuccacccccagucccaguuugauucacuggcagacagcaguggaaggcucaugggggccaagguacagccugggcuccccccacaccccauucgguccaaggcuuucuccccuagggacaggcaggucccucugaggugucagcaccuccuuaucacugguuccccugggggcccugagggucacagggaccugccccacagagcugggagcagaggguggggcagggggcaggggcugcucguggggaccuguccagggaccuguaggggccgggguggggcaccacacgggcugcaagggcaagguuaggggucuggcugcuggggccagguccggcucugcccucugcugacaggugacccuggugugcccucugggagccucaguuuccucaucuguaaaauggggagugugggaggcccugcacauaggggcaaugcugcugccaacgcuacuaaucagacaugcuggguccacagggcuguccccaaacuggaaagaaguccuagaaaauagaugauucuuccuaaaacguaaauuggaucaugccucucccccaacagucucaugccuauggaagggaauccugucccccaagggguucucccuccugucuccuccaagaaccaggcagugugggguggggcagcaggacccagggucucagagcuggggccuccccagccucacuuggggccuccaaggcuaaguucugugaccuccagggcccaagagugaguuccucuggcugcuccagaaagugaagagagaagagccaaccccggcucgggccacgagccccgaggcgcugaccacagccagagcaggccugcuggaagcuccgucccugcugcagaucccugcgccacaugauaucagcaauugcugcaauuucgcccuaaguacucuuguuuccccuaauaauccacguuucaucuccacaauaaacauuguuagaacucuucccucagcuuuacgcacauauaauugcuucuggugccaguaaaagguauuaauuccacucaugcauuccauaaacuuuuaggauaaugcaauugauaccaugaucguguugggacaccuccgcuauuauucuccugcuugcaagccuccgaggcgcugggaagguugcuccagacccauuaguguugacucagccucauucuccccaggaaucccgugcagagccuuugugcuucccuggccguccuuccauaugucccuccuggacggggggcuuuccuacccguggagccagcucuccccuaagacaaacaugugugcacaugcucgcgcacacacacacacacacacacauacacacgcucgcgcacacacacacgcugagucugagagcagcuggagggcacucagggggcuguguccgggccaucuuucugucuggaggaaugcuggggcagcuggccaucgcaccuguguguguccucaccauccugccauggcagccugccucgugggcuguggguggugucacucagcaugcccugaggugcccacagaugcugugcugggccagggcuuccaaccccacacugccuucuugccugaccucagagccccguccccaaacuucccaaacaccaaggacagccaccuucccugaugaggcugagcugggggcagaacggcugagccggggugucacagcauccgaugcccaucgcgucgggcuguucugacagcuagaggaacuccuguucauucucugccccgagggccuccuggaaccagcuguccacaccacugccaaccugcagggcucccaggacaggaguggccagcagggcucagaggccaggucaugcaugcccugcagagagcucugcccacacucugagcccacacugucccacagaggguguugaacugggagaagggcacuggugucaccaucagcacugcacucagagcucacguguguggagcgcuccccagguacccugcccugaccuaagaagucccaagagccagcuccuuuguccccaccauggcuggcaggccauaccucucuuugcaggugaggaugccagggcagaggggcgaagcagaaggugcucacgggcagcucugggauugggaccccagcagacgccagcuccaccccucucaccaugcagggucccucucaccaaaugccggccuugcccugucacuggucacugguuacacucucguggcuaaacacaaauccuuccucuggcugcucgguuacccacgacucgccuccuccuccuccuggguuuccauggggugggagcuacuagaacccugggcagugauggggggaggccugugcauguacacgcaugccuguguguuuacaugugucugcgugugcauaagguacuuguguauccacgugugugcaugcaugugggagggugcugugucugugugugugcacaugcguguguaugcacacauaugcacagaccugugaaccgcagccuccagaccucucagugcccaaggagaucugaggucugaucuguggucacuugggggcuggugaggguguuuuuccugaucggggagaaaggagggcggcagccaauguggacuuguacuugagaaaaauaugaauuaucuaucaguuaccagccggcuggcgugccgggagccccaggagucacggugcagaggccggacgcaagcacaggcagcagggcugggcagcacccgcauggugggaccccagagcugggagcaagcgggcugcccggcggccccguucugcacugugagccgaccacuugccugccccucccugggcaaggaaagaagcccugguggaggggguucuggccccagagagcugaggugccaaaaaucucauuaucaauguuugucccacccccuggauccacagggcuucggaggaggagcccugggugcaggcgacagcauuuuccuccccaguucgcgcccccccacccuccccccgccccagcauccacagagcccagcagggagggagcgaggaggugucacugcuccucugcugggcaccaggcacagcuuuccccucccgcuggugcagcugaccagcccgggaugccuggucugagcagaccagcccaucccacagggcaaggccaccccguccugcaggacaaggcaguugagacaaaaccaugaagucccuugaaccugaugccacacaccuggcaggggguggggguggcagauacccuagaugggggaagccagccagagaggggguugcuccuguccuuccaugaggaucagcucagaccacaugcagugcauuccaagcauggugaagaccccaucagcauccucagaccaugggaggaagggaggcagagcucccacaagcugccugccaggacuccagggagacacucuccagaaaccaccagcaucauaaaccccagggcaggaggucaguguccuuagaggggagagaguggacuuaggcaacaagccugagugugggagagaagcaguggugaggcuccugcugcuggaggugugcaggugaggaugccuuggggcuuucugaccuggcuucagaccuccaagugggguggaaggauaggccuggucccccuugccccacaggcaggugcagcugccacggaaccacucauuugggaggcccaggccagcacaccaccaccacaauuaagacaacgcaugggccuccugcugcgagcuaagcaccgugcuggccacagcccuggcacggucuucccauccuuaucuccaucgugcaguaaggugcguggaggaguaauuuccaaauggagaaaacgggguguuagcacuggggucggcauugccugccagauggaggugggaggccccggaggaggugccagguccucugccccucagcccaacagcccacagagcccccucccaucaagcccagcgaguccgggcugagccuucucuuagcccggagccagcagcugggggagcccguggcuggagugagaaucagaaacaaccgcaggugggggcgggcggggccuggaacccagaccccagaccagcccggcaggacuguccggcuaccugcagagccugacagucuaccuuaggcuccgcccugccccucggcccuccaggagcgugggaaaaccgcagcuauggccagcagggcagugggacccgauucuuaaagcggaaaaaccugaggggccccuugcucagcacucccgacagggggugggaaugcggccgcccugcauggacuucagggggccagcacugagcugugcccggggaggcggggccucgugggggaggggacgcugcccagugggccggaccaacaugugucccauagagccccuccugcagccauggccugggugcccaggcagggcucacuugcccccuccucggugcaggaggggagacccggagggcucuuggggcugcuuuucccgcccagccccugcgugcccuccacuccuggcuggggucaugcagccuucaccuugccccuccugacagacccccuccccugaagcugucugggcagggcagcucagugguuaggaauacagaugcagagguggcugcccccacuuacuaugagcagaacucugggcgaaccacuucccuccccgagccucagccuccuuggcuguaaaaggggagcagugauggagucagcccugugcguuguuggugggugcaagaguuagcucaacucaaagcccugagcauggugccuggcucgaggagacuggccuugugcacaggugauguuaucagaauuagcaagauccccaccgugggccagucugucuccaggggcaccgcagugaggaccugagcccuuggcacggugguuccaccccaucuccuuggugcaugccaauuccuggaaaugacacuccagagacagugccagcaaagcccaaauccacccacccgcagaugcgucucgcugccuggaggaggcagguucugcagacccuagggcugugggccugucucggacagacaacucuuggcagcagagcccgugccucuguccaggacaggauuucaaaccaaagaucccaccugagcauggggaagccgcuggccagucuuggcagagaucucaccagcagggccaaguccguccccucuguggcccuuuggaggcugacuggcucuggccacucacgucuagaggggugggcacacccagacugcccggcccugagacccgccuccugcccgaugcuccuccuggcccgggccaggugggaaccccgagcagacaguggggcgagcucagaccucuugaggugcggggaacgcagccaccuccucuccagcccgcagcccgcagcccgcagcccucagggacuaggggaacucaccguccagguggcugacuuggccgugcuggacugcuggaaagugaccucaaaguggugggguccgggguagucgguguuggaggggaugacaggcgccggcgacauggugucgaagguggagcuggguugugcguagggcgagugggugggcacgcuggcggcgugcucugggguguaggggcuggccgaggccgcgcggcugcucaucugguccauggugcugcucagcagauugaacugggccuggcgcgggaaaggggaggagggagggggaaacacacacagucagucguccugucccgucuaggagguguccuguuacaggagccuuaaagggccagcggcuccagucaucccaaauauuuccccgggucucucccccaucccaacaggccacuacuugcauugggauaaacugacauauucaccucgcccuccccuccaucagccucccggugccaggguuucuggggauccacccagccguugaugaggcggaauagacucucugcacaccuggaggggaggcgucgggugggggaggcucccaggcccugaugcccacacgggcuucacuguacccuccgggcggcaucggggucuggaccucacagcucaaaguggggagauccagccccagggagccaggcagugggggaggugggcugggcacaagugggcccugagugcagggugcgcacaccugggcuugggugcgugggugccccugaggugcuggagaccagauccgggcucucacuaggucuggcccucuagguggugggauaagguggaacugcuguucaauggcugagcccaauuuucccaguugggcggccucaucucucggugaacggccucaccccgacuggaaaggccgcuccacgcucaggggccggcaaagccucaccccugcugcccccuggcccgggguucucucguuaggccccuacccgcagcucccccgccaggaccacacaccaaggaacaggaaccccuguggguguguccccugcgccaccgucuguggcgccccgggaccccagcauggaucagccucugccaggagcuuaagggaggccccagcugagggagggggugcuggucuggccucgaugucucagauccagggcagggcagaccucacuuggugggcugcugaggaagacccuccuuccaaauccagaggcgggugcuggaggaagacugcacauguauaaacagcgcuuucccugugacccccgaggcucaacgcaaacaaaugccuuuaccccccucuccccgggccugcggcgggcaccgugauugucccuauuaccccucuccccgggccugcggcgggcaccgugauugucccuauuaccccccuccccgggccugcggcgggcaccgugauugucccuauuaccccccuccccgggccugcggcgggcaccgugauugucccuauuaccccucuccccaggccugcggugggcaccaugauuguccccauuuuacagaugaggaaacugagcuauggggcuggggaaacgauugaccccagugaucuagcggccccagcagacggcacaaaggucaccagcagucagcaaggugcaggcugagacccccagaccgugaacugggauugcagggcaggaaggggcagagccaggcggaggcgggccgggggcggggggcggucauucugcccugugucccucuuuagagaagcuguggugugcugugagcacacucuucccucccaccagccugcccccuccaauccaaaaaacaaaacgugcacugcccgcacaggagggugcaggggccucgccgggacucccaggcucagccccuuccugcaccucagccuucuccaucagaggugguuggguuuagugacccagaggcccucggcucugcagguccuaggacacacauccacugaggucccugacgagggccgcaucccccggccccuccagcauccaauggagaaggacgccaggcaaguccagaguuugcguccucucugaguccucuacugaguccuccacugagugcaguccaacguggaggcagcucagcccgggaugccggaggggcaggaggcaggggacugcugcucaccagagccaucaccacuguucccagggccaccaaaggccaggcaggcccucucccugugugcuccagcccaggacagccaacagccccagcaggccugagccgucaggggcgacccgugcccuggcuccacugcaagggucuuggcacgaggccucggcugaagcugccaucaucuggcaccauuaagcuggcugugagcugucaaccuggggagcccacccaccaguggaacggggacccccugcagcacgggcccugcccaccucuccggcaccacugcagccuccuuccuggucugucgcgcuccccacaaccucccuaacuuccugcaccacagguccuucccaggagcccaggguucacugaauggcaaauggauaaagaaacagugugucuguacaguggccucuuccucggccauaagacagaaggaagcucccacacgcugccacguggauaagccauggugccagcuuaaaaacaucacggggggacgcccguaaucccagcauucuggggggcagaggcgggaggaucucuugagcccaggaaucugagacggcagagagccaagaucacgccacugcccuccagccugggagacagggcaagacuuugucucaaaaaacgaaacaaaauauaacaucccagggaagggugacccucgccucuccuggcuccugggcuauugugagggggucuggggaagcagccacugccccccucagagaaagauguagaaaggcuacuccugcuccuccuggugucugguugggugucacccugggcaccggcgagcugccaguaggcuucuggcacagaggauggaccccugccucagcuacacacaugggagguugggugauggugggggugacaaggggcagugccaggcucuggucgcacagcccaggccccgccccagaguccccggcucccagacuccucaccgaggcccaagaggccucugaggugucugagaccugcuuacgaccacgggcccaggcccuuccuggaagccugcacuuguggucugcacacgacccuucaccagcccuguccgggcucagaggucacuguuccgaggggucagcccuggccacacgggcaggagcagcgcccaggccucagguguucucuuucgucacccgguuugagcaucuuucuagccauucuccggaagggcaggcucgcaugucccccauggcuucugucuccccuacucgacugugaacccacgaggacccuggauacgguggccacuggccacacagggugggggugugugaaauguggauggaccugagcccagugugugagcgcaccccgauuccaagggcucaggaccacggaaagaacggaaaacaccucgcucaccauuuccuacugauuacaggcugaaacgaucacaguuacgggugaauacaggaaauaauuaaaugacuuccgccagcuccuuuccaccuuuuugaaugcggcuacuagaaaaagcagaauuacacacacggcucggagccgacacccucaguccgugcuccuauuacagcguggcugcuugaaaggcucgcugaacaagcgagcuggcagaacaaacgaacaagcgaaugcaggacggcucccccaguccagcugcccaggagugagugugggacaugagccggccccucccaucaccggguaccgggugccagccugcccacccuccccucuccguggugcccucucucuuccaggugaccagcgguggccuuccuggaaaggucuucccuguuuugggcccggggauggccucagggaugcacgacuuccccauuccugacucauuugagucccccgggcaagaacaucccggggcucaagggcugcccagcugaggcuucucaggucaggaugacaggcaagggcaggcuccagggucccccugcccgacucccaucccugcuccaucccugagaacaggacagccaguggggcaaaaagcccaugccucccuuguuugggagaagcaggaugcagacccacgacaacguguuucauauuuuaacuuguccacauucuuguaugaucugaggaaggugccaaggaauuagucauugaggcaagaggagaagagcugauaggaucucugcgccuagcacagcccagcgggagugagccaggcccuugcggcaggcggccccacgcgggaauccuaauuaguggacaaguguccggacagcaggccugaagcccucucggugccguccucuguggcccagggccccaggcaggcucccuuagcagggccuuccucaggcagggccccgaugucggccucucccucugguccccucucauccucaggcucagugacacggggugggggccucugaagcccccuccuccccaggguuacugggccuguccucugcccaggggacgcuguccucuccuccugcuuccaggggaccucucucccugcacgcuggcccugccuguggucaccgccccugucacacccccaguggguggcagaggcuuugcagcugcaguuaugaaugcagcugggaacgcagcaucugggaaguguagggggcuuucugggucucugaccucccccuuaggccuccccaggcauccuccacaagccccuccaccuggcucgggggacucuggucuucccuuucgcuuccugccuggcggcaaggagcuuucccuggggccuggcuccugcucggggucaagcugcugaaacagggaacccugaaccuaacacaggccugcacaggagcccggggucucccacaaccagagggcccccggaagccacggggaggaacccgggcacaaccaggacuuuuuugguuuguuuugcuuucaacaagagcucccaagauagugggcuaauuaggacacgcccggcccgcggcggccacaagugccuacaugugugugcagggcuccugggccugacccaaggagugcgcgggagccagagagccagcggguggccuucccgccagccuccaggccgcggacgcaccaggcccugcuggggccccagggccuuguugcggggcaggagugcucugccaggggaaauacugcagcccccacgcacccacccaggaggccucaucucuccucccugcggauggguuggggaccucccugggugcaccugugcuggagauuagcucugggcugggggcugggggcugggggcuggggugugggcagcaggcagugguaaauggggcugcucucucgccugggccagucacagguaucaacacaguucccagaccucacugguuugauccacccaugccccugggguggcagcaggccagugaccuugcuccaaaaugaggggucagagacugagaggccacccaguagcugggcccccuccaggagggcuguggagggucccgccugcccccuggccugccugucugagagcagagaggagcagugugggggaggccagagcucagcccagcccugaagccccaucccacuggcuggacaccccaauccaagcaccagcaucuaccgucggccaagcuggggacggugauggcugaggucuggggguucccacaaggugggcaggaagugguggccagggcugcccaucccagaacagcagguucuucugggucuacugaugccccuacgccaccauccuggaaaccaggccucucugcccauccaggagaggggcaggagagaccucccagggaccuggggggccaagcagggcucugaggucaggaguccuggggccaagucucagcuccaccuguguaaccuggcccaucgcuccaccucccuaggucuucguuuucucaucugcagaguggggaugaaaucaacauguacuggccaggcgugguggcucaugccugucaucccagcaauuugggaggacgaggcaggcggaucaccugagguccggaguucaagacuggccuagccaauauggugaaaccccgucucuacuaaaacuacaaaaaaaaauuagcugggcgugguggugggcaccuguaaucccagcuacuugggaggaugagcaaggagaauugcuugaacccgggaggcagagguugcagugagcugagaucacgccacagcacuccagccugggugacagagcaagacucugucucgaaaaaaaccaaaaaagaaaucaacguggacuucguaggaugguuguggggaucaagaggguccagaaguaugguaaccugagacuucaucggaagugacucucgcccgggagcccuccuggaaccaauguccaggaagcucccaugcacgaggcaugaccuccacgccuuggcacaaaaacccagccaggaggaacgacggcugggcaggcuccgccgaggaacagggacgggaauccagauucacuacgcagaggacagucgcuaagcccugggcacagggacggauggggaagagcaggugcucucgggggcaggugcucacaggggucggggucucuccuguuccccgagguguccagauagccaguaccgacaggacgcucagaaacucuugguuggaugaaacagacccugaaauccacgcgggccauccaacugggggaaguggccacggugugccacugcccgccaugucggccacagccccaagcccagacagugcccaggguccaggcugccuuccucagaauguggagggcggggacagccccuugaaagacucuuuguccucaccggccaggagcuggaggggagcugggccccaucaucacccucccgccgcauggguucuguucuauuucagauuaaguuggauuuugugguuuuguuaaaagauucccauugcaccuguugacuguuuaaaauguguaaaccgucucaagugacuuuuuuuuuuuuugagacgaagucucacugugucgcccaggcuggagugcaguggugggaucucggcucacugcaacuuccaccuccuggguucaagcgauuaucuugccucagccuccccaguagcugggauuacagacgcuaauuuuuguauuuuuaguagagacggggguuucaccauguuggccaggcuggucucgaacuccugaccucaggugaucugcccaccucagccucccaaagugcugggauuacaggcguggggcauuugagugauuuuuuuuacaaguagaugggaaauaaaucuuuuucaaguuugugucccuguuccccccuaguccacuccucucgcuucccgguauccacagugccuuuuaucagagccuaggauauuuaagacacaaugcaaagcaaggcaugggaggucacgaccgugccaucggaugacaggggacagaugugguacuguccagaacggaacguauuuuuuaguggaaaugacaacagagaaaccugccagcaaaauucacaaugacucuggccacaucuccaaaggccacgguuuuggcugacuccuccagcggaggagaugugaggcggggaaggcacaugcagccuggucccugcauugggccuggcaggggugguggggagggcggggcacaaaugcucauucggaaaccuuugucuccacaagugcagaggcucgaaagacggagcuccugccccguagacagcaauaacagcuucccgagggaccccauccuugggagcugaggccaggacagcucccaaggauggggccgcuuccuggggcccugggcuuggcggagaucaggagacuggggcccgagcccacggucuggccaugcagucccccuucucuuggaaacagagauuccucugauccuaaucacuuaggauccgagucagagagggaggcacgugaaaaagcguaguagggaugucagcugaaauccugacgccccgcuggccccuccccagcuccaccuccgccucccucgcuccugucaccucuccagcuccugcccccgcccgagcaucccugcuccccgcccggcauuuaucccgcacucucauucauucuguucaacuaggacaggaaccgggagcuccagacggggcagagacaugcucuucuucauccaccacuggcagccauggcauggugcauggugugcccgugacagacguuuccagaaggcagcauguuugagggcuggagucuggcaucggggccugccuggagucuccugagggcucagcuggccucccucuggccuccuggccuucucccuccagccuggacaggggcucugagcugugaccccagcucuuguagaacaaggagguccguguccucguucccuggagaauauugagaccagacuguugugguuuuuugagaguaugccgcuccucaaacucccugaucucucgugggcaugucugaacuugggccccaaccucacccaggggugagugacugacaagcagccugggcuucggaggaagagagcccaucccaccagggcaagaccuccguccugccgguacuucccacagcaucucccggagcccgugauuaaacgaauggaaaugccaacaagauucgacaugcggcuggggggaagccucccucucccgacaaugugcacacagcacccucugcucucauccacagcacccucugcucucacccacagcacccugugcucucacccacagcacccucugcucucacccggggcugaggcgaggccuugcccaaucccgugccagggccauguggaacuuuccacaccucacaccggagaaacgcgcccccaggagcaguccccagacgugugucugcaggacugcgaggcccagggccaccgcugcuauccugccugcaccugcccgcagcggcugagcccgucugcagcacccacucugugcuuagcgccacaugggggccuugcagaugcaugucccuccacacgcccaggugacuucagaugacuccaggguagccuggugccccccgggccuccacggacccacauuugagccgcccacuguggccuggugcaagggccucgccccacccucuccucaacccucacugccuuccaccugcuaaccgccccggaguccacucacggugccgccgccuccucccccagacccuucuccacgucccucagcuucugcccccugccucccggaucccgcucaaagcccaccuccccugagaggccuccuccagagggcuggcccaccagccccucccuuccagguuguggcgaggggcagccuggacccugagugucugcgggaggccccagugggguauccaggcuguauccccaucaggcccugugcugcugccuaugagaggcagguggccaacaggaugcacagacuuuauuuaaccaccuggaaacgggcugguccaggcccucccacccagaaugccgagugcccgggaagacgagggggaaggcacagcucacacacgcuucucuccccucuccgaacccugcugccagcaccccagagcccaacccaggugucagcccugacauccuguguccuugcacacaugccccugcccaucugucugcccauccauccaccuguccugcagaugugaaucaggcgccaccuguaacagccuccugcugugcuggagacacugacagaugcuuagcagggcuuccuggacaccuuccagcacacauuaguggcugagccgagaauggguggcugagccgagaacuugaauuaugacacgugcagugcaggguacagggagggggaggcagucacggggcgugccaccuccgauggcccucggugauaagcggacauuggagcaggagcccaaagguggagaaggcgguccaggacggcuguggggggccaucgaggcagagggcagaggccccagagccagagagacagcagcaugcuugcucaggaaucacccagccccgcucugccuguccccuccccaguuagugggcucaggagugacggauggucccgcccagugcacuggccuuggucagcuccugcaaaggcaggucuccucuucacacccauuuccuaggcuugacauccuagcacccucccaggugcaggaagauggcagccggcacgagacacgaccccggcccuccaugcugacgacaguaaacaaaccagccagcaagcgugcaggggcuugggaucaaaaguggucucagaaacacagagccaggcacaggggccagggcuggcguccaggcaaggacgggcucgggaaaaggugaaggcgggccugcaggaagggaaagaucugccccagguauugggugggccuggggguguuuccaggcuggggaccagcagggcagagagccugcagccagaggaagggccgagggccugugcagggagagacggagcccagggggauagcgggagagguggucggagcugagcagagacgcccggggcugcaaagcgcucccucuggcuccgguguugagaacacagggcgggcgucagcaaaggcagcaauugugagauguaucugagcagugggugcgaggugggccgcgggugcgacgugggccgcgggugcgaggugggccccgcaggggccccaggcacauuugcaggcaggauucacaggaccucaggcauggagagugccuccagggcucuggccugagcaaaggcgagaguggauuuccugcuggcugagacacggcaccauccccucucaggggaagauaaguuuaguuuggguuuagcaaguugagguccuauuaggcuggugacuggggggagguccaaugggggacagaacaaaggagacagaaauagcagcuggccgaggguggcaggggggccggaggcgggcgugcacuaggcacagcaggcgggugagugggguggcuccucugaucccuggaucuccaguuaggacaacuggucccuccccuggccccacauggcuugagccccaccgcugcucggggucuuucaugacacaaggccuggagaggaugcugagggcucccuuggccaugcucagcaaucccaugagccauucccaguugggcccugcccucuccaaaccgugggaacucagcagccucuggguugccaagccccagucccuuuucuguucucccagccagccucucgugccuccuggccucccaggcugccccucugcaucucccccucugcuuggugucucggaugucguagugcccagugcucagcuccagccgcugucucucccugccuccgugcagaucccccagagcccugacuguaagugcccaugugcaggacucccuagaggucgucuccacagccugccugcccacaccagcaacugaguguccacauggccgcuccugccaguguggccccaacuccuuacccaccucacauccagacccugccggccuuuccugccuuggggagcagcagagccuccugcaagggugcaaauggaaccucagcaucuuucuggaauccuccccugcucuuccucuaaggucaccuucaaacuccacccuaagccugaccaccacccaccaccuccucugaugcacacaggacugagccaccagguggucacacuuuucaggccccaggaccacuggaaaccccucccucauggggcuuugggaacugcucgcucgucguccuccucccugcaugcggcuccuucucagcuaugcaauggcugccgggcaucuccaacacagccacggccgaccgcggcguuuucaccccugcucugcugcaguucuaccaaucucagggcagaaaacuuggggucucccccaccccuucccucauauccagcccaucagcaaaucuugcccagaaucccacggugugguaccaccugaccggcggggcugccccauucccuggaucgucccagccugcaggcggcuccuggccuuggcccugccccccuguggucuauccccagcacugcagccgggggcccucccagaacgucugccagcugcgucccuugguuccguagccccacguacagaguaggugccuaguaacugcagcuugcugcacugauuggcuuccccccgccccagggcccuguccuggaggcccauccugcccagagguuucacuuucugcaggaacagaguggacacuggcuccauggggcgcacgggaguggggguguccaaagcuccagauccguccgugcugcuccucagcacagggguggccacguucccgcaacgcauggaugcccaccaugcggaggggcagggugggaacaggccaggcccaagggugcacagcccaggcccugcggcgagacaggcuccagccccuccauagagagggcgcaggagagcuaggggugucucccaucacccuggcuaaccuccugagacccuaaagcugaagaacagcggccccaggaggaaguggggggcaaggggccaugaacuggacauuugggaagucagggagacuccuggguguugguagacagcacccagcuccgacgucuccagcgcucagccucuucuagaggggccccacucauccagccaucggcuccuuccuugcuacaggcagaaguggguaaugucucuguguccaccucgggguugggcauugaucaaccccaguccgugggagccgcagacucagaacguggccuuguuuggccagagccaccacaggauuauccagucccccauguggaaggacagugugggaagcaagugaagagcauggcugggauugcgggaggaggggcugaggcugcauggcugggauugcaggaggaggggcugaggcugcagggcugggauugcgggaggaggggcugaagaugcaugggugggauugcaggaggaggggcugaggcugcauggcugggauugcaggaggaggggcugaggcugcaugggugggauugugggaggaagggucugaggcugcauggcugggauugcaggaggaggggcugaggcugcauggcugggauugcgggaggaggggcugaggcugcauggcugggauugcaggaggaggggcugaggcugcaugggugggauugcgggaggaggggcugaggcugcaugggugggauugcgggaggaggggcugaggcugcagggcugggauugcgggaggaggggcugaggcugcauggcugggauugcgggaggaggggcugaggcugcauggcugggauugcgggaggaggggcugaggcugcagggcugggauugcgggaggaggggcugaggcugcauggcugggauugcgggaggaggggcugaggcugcauggcugggauugcgggaggaggggcugaggcugcagggcugggauugcgggaggaggggcugaggcugcauggcugggauugcgggaggaggggcggaggcugcaugggugggauugcgggaggagggggcugaggcugcauggcugggauugcgggaggaggggcugaggcugcaugggugggauugugggaggagggggcugaggcugcagggcugggauugcgggaggaggggcugaggcugcaugggugggauugcgggaggagggggcugaggcugcagggcugggauugcgggaggaggggcugaggcugcauggcugggauugcgggaggaggggcugagaaugcagggcugggauugcgggaggaggggcugaggcugcauggcugggauugcgggaggaggggcugaggcugcauggcugggauugcgggaggaggggcugaggcugcagggcugggauugcgggaggaggggcugaggcugcauggcugggauugcgggaggagggggcugaggcugcagggcugggauugcgggaggaggggcggaggcugcaugggugggauugugggaggaggagcugaggcugcauggcugggauugcgggaggaggggcugaggcugcagggcugggauugcgggaggaggggcugaggcugcaugggugggauugugggaggaggagcugaggcugcagggcugggauugcaggaggaggggcuaaggcugcaugggugggauugugggaggaggggcugaggcggcagcucuccaggccaggccccccugcguccccaucugcagcaaguaaccaguggcucccauugggccccgcagccgagcagcuacggugaacaccguccucaucauagaggagacugaggcucagagagcggcgucacugaccaaagacucagcuggcagaugccagagagacagaccccaagcccacaccuggaacccugugccaggcugggggcaauuggcgggcccagcugggggcucagacaguguccugcaacccaggggccucuucccagggccaggcuggcccagcgggcuccggagcagcuacugugcuuugauaggaauaaccagggccucacaaagccaccaacuccaauacaacucuauucgcucacuuuggguuuaaaacccuuugggccaaauaccacuuucucucucaaaauacguuccugcaguaagaugaggucaugaauacucucucuggcacagaaacagggaaacugagucaccacuccgcccauuaggauggcccagccuagcccaccuccccccgagagggaagaggugcuggagacauggcuggcucugggcacugccuccaccugcuccuggcacucagccuaacacacaaaacgugcccaguuaacacuugcugaugggaugaaugaauggacaaaugaacgaacgaaccacaguaauccuugguguaaaaagaaacagugauggcacagcuggccauugcugacgcccagggcaccgggcagcagcagccgaguggacaccagcagcuccugcaggcagugagggucugcaggccagggcagcagggcuccaccuccccaccccucccgggaauggcgucugcgcaaccacauacucaaccuugguggagucccccgagagggugagucacauggugacaucugcuccauucaagggaaaagauuguacuagagucccccagguccccaggcuucucggcuggccaggcagcgacacuggccucuccacccgaggcuucuggauccaccucggguuccaggcgguccagcagccgggagauagccccucccagcucacacaccuccugggagagucuggggguacaaggcagccccccaggagccccaggccugcugugcguuucuaauagcaacguguugguggauacauguaucaaugcacaagugggugacagccagacaagggagagagggacaccccaugccugauguagccguuccacgcucugggcuacagucccagcacuggguuucagauaaaaagaucacgcaggcguguggagaggccauggugccgccagacucgagugcauggacccagcaucugggcaggcuguggggcugggucacccacacccucacccacccucugggccacacacacacacugccucucuucucaaagccuugccugggaacacacagcuacaggcacagacauccauguauccaucgcaacacacauacggacacacgugagcaccuacccacccaaaucacacaaucacaccugcaguaccaaucugcucacacguacacacaccacaacacacaggcaaacacguguacauacacacacaccagccuguacacacacccauaacauacacacacacaucugcacauauccucgccugcguauugcaugcacauccacgcuuagacacacacaugcacgcacaccaauacccacccgccacaugcacauugaugugcacgcucacacacaucgcugucacacacacccuggucacacugccuggggagcccacggcuccaaaggccuccguccccagaucuuugggccucuacaucccagugccagcagagcuucggggcacuuggacucugccuaucugcccgcugcccccugcccauggcugaguuucccguguggcacagguacccauggucccagcugucugcuucccugggaggaggaacggccccacguggagcagcugugccgagccuuccaccuucucaauuagcagcuggugccugccuggcccccagggaccuggcaagucuggaagugaggccagguccccagggcucaggcugcaggggccaaccacaagcugcagacccuucccuccccucuuccaagccagcagcccacugcagggggcggguggcgcaagaggccucaagcccaguuugccacagguccuggcccuggagcucagacccacaccgagaagagcccguggggcugacaagaagcaccgucugccacugcugucaaaugagcaaauucccugaugagggcgggggcagcuucacacccaagcccaggagcaaagaugacuucuagggugcacugagcuccuggcagcuggggcagggcagggcagcucggaaacucugagccuggaccaagccgccagccccaaagccaaggagcaucagagacccccgagcacgaggcagaaacaccagcagccccaucggcauggacccggccuccucucccuggcugcgggucccugcccagcaggugggcacaggcuguuggagcccgaaucugcuugccuccaugccugggaccugccucuagccccucaacgccucccuuccuaccucugcucaccccaacuggcagcagacuccaggccaggaaggcaggcagaaggaugccccucugaacccuacacugcagcaaaaucccccgcaaaguccccgaagagauccuaugaauggcgcgucacaccuaccguggcgaggugccgugcggggucaccgacguacagcaugguaggcgccggggggucugcacacgccagggaacuggugucccgugggacgaggcauggaucugggcggcccgaggggaagggucacggucguggccgcccggcagcguggaccgagcgggagaggcuccgcagcuagugaggcaggagccgaggaugcuggggaacaugcgggccguuuguuggcauuuucgcuuuucccaucucccuuaguucugucaacuggcugaauccaacaacaaaacccgcggcccaccccuuuauuccucaugaguauucauccaaguccggggcaggccucagcuugcccggugauguguuggaccgcaccaaggaggcugcguggggagggcggggacgccggucagcgccggcuccauaauuaaacccaccagggcuccuuccgagaugcugccugccuggggaaggcucggggggccccaggcccucaccccguaaagcagccucuguucccaggcaugagggcugagccccggcccuggagaucaugguaggcaaggcugggccaccccaagggggagagauggugucgccucccuuggcacccagguggggcgcaccugcccccugcgcggggaacucggugguccgccaggaccaguccaagggcugcauggagaggaggggcucacaggagguucgacccuagacccccgagggagacaggugacgggagugagcagcucuuguggggccugccuuccacugccugcccaaagcaggggugaguccaagagcccagagccgugcguuuggagcccacccuggcacuggccaagcccccaggaaacagggacaagccacuguugccaaagaacagcccggcaguggggcccccugcaggcguggacggccuuggcacagccagggaggggcucugcaguggugccccgcacccgucuaguggggccuuugaggugacugccacucccuguugggccgucugaauuuccauuguauuucagccgucuuggguacaaaguugacccuggcagaggggcccgagucccccuggaagcaggcagggcaucuaugcucagacaaaccuggggacuggggccugcggacccacacuuccaguccccagggcgccguggcucucacgagggcugagaaauccauggggagcugagaaauccaugcggagacccuuuccccuuuccuuccaaccuuuuccugccaaaucccaaaccaccugccugcuuucucuugucuccaucuccccagcuuccuuccucccugucguccccaccgagagccggcaggggccucaucgcuccccacccccacccccgggagagcgggcagagcugggugagggcaggggagguuuggacugcagcugccugaggagcccuggggacccgcccugccccaccagcaggccgggcugaggacgaaaggacgauuccagguguugugccccaaggggcuggggccuggagagcccagcucagggcccuagggccgggaggcagcaggugaguccuggacgcccgucucuuccuguggcagaggaucucagcccccaacaggaagggcagcagcacucaggaggagacgacugagaaaaagacaguuuugucugguagaucagguucaggaagggcgucucugggaagcccccugcagggggucggcuggggcccagacuggauguucuggggaaagcagcagccuccuugcaggagagcccagggcgagcacuaggagacuccugcugggaucggggaugcccuggggaugagggugccuucugcuucugagccugggaccccucuuggguugggggcgggcuccccagggauggacagacccucagagcagggccgaggcggggccuggguuccgcucccgacccccacagggcacauccucagccucuguaggcgguguccucuccugccaaagggaaugaugcauugaaaaggagacucaggcgagucccaugcacagggccggccugaugguuuuauaaauagccaaaaggagagcgccaaguggaaggacgugaggaaggaagacagccaggcugccuucagcacgagccccacccaugcccagggcaccgugccugagaccccgcaucucuccacccuuagcaucugggccaggcugcggggaucccagugcggcugagcuacacguuuccaacucaaaagcacccaaaaccacuggccucugccccagagcggcacccagcuuucugcaaacguucccaaggcccagccuugcagaggacagggacaggggaucuggggccacacccccuuggcguggcccuuagcgccuccuccagguucccucccugcuggguccuccauucugcuuucauucugcuucugacucaccggggauuccgccugacuuuccgcaggacccugggccgcaggacaggggggaacgacgcugccgcaggccacggcacucuucaggaaccaguuagugggagggguuaugugccagaacagacagggggacuucguuuccuggugccagugaugugucaguucaaggccaaacucauggcacagggucccugcugggcagcuggcuucaucccaccgcauggaagaggccgcagaagcugcaaggcucugagaccugggugcugggugggguucacuucugugcagccccaaagugcuuugucacgaaagcccaccaaaggaaaggcugagugggggcucucugggaggggguaacgggugggcuggagucucagagcugaccguggugagcugagcccccucccugcucccacgcaugaccccacccuuccuccagcuacagauccucccuggaagggagggguguccuucucccucuguccgccugcccuuuccugggggccacacaugcacgggaccugcgcccuuccuucuccugggccuggggagaauaccucucccugaagucaccaaggccuaucuggggugaccucuagggucucaagcccccaaguguccgaagguucugaccccgggugucuguccugccacuggguucccggggcucccaggguagaucagccugccuucugccccaccagcuguagaccccgcucuguggcccaccugcccacaacaccuguugucagagaaaggcgccaggagaggcaggaaggggcacaggggaggggccagcccuggaggaggcucuagggacagagaggggaggggagaggacgggagcggagcagaguggaggggaggggagggaggagacacuugccucucucuccuuuucuccccuccuguguccucccuccuuguggagcauccugagagccagcaagggccgcaggucucauugcccugcgcugguuuuguccgaggggacgcuagcgcucagaggggcagggauucgcuuccaagcccaggcccagcacugcagagacuccucggguggguccgggugaggauaggacccccgccccaccaucacacccacacugccuccucgcagccugcgagccuacgagggagcuuuauccucugcagcucuucccagacgguguggggguggccagggcagaccccacccagguggcauccagaagcccgucaagccuuccucauucagggaaccagccaggguccugagagggcaggggcugggccaguuuuagcuguggcuccucggcccacccuccccagcccauggggaggcccgggccacaggcuucccccugcucuccucuugcagaacggggcccuauuuuagagugaggucccugugagccauguagggucuucagggacagccagagccuaaggcacgggacagcucaggcaggaacugugccaggcaaaggcagcaggcccuggucccagauccuauccuaggcccuccuggcucugcuguucugguguccgaggagcagcuuucuuaaacacagggccuccucccugcccucacccucacaccuagcguuugucacauacucccgaugggcccggcaccacuggacauccucacaucgugggugacuuggagccucucaguagcgccauuuauagacaggaaacugaggcccagagggcuauguaauucuuuaaaaguugcccagcucagaagggaagggguagguccugagcucagcaaaccuggccucggagcccccagccacacccaccucggccugcuggacuuucugggccaccucagucagauggccacagugaccacggggucuguuuccugcuauggccacacagagcucacagucuccccaauaagucuguggccugggacuccucuagagcccacugaggguucaacugcucuugcccacaccccacucuccugaacugccuaaacucagccuccucugcaggggccaguguggcaggaggguuguccgaggcccacgggguugggcagagccagcacccagcaccuggcaucccagagucuaugccaccucccaaagggcucucugcucugggcuccuacccccugucaccccagcuucaccagcaaggacauggaggcucagagaauugugggagcuugaaaccaccugcuccgccugucucccacggcugcuaagcagguggcuaaggcaucccucagacacccuguguccaacgggaaccaaucugccugcucgugguucggggagacccacgucccccagaugcggaaggcacgccccacugcagaggaccaguguccugcgcucaagcacugugccugcccgagcugaggccccuuugcuggaugagucccagacccgccccugaguaugggagcagccagaugccaccaacacccagggacagguggccagagggagccgccaggggcaggugggggcaggugcgugugcagccacuuccacaagcaggccccccaccugagccacgaacucaggacuaucgguagccccggaaacauccggcacuagaaccgccugucugacccgaggccgggccugugugguguuucuuguccaaggucaccagccucgugguggggcuagaacugggccccugagcugcagguggcaguuuuccagggggcacucagagccccccaugcccgcauccgcacugaaccggguccagguccccagccccagcacagcagcuucccugagcuccugggcugaacuuuaaaacaaugccccccaguucagcuccagccccacucugggaccccuggaguuagcgggccaggggccauucucaaggcagcuaagcccugggcccugugccaggcugcccgagcccacccguuggcgcccuucggagucucugucuuuguaccuggcgcucccaugggagucagggguaggggacagcaugcucuuggcccagcagccacuguugugagggggcugggcccuggggucagaaugaggcuuggcucuccccacgcaggccugggccugccuucauuccagggaaucccccaucuccgugagucgagcugugcaccuaggaauuucauacauggcuuugggaggaggcgugucgcugccagacagauccagccaccuugcuguuugcggagguucgaggcucccacugucacccuguggcuggggaguggcacguuccagcaggcgggggcucggaccagaccccgauauggagcucagggaacccuccggggcuggggaggacaagcacgcuccacccacucaggaauguagaacugcuccuucugccucccugaguccagguccuccucccgacacagggugggucugugccaucuuaggggccuucugcccucugcagggggaguggcugagcaacuugggguugggagguggcuucuggaucucaggggacaaucuuaugggucuuccucccucccucccugggguccagcggccaguuccugccccuccccagauuggaggacacggauguccagaaggggaccuggaggggguggggucaggacccuuguccccagagagcagccggcagaacuguuccaaagcgagagaggggagagguugcagucucacuuucuugcacuacccggccccauccccagcccacccuuucccagcaucugccucgguuuccucacccauaacacgggacuagaacacgcgcagacacugucgaguguuuccacugggacggucuccugagcaggggugggagggcaggggcaggcggucgaacccucagauacaggcugaggggcuccucggaggaauugaccccccgggacuguggcugcccaaggaggugccuucucuggccccacauggcucugggccagcccagcauccgcaauggagacggaacaggcaacacggccccuccaccucuacacucccccaccccgcuucacucuguucguucugacuggagccccacagcccccacucccuccagugcucaggguggcugggccgcccacccccaugccucagacagucagucgugcgcaggggcaaggaaggggcuccagcuccuggaauggggacuugagggaggaggagggccaggccgggugcucucaggcccccagaggcccagcaucgccucccucccuuucgggcugagcauaagugagggaggcccgacccugccccagacgcgcuguuccgcguauccccacaguucgggcugguuuuccgcagcgcaaacaaauuccccaccuacgaaucccugggcggcggaggcggggcggggcagccagccugugggcggggccgagcagcugacgaguccagcggggacggcuggccucgcugggccucccaggucgggaucuuugcucucuccucacguguggugcccaccugccauccaccucccggcacagucgaggccuggcuaugggcagccagagagguaggcaggagcguggcccccaccagcucccacagccuggccuuuucccccagaggagcagccaauggggcagggcuugagacucccaggaaugggggagccugccaagauggggugccggaggccucacuggcccugccugcccccuauccaguccucuucuccuggaaacagcaccuccaucuuccuuugggggucccuguguggggaggcccaccccacuccauuccauugucacccuguuccacugaugguggaggccaggccaaucagaggcacagauguggcucagagaugggcccaugaccacauucagaucaacgggaggcaggacugcuggacuaugggaaaagagggaucuccucuccacagggauagggcaugcugguggagccugguacucuucaccaugagaggagaugcggccuaaaaacaaagucacugcaggggaaagcagaccaagagacugagcgaggcagcugugaagcaccuggacacagccaugcccaaagcccuuucuauaccuggauccaccaguagaagcccuuccuacaccuggacccacccauguccaaagcccuuccuacaucuggaucuagcugugccugaagcccuuccuacaccuggaucuagccaugccugaagcccuuccuacaccuggauccagccaugccugaauccauuccuaucucuggauugacaguuacaugagcugauacauuuucuccuuugcaauuugaaguguccucagaaacccacaggggaagcuguacaaccaagaggcuaucuccugguucugccaggcucccaagacaggacaggccacauuuguuguccccacuccaguccucuugcagagggcagcccccccacucaccaugacagauguagucaugcccuccagguggaagacguccaugcuggaauccguuccgcccaccaccucauuauucccccggcuugacuggggaaggucgaaguaggugcugucugguucccuggggcagggagaggaaaauagaagcgucaguccccaguuugggugucaccccaauaccucccaggcccagagcucaaggcuagccugagacuccuggugaggccuacgucuccugcccuucccauucccucucaucccaucucuguccuccaccugccauuccagggcugcugugagugccagagaggcagagccagucaugggcucuguuauucugggccucugcuggccaugggcccucuccagagcuggccagagaaaagagucugaauuuugguccugcauccccagggaaggccuagggcagcagucccucuucccugccccuccgacccgcccuguccccaagcugaugaggguggcuaaggcuagcccaagacuaguguggagccaccucuccugcucugguccaguuagugcagcaaggguggucgaggcuagcccagaaucccagugaggguugccaaguuuagcccaaagucucagugaggguggcuggggcuagcccagaguccucccggggccaccccuccugcucuggcccaguuagcccagcgaagguggcugaggcuagcccagagugccucccaggggggcccccagcucuggccagccaagcgcacucacagagagcuccagaggugcucaaacguggugcccccaucaggggagguggcgguggacugggccaucuuccccacgccggccuccgagggcagcucgcucugcaggaaggaaggaaugacaccugagcacccugggaacucgugcucuguccuccugugacagccucggugggggcggcaggcaagugggccugccuggggcaucccuggagcaggugcccccgccuugcccucccugugcccucuccacugucauuucguccacccuguuccccgcggcuggaaaccgaaggccaggugggcagcucugccuuggagguggcgggccuggaucagacccauccgugggggugcccugggcaggcaggagcuucucagagccgucgccuuggaagagggggugacagcaacacccgcuccuggggcugccuugagggccuucaggagagcagacucuuugagaugcuugggccgggacaagcgugugaggccuguggucuguuaugauccacugugucuagguuuggccugggggaugcuugggccggaacaagugugugaggccuguggucuguuacgauccccugugucuggguuuggccugggggaugcagccagguuuggggucucccugaugcccgggaccuggagguggcuccggucccggucaccccaucuugggaacagcgugugugagggcugcgcuggaggcugcagccaagcccccggcuagagccuagcugugcccacugcugcaggacacagacgcccccucgccuucugagcuggggcuccuuccugcaccccagggccacagggaagccuggcaaggcugggaacuugaagcugcccuguccugcagccggccacugccuggguggucacgccuugagaaggagacacccagggauuggagagcucugaccccagcgcccguccgcuggucuuugucuccaccauugcuccccugagaaccccugggcccagcucccaguggcccuggacacccaugaggagguggcaguguccaggcagagcacagcugggggaggggacagggaaacccgagcccacccugcccacagcccccagccccggcugaggugaccucuccccugggccagccucccagguccucggugaggugcuaugggacaggcuuggccaccgcccugcaaugcucaggcaggcaggccuggaccugcccacggccagcgggggugcaggccauggccuggaaccugucguuuuuguccuuccccaggcaggcgggagcugauagaagccuguggcugccacgugccgggcccuggagaaguggcacaggccaggcugaggggcgguccgugagccaugauggccugggacaagcagcuuagagggugcuggcccaagccaccucucccaggugggcgugaccgcuccauccacuuuucaggagccccaaggcucagagggguuaagugacuugugugaggucacacggcuguaagugcuggugaugaaugcuccaggggcucuuagaauuagaaguuaauuugguugcccugccccaccccacuucaccaucacguggccaggugggugugcccuugcaggccuccgauccugggcugggcuaaaaccccaguggagcugagggugugcauggggaccgcaccauuccguuaauuuaaaaugggagagugugacaggaagcagaaccgcagguccagcugaggcuggcacagggccccgggggagagcagaacccgcccuugcccauaccccacggugggucccuuugggcugagcaguaugaguaggguagccucuuggugcagguaugugggccaaggcugggugggcacaagugaggggucccaggcauguuuccugaagggcaggagcacuggaggggcuggacucggaggaaagaaauucccuuagauccaagaggacaagccugggaagguuuugccgccagaggccucugggucgcauccccuucauuuuguagaugggccaccugaguccagagauggaaauggacuugccauccacagcagguggaugacaaaaucccagcucccuucacagcagcaccauuccugguagcugaacggugcacauagcccagacgcccaucagcagagggccgggcacaggagauguggugccagcaagcaauggaacauuacgcggccaugaaaaggaacgaagcucugacaugcuacagcgugggugagaccugaaaaccucaugcucaggacacaugaccucaucugucagccugugagcuguccccucccaaggcuaaggugggacaaagacagagagagacagagacagagagacagagagaaacaaggacaaagagagacagagacauagagacagggauagagacaggaagagagagacagagagagagagacaaggacaaagaaagagaaagacaggaagagagacagagagacagggacaaagagagagacaaagagagacagaaagagacagggaaagagauagagagagacaggaagagagacagagagacggagagagacaaaggcagagagagacagggacaaagagagacagagagauacaaggacaaagagagacagagacagagacagagagacagggacaaagagagacaaaacagagagacaaggacaaagagagacggagagagacaaaggcagagagagacagggacaaagagagacggagagagacaaaggcagagagagacagggacaaagagagacagagagauacaaggacaaagagagagagagacagagacagagagacagggacaaagagagacaaaacagagagacaaggacaaagagagacagagagugagagagacagagacagggagagacaaggacaaagagagacagagagauggagagagacagagacagagagacagggagagagacagagagagauggagagagacagggagacagagacagacagagacagacagagaaacagagggaaagagagagggacagggagacagacagcgugggagccgacggcaucccgccgcaccccuacuggagguccagggguuccgugaacaggugugcacggggcaucccuccgcgcagggcucagggcucacaggaacuggucggcaaaacaugauuugugaucuuaugccugggacaugggcguuggcuguauuuucaagucggcauccugugaacucccccugaagcgacacccucucuucccacugaacccugaaugaggaacagcgacccuucuugucagcgcgccucugccugccggagacccagcuuccacauccccugaccggcacccacugugcacugcaggacaccagcuuggccucucaucccugccugggcacaggacagaggccagcgagcguggucguggguccccgaucccacccguccggcccuccaggcucacaggacaggccaccaccaggagcauguggggugggaaaggggcuuccuccacgccaggaguuggguccccaaacauccccaggccuguuugccugagaugugggcagugggccuccaggugcaggcguguggaccagccggaagcccugggcagaugcaucuuccaggacaccccuccccacaguggggcuggggcagggcccaggaaucugccccuuuaacaagccuccaggggagucaugaagagccugggacaggcccccugaggaggacacugucaugagggccagccuugccacugcucggggcccugcugcagccaccggccucccccaugggaaucggguuccucauuagccaaaaccaggacccggaaaccugcccagacuuaaagcacacggaggaacuugaaccggaagccacgagaugccugauucccaacuuccugggaaaacgccaacgcugguagcauuggucccagggccccacaggaacacugcucacaggcacaggcgccaggcaggggcucccccaaccggccucacacaccugagcugaugacuggcuccgcaggcaucugggaguacugggcaugaggaacaggaagcucuguugggggugcagggacgcugcgcuggggcagggggaguaugugcccucugcccacagccgccuuucaggcaaggaucccaguggcgagaaaaauaagucaauucuaauaaaauggccuuucaauuaaauccaauuuucccaaccauuugccuuuuaauuugaaaauucguucacaaggggaucacgguucugggacaaaacagaaauugcuuuugaaacguugccaauaguuuuaaaaaucauguguaucaauggggaaaggagaccaauuucauaagacaucuuuaggaaguuuuaucaacaucauaaaaugcaaauacauuauuggaaguguagguuuuucuaagaagauuuagucuaggagggaugggcugggugcagugguucauaacuguaaucccaacacuuuaggaggccaaggagggaggauuacuugagcccaagggcuugagaccagccugggcaacacagggagaccucagcucuccaaaaacuuaaaaaaauauuagcugggcaugagggcgugauggcaugugccugcaguccaaaccacgcagggugcugaggugggagaaucacuugagcccaggggcucgaggcugcagugagccaugauugcaccacugcacuccagucugggcaacagagcuagaccacaacucuaaaaaaaaaaaaaaaaaaaagggaaggaaggaaaugaaauaaaugaguucucaguuguaacaggggcguccaguguguauuaccacaggucuugcaguggaaggcuuuguguggccacagcauuuggggguggucauuggggagcugcuggccggcacccccccagcccuggcaccaucaagucagggcacagaguugcaaaggacaguugugcuggguguuccugguuacgcuguagccaggcuguaggcugcuggcacacccaggaagcagggcaccucgacccugccccaacuuccaugaggccucagacaaguccccucccuuugccaggcuggaaaggugaccagcguuccaaguccuacagugcccacagcagugggagcaggacaaagaccagccaccgagggcccuccggcaaacccagaccucagccugcuuggauccucaacuccaggggccgcuguaccagcugcaccacagggagagcccccacacacgugugacucagaacaggaaaggaacucacaccagcaauuaggcccccacagcuuccccgggacccacggagcacaggugggcuggggaggggacuguguggcccagaaaaccagccugcccaagcucccuggagcugaaaacaaggcucucugaugacuucucgguuugacucagggccuucugaggucucagccuagggguucucaccaggggcaguuccacccccagaggauauucccauguggggacauuuuccacggggucagagggugcuguggaaucuagugugcaagacagggaugcugcuuagcacccuacguugcucagggcagcugcccacagcagaacgcacgcccagcugucggggccguggcggagagggggugcugugccauggcuccgagcugaggcuggccaggcacuuugcagggccucaggcucacacgccaacccugccccaguucagagaugagcaaguggaggccaggaggcccaguggcuggcccaaagcuacugagggcugaggagcugggacuccagccaagcccagguccucugauggccuggccgcacccgaaugcuccccucugcccuguggggaggaguccgcagccggugaggggcucucagccucucucaucucacccugcccaaccccucuggccucgucuuccauagcuucccacgaaagccacagcccccugucccccugcccugucccaagcauucccucccuguccccaagcauccccucccuguccccuguuccucuguccucucccugucccccugucucccugucccccauagguuccuucccuguccccuuucccuuuguccccuagccccccaucuucuauccccucccugucugcaucccucuguccccuccccaucuccuguuucucuguccccucccugucccuuguccccauagaucccugcccuauccccauggguccccucccuguucccugucccuuugaccucuccuucucccauccucuguccccguccuagcuccuguuucuguguccccucccuguccccguccuccuguccccuccuugucccccauccucugucccuccccgucuccugucccucuguccucucccuaucucuuguccccaugggugcccuccuuguccccuguccccaguccccacaugccuggcuaugugcucucuguguucagccuuugucuaccacccccuuccugcccucccaucucaucccuaucucuccaggccaggccaggacccagccuccucuaggaaccccgucuccggcugacgccccauccucuccccucaccaccugacaggaggugggagaccagacauuuccuuggccaugggcccacagguaaggccucgucaguuccccaaccccuuccaccucugcccaggccuggggcagacagggcuccacaaccaccuuugauaagccaggacacuccaccccgacugagcccacucuggaagaggcacuccccauggggacacccacucccaccugcaggggcccuggccgcagggcugcuguuaccuacccaccccucgguggagcucugagaccgagccguccgcacucagccugggcaggagacacaggccccucugccccgucuggcccagccaucccggacacuggcucuuaagggggaucacaggaggggugcaggguguccuccuccauucagggaggagggaaaagcccccaggaacuccacccgccccgggccaccccuaaagcaaacaucucaaugcacuucugauuccggugguucccaaaccaccaaugauuuuaccuguuauuucagcagaucaacgauuccaaucugaaguggcaaagaaaccuggggccauugugggaggagacaccugggccauugugggaggagacaccugggccauugugggaggagacaccugggccauugugggaggagacaccugggccauugugggaggagacaccugggccauugugggaggagacaccugggccauugugggaggagacaccugggccauugugggaggagacaccugggccauugugggaggagacaccugggccauugugggaggagacaccugggccauugugggaggagacaccugggccauugugggaggagacaccugggccauugugggaggagacaccugggccauugugggaggagacaccugggccauugugggaggagaccgucucaauccccuugugcccuuuucccagggacucaggcaggucccaggacccagaacccagaagagcccccgccugggcagaggggucgggcggucagcgcaccagaaugaagccaggcaggcuggcccugugugagacagcggcucucccaggcagcagcccagcggaauuccugcagggcgucaucagagcccagccuccuggggcccucugugccaaggggccucacucuccccuccagccaccgcaagaagaggggccgcucucgcuuggcaggcuggggccaaggacaggggucccccggagugagggccaggagggccucccucucaggggcaaggcccucugccagcauugccugccccucccgacagaggcuaaggaccauguggccucccucuguggguacgauggggccagguccuucagacaggguugccaggacggcuucgucagcaggucaggggcagggacgaaggccuguccgcagggccuggugaggaggaugcggcugagagccccccucaccgccacagauggcacgccugcugccccacuccccuaguuuggggaagcccagcauggggaugaaagacaaacacagccucccacggugggguagcgugcaccgugugaaauaugcggacagcuggaggugccugagcaagcugcccucucucuccugggccguggcccacgggaagcgggaggggaggggaggcagaugcccaggacagucugggggaaucccugagccucaccccagaagcuuugaggccaugaccaaaccaaaaugcccgaccccccgugggugggggugcccccaaccagcuuccugggucaguucacacucagccaagugaaauguagaaacaccaaagcauggcuaauucccggggauuccagccaccccacgacggcccagugaggccacacaccuguuaccaaccaggagacaugcacagagagggaagaccagcccuccaugggcacacagcuggucaggguggaggucgaacccagcagccuggcucuacccuggccugaccuggagcugagcaagggaggcacgggcccggcugcaauccccuccccaguccguguucccaccgcacagccacaccccgcacccugccugggaagccccucucuggaaauccccugccuguccaucuaucuucaccgguacauugaggcccaauccacauccagacauccaagaggcccgccuuguccucugcugccugcccaggccuucuugcugucauauauguguuugggucauaccaagacacaugauuccugccccaccgcuucgugcccugaagcccagcacugccgggcacacacuccaguucccucuccugcucugcccacgcagcccaccucugccgcgcucuagcugugugaccucagauagaugucuugcccauucugagccucuguuuccuugucuguaaaauggagauaauuguagugccuccuagaagcgcuagguggaaugaaguaacucuacgcauaucaaaagcgaaagcacuccucuaucugggcacaccguggaugccccauaaaccguaucgaguugccauugaccgacgguuauuuaguaucaggugguggcaguggaggaagaaccaaugaggcccgggucccaaaggcaccaggcugagcgacagaacugcacacacgggggcggaaagguggggucugcuggcugccgggucccuggcuccuucgagugccucuccauuucauggucagcacgcgugucucaccccacuuuuacaguggucuccgcacccuuuugcagagcaccagccuauccucagucucucagggaaugaggcguccucgaaacggguagugcccaguugcagcggcagccggugccagcuccaugcccgggggcaugcaacgcgguaaacagauaacccuggcccacuggaggcaaaucauguaugucugugaggcccucagaggcuggguaugaggagggugggugguggaagagaagucugcaccccagccccagcuugcuugcgccuuggagugggcggugcuccuggggguaagcgggucaggaggguuuggagguggggucagaagcaugagcggccugaugggcugagcuuccucuaagaaagggguggaaggggugggcagggacauggcccuuggggggacgagguuggcggcaggagggaaguggggcccugucagggaacuggggcgcugagcuuggugauguuuccugccaggagcccaccuguuagaggaagggcgacccuggcgggggugguaggagcagaucugucacuaagggagguucagaccagcacagugggcacaggaagaagacccagaggaccgacugccaaggauagggggugagggguccagggcugggacagagcggagcuuauggccagagugggugucugagucgauaccuguguucacaggugaugaguacagcgcugcccucagcagggcaggugacugauggggccgcagccgccuucgcuggagcugccacagccucguucugcacagacacaucccuguccucugcccccuccgauccuccucucacacccccuuucuaccccaagggaucacaccgggugucacuagccuuugugcggccagcgcccauguuggaagugccugugcuguccuccagaaucuucuuucuuuccccagagaagcacuuccacuccuccaaccaagagagaaugacccuucucaagcugcuguccccaccuggccacccuccucuggacacccuugguggggaugcuccacucugagauguccccacccuacacauaccccucaccccuggcucugggcuuuucucuaaggggucugggacacgcccgcugcaccaguggacaugucucccugcugaccacucccuacccugcggucugagcagacgugcccuuccagacagcugucaacucccugaacuugucaugcgucccucugagucccgcccugacucagugagcaauccucccuccuggcguguucccuuccuguucuggagucagccgcucagcccugugaccuccccugcacagugguggccgcucagccccgugaccucccccgugcagcgaucacggggguccacccaccccucacuccuuccagaggcagccacugcuguuccucagaguggcuguccgcuggcucucaggguugccuuucugauauugcugcccagcauucccugugccaaauccuccauauuuucaagcucauucaauccucagaggaacccagcgggaaguccccagguguucccagaggccccgagagggcgagcagccugcccagggccgcacaucucagaagcaccacagcuggcuuaggcugggcuccggugagcuccaccuucccgccaggcagcccguccucuggaggccccggcuccugcagggcagacaacgauccagccuuugcccccgucacgaagggggcucccgacgauggcugggucagcccaagagcugccuaggcccugggcagggcugugaucuugugggacucacaagcgaauggaggggcacuggccaugguggagcucggccaaggggcagccugggcagccaguaggucagggagaggcaggaacagcaacuggagcuggacaggguacaggaccaccaaggucacaauggauccuaggcuccaugcuacuccaggucugagggggcugcuucccgucacgcucccagcucccacaccccacgccucuccagggacaggcccaccccugccaucccugaggcaguuccagcuggagcccuggaacccugaaaccuggacaggugccagccgaccugugcuuccagcccagcccugagggaggcugugcagccagaccccacucugaccagcauggcacccacgagggacggcugucaggaagccucacuccucagggcccgcgcacccccauuuaagagacgcuggucuuccccagaccugccagggcuccucccucccagcacccaucgcauggagagacauucacaugcugacucuuugcgggccagaccaccaagcccugacugcucucugcgcugcagccccagcacccgccuggcacacaguaggugcuccgugaagaagcgaugacagaauccaugauuugguuugagcgggcggggcccagcaggucaggucaggacaggaacagagugacugcuggagaagcaccauuugggguuaaauugcucgacuuccuccucauuucuccucacuuuuucuuuuucuuuuccuaucuuuuuuauuuuauuuuauuuuuuuugagauagagucucgcucugucacccaggcuggagugcagugguacgaucucagcucacugcaaccuccgccuuccagguucaaaugauucuucugacucagccuccccaguagcugggauuacagcugugugcgccaccacgcccagcuaauuuuuguauuuuuaguagagacaggguucaccauguuggccagguugcucucgaacuccugaccucuguugauccacccgccucagccucccagagugcugggauuacagaugugagccaccacgccuggccuucuuccccacuucuaaggggcuccuguacauccccaccuggacauggggcucuugagucuugaguucagacugcgggaccccagggagacgacacccacauuccagaagccugugcccauguggucccccggccccaucaucaucccugccuuaccugugcccaugugguccccuggccccaucaucaucccugccuuagggaugagcagagagauccucagagugguguaaaacgcacccagagcgacacagcaagccaggaagagcccauggucucgccccccgagccacaugcccauccaggaggccaggcuggagacuuugcaaagagccaagggaacaggauccagaggcccuggccccucggacauucccccaaggcuucagggaggagcuggucacucaguuucccuacccacccucucaccucuagcaacacacuugcacauacaugcacauggacacaccuauucacauaugcgcacacauguguccgcaggcacugccacguacacacucugcccuccucacagcaaauccccacaagccccuccccugucccccaguuugaugggucccugaggauuccccagccugggaguccagcccuggaagcaggacccaggcagaaggaacaggacaugcccagccccuuccugccguccacgucauggucaggcuugggaguagcugcgugagugccggggaggccggggcauggcuugcuguugccgggagaggcuccggggccacaaaagagugagggggcuggggagaacugggagguucuggaucagcugugugaggcugaggauggcggcccccagccgggaagcccccggacgugccaggcuggggcagucacucugcgccuccuuggcaggaaguggaaagagcuccugguggguccaagggguggagguggcgguaccagagccacuucugcccccgauccuagggucacacgaggagcccugaugugccacuuggggcagauggcuccccagagcuguggcuugucccaucaggagaacugugggcaaggccuccccacccuggccugaacaguacugcauuuccaagccgccuccugggaggccguagaggggcucucugcaccccagggugggcccccggagccacugcacccacgguggcaaggagacuccccccgacucaggccgagaggagggcgagccaagcccaagccuaccuuggcuaagccugggccccggagggucgguggggccagguggaaguggcccucggcuggcuccuggcucccgcaggcgggcgguggcagcagcgucccugucaccuaggugaugacauuggaguugcgaaacuaggcggcagcguggccggccuggagcugcagggcagcugggggcggagcauggccuggagcccuggggcuggagacgggccuggagccagcaccugccgccugccaccuggcaugcacgcgccacccugcaucccugcuccccccaacccuccucaaggcgacugacagggccgagcucagggcagccaggacagggcugucuccacccagcuuuguacucguuucuacuccucauuguggacacuuccaagcacacucagcacuacagggaacggcccaggaacccauccacccguccccagcucucaucacucugaccucuggcuuuuuguuuccuggggcauuucacagcaaauuccaccuaugagaccgucucauccguaauacaccaguacaugcuuccagcagguaagaaccucucuuuuaaaauauuaggucaaaccaugaaauugcugauaauuaaccguuuugguccuaccaacaauacacacacacacacacacacacacacacacacgugcagcaaguucagauaauucaacauuauaugcagccauaauaucaaauucugaaucuuuaaugcuggucagaggauuuugaggagccccgccccaauuuuggagagggaagugugugucgcugccacugugccaccuuccucccccacaauugcagcagcacggaguggacagcacggaugugugucuaggugcugcacggaugugugugacagcuacucauggcuguuggcuccaggaggggagauggccccucaucgcagccgggugacucuuuggaaaguguauccaugggucauucucaagcacaccaauuuggguuccuuggcugcagugaccuccuggcaggcacuccuccucccccaccccuaguucauaggaaagugaggggagaggaaagaccugaacccagggaggcuggugccuggcuccucucaacauccuuguuggagacaaaaggugggugggugacaggaggagcaauagcagcuggacccuggccauagccauggccaagucuguucccuggucugaagagcaacuagcacagagugacaguggccaugagcccuggggggacacugaagggggaguucaaggagaauuuuugcacaccugugcaccguaacacaaggguugcaaagcuauuccugaacuccccugcccuauuuuaagcugggugguccagaugugaacuacagggcaagcccuuguuuauuuccuuuuuuucuuuuuuacuuuuuuucuuucuuuuuuuuuuuuuuugagacagaaucucucucugucgcccaggcuggagugcaguggcuccaucuuggcucacugcaaccuuugccucccagguucaagcgauucucaugccucagccuccugaauagcugggacuacaggcacgugccaccacgccuggcuaauuuuuuguauuuuuaguagaaacgggguuucaccaugugggccaggauaguuucaaucuucugaccucaugauccacccgccucggccucccaaagugcugggauugcaagcgugagccaccgcgcccagcugcccucguuuaugccuaucaggcaagagcuggagaggggaccaugcggaugugcgcacugucuguuuucuguggcugccguaaccaaugaccacacaaugagcagcacagaaugagauaaauuuacucucuuacaguucuguaggucagaguccgagauggguaccagggagcuaaagccaaacugcgggcagggcuggcugcuucuggagaccccgggagaauacauuucccccucuuccugucuuuggggggcccugggagaaucccuacuccccugucuucucuugguucuggaggcccugggacaaucccuaccuccccguccucuccugcuuccgcaggcauauuccuuggcaugugacacuuuccuccaucucugaaaugcaucccuccaaccucugccuccaucaucagcucccucucucaccccucuuguggggcccccugaugacacuggacccaccuggauccugccagauggccuccccaucucaaaauagcugaaucacgguccccuuugccaugggaaauaacauagacacggguucuggggauugggacgugaagaccuuuggggagccacuuuuuuuugccaaccauaaaugucccucauugaaaaacaucuuuucugagcccucuguuugggggucagucugaaagccgcccugggagagacgcccgcauggcacugagucgcgucugcucagagcaccauccccaccgccaaugcuuacucacuuccgagcugaagggcuucugggacgguuuguuccugcucagugagacacacaggacaggccucuuugaggucaaagggcacccuagccugcagccaaggccagggaggugggcaggaggugguggggagggagccagcagagggaccauuaaaagccccccgcccacgcacccaccuucacugucagaccccuuccuuucuccccacagcucuucaguauuugccagcaggucccucugugugcaucagugaguuccugagggcaugccgcagaagugaaacugucaauaugacccauaauuacaccccaccaacacacagcuuacucugcaccaggcaccauuuuaagauuuuacauucauuagugugggauacauagcaagacccugucucuaaaagcaagaaacaacaaaacuaaauuaacuggaugugguggugugugucuauggucacagcuacucaggacacaggcaagaggauggccugagcccagcaguuggaggcuguggucagcugugacugcaccacugcacaccagccuaggcugcagagugagauucucucucucucucucucuuuuuuuuuuuuuuuuuuuuuuuuuuugagacagaguuuugcucuuguugcccaggcuggaguacaauggugcgaucucagcucaccacaaacuccgccuccuggcuucaaaagcgauucuccugccucagccucccaaguagcuggaauuacuauacccagcuaauuuuuguauuuuuaguagagaugggguuucacuguauguuggccagguuggucucaaacuccugaccuggugauccaccugccuuggccucccaaagugcugggauuacaggugugagccaccuugccuggugauucugucucuuaaaaaaaaaaaaaaaaaaaaaggccgggcacggugguucaugccuguaaucccagccacucaggaggcugaggcaggagaaucgcuugaaccugggagguggagguuucagugagccaagaucaugccacugcacuccagccugggugacagagagagaaauugucuaaaaaaaaaaaaaaaagaaaagagagacaaaccaaaggaccuaggggucagaguuaugaaacuucaaaauacgaaugauuuccaugcaccccacucauaucaaguccuuccgguuuuaaaguucuguuuugcauaaauuacuaaccguauacuucaucgucaagaguagacucuuucuguuauucuaauacuuucaaagaccagacugaccagcugaacauuagacaaugaauucuuggaguuauacuggccucaaucuuacaacgguguauuuugcuauuuuuaucagaauucaucauuuucauauuaauccaauuagcauccuguuuaccaauaccucauuuuuuaauuugcagcuuccuucuaaaagcuugggggggacuuucacaacucgaucuguccucccucauuacugccaaauaauuagucaaggagccgucccugaucaaaaauuaagaacccagaagcaaguuggagcaugccucgcuccagaagaaaacaugacaggagacucuuguaauuaugaggggacugguugguagucaugaugcagccggcaaagacugugauagcaggaaggagagaccugcacugaaucgugagcguggccgaucacagcucauuaacuagcuuggaguuugcaucuccuguuuaacugacaaagaccgcagagucuuuccucuguaauuugggggcugacuucacccugcauugugcauggugcaaauugcgaggaccauaaagagaggauggugaguugccuugcccacugaaucgugcaccuuaucucggucaucggauucacaggaaucaccugccucuaaagagggagcacaucuucccuuuguagccugaccgcaucugguaaggguggcuggguuuucugcagaagagauaccccucucugaggcccagccgaggccucccacagacucuacaaccccugccccccaaccaucucacagucaggaaugacccacacugaagcaaggcugcuccccguccccuacaaccaccaggccccagucuggcgggugggcaccacccagguggacccggaggccaggaggcuguggaagagaaagcugcgggucuggcucauguauucggacugguggagaaaauggagccaggaagucauugcuaagaucacaggaaauggugcaguacgggcgagcaggagcuucccugcccuuuccaaaggacccagugaaauacugcaccucuccugcaggaggggcagccugcccccucagcccagccuuccccaggugccacccccaacccugccugacaccucagagcagcaggugagcaauuagagcccccaccccuccucacaggcacccugagccacggggggccugccagcugguacugggcagggaaacagguggguccuuccuauccaaugcagcgccucugguagggggacacacccugggcuggguggaagcccugccggcucaggcccugcaucugggcugguaggaagguaggagucgcgaugcccaggggcccgugcccagacuggcagggcagaggggcugcaccagccucacuugggcaccucaagucugccagugccacccuuggggguucucagguguggucccauaggcagcucagaucgagcucacaguggggauacagcaguggccucuccagagagccuguggcauggagggaggggggccggccacgacccccaggguacugauugggcucaagacauaccacuaccccaaaaccuggcacgguggcaucugagaagccagggaaagcagguaugcucucuccugcucccugucacccugaggcaggccauaaaagaguucucuggccuuccucugaauuaggucacagacccucaugugcccuagacccagaagaaaggaagaucagagccuucagaccuggccccagcccccgguucaggaugucuguauccuuucuuucuuucuuuuuuuuuuuuuuugagauggagucucgcauuguugcacgaucuuggcucacugcaagcuccaccuuccugguucacgccauucuccugccucagccucccgaguagcugggacuacaggcgcccgccaccacgccuggcuaauuuuuuguauuuuuuaguagagaugggguuucaccgugugagccaguauagucucgaucuccugaccuagugauccgcccgacucagccucccaaagugcugggauuacaggcgugagccaccacgcccagccgccuguauccuuucaucacgcuccgugcuguccacaccccacaaacccaggaggaaaauaugcagaguuccccgguucgauggguguuccauucucaaggcuccugugucacauggaacuucucguaaauaagccugcacggcccucuuguuaacuugucuuucauuacugguacggcagccaccaggcucgugauaggcagaggguccucuuguuaaccugucuuuguaggugccgcagccaccagccucgugaagaagagaggccccuucuccccucaggcauggguggcccggccugcagcugaucuugguggcaugaauugaucucccaggcuucagccuccccaucugugaaugggacagugaucacuguuuccagauaaugaucagcaaagcccucaucuguaugaugccacugcagugaggaaagcgccgcccucagauuacucaugccagugcccaaagggcaacacaugggaccagagacaaguuucucuuauaaaagagaauuucguuuuucucugagagcgcucggagcugcuggaagaggcagccccaugcuguccucacacuggggaccccucccugcgcuccccagccaggucuguccuggggccugguggggagcugauuccaucuccaaggcccauagaggccccucuaggcccccuugcaauguccccuccauagcccugacaccuggguuggggcucaggacacgccaccccaccccaaaacauggcuugagggggcagaaugugccaccccaaacaugccuuggguauauccauuauuucgaguaacugcagacacaggaguggcucugcccagcugccugucugggagagaaaugaaagacauuuccauucguaaaggucucuaugccgggaggagagcggcuccagguaacucugaucgccugagagacgcauguccgcgugacgaaaccaccuucauucaccagucaacuccccugcuauagcugguucagccugcagcagccccacaguccuguaucuuccugcagcugaggaugacgcagacgccuccgccaucuggccccuucccccaguuucaucuccgugugggacucccauucguggacauaucauuaaaauggguuuucuccuguugaucugucugaugucacuuuuccuccccugcagcuuggugacaugaaaggaccuccguggcuggccuuacucccuguggaugccacagcugcaggauccuggggccccaacagaagccggugaaggaagaguuccugcuccagcaggugccuggucuccaccuucaggggcugcuccaggagaguggcaauuuggggcagcaggaggaaacaugggugugaacuaguucuuuuuuuuuuugagacagggucucacucugucacccaggcuagagugcaguggcaccaucauaguucaucgcagccucaacuccugggcuucaagggauccugccaccucagccucccgaguagcugggagacaggugggcaccaccacacccagcuaauuaaaaaaaauaaaaaauaaaaaauaaaauaaaaaauauauauuguguguauauauauaauacauauauuauauauauagcguguauauauauaauacauauauuauauauaguguauguauauauauaauacauauuauauauaguguauguauauauguaauacauauuauauauauauauauauacacaaaauacauguguguguauauacaguuuguugcucaggcuggaguacaguggugcgaucucagcucacuguggcaugaaucucccuggguucaagggauccuccuaucucagcuucccgaguagcugagauuacaggcaugugccaccaugccuggcuaauuuuuguauuuuugguagagacgggguuuugccauguugcccaggcuggucucgaacuccugggcucuagugauccgcucaugucagccucucaaagugcuggaauuacaggcaugacccaccaugccuggccagaucuaagaguauuuuaaacuaucuaacuuucugcauuucucuuugaauauuucauuguuacuuugauuaaaugagaauuaaguauuauuucauaaugaucugggauucuauuuaaucaagugcuuucaaccuuuugacauuuugacaacuuuccaaaaucacacacucuaaauuaagucuuuuugacccugaauuaacguuugggauuuccuagauuggccccuggaauaucucaaaaggauuuauuuucucuccuuauaaaaacauagauuauuuugccaauguuaaagggaaaauuguuuuagauaaaauaaaaagauauuaaauaaauugggcuuauuugaucaacuaaauuugcauggaagcacuguaaaauaugaagugaugauuaaccuucucugggugaguuauauuugcauggauauauauucauauaagaguuccagaaauuauaugaaauucuuagaaaucugauacauucuauauuaguuguaauucuaguuauuaugugaaaguauacaccacaggaauaaccaaacuuccucaucaguuacauuguaaugaugucaucacaucuuuagccaaggccauuuuaagccuuucugucauacacaguuaacuguuuggcucugaugcuuucccgaaagcuuuugcaagcaacuauaauucuaaaauguugugucuucgagaagauuucauggggaagacuuugaccaguacagguuucugauacauuaagaucacaccacuggauggcaagaauuuccagaauguaaaugaagaaacuauuuauaacuuacagcauucugguacauuacacuuuuauaagcaaaauugaaaugaugacuuuucucccuaccugaucucuccagaauuuagaaacuauuagcauuuuuauuuuuacggccauagaguuauuugcuuaaguucaagaugaaucugcugccuuguaauaggaaacaacuggaaauguugguuagcucaccaaguguuugaccggaauaucauauuugagagugaugugcauaaaaucagaugugaguagcuuuaaggaacuaagguugacuuuauggagccaaugaaacccguuggaggaaaacaaaauugcccuuguaccuggauuaaagggcuucugcagccucacggguugaggaaagacugugauuuuuuggcaguaauucucaagaauacguugggaaccuugagaaagaggaauccacccaaaucuauagguauugcaggugaagucugauaucaaguccuuggcuugacuucuuagccucaagaggcuuuugaaagccuaaccugagauuuauuaaaaguuccagcaaagcugaccuaaagaaagccuagcuggccacuuacuauucuugcugcacuugugcaaauaaucaggccaauuuuaaugaggcuagacuuacuuuacaaacaaguuaaucugacuaggcugggcacaguggcucacgucuguaauccuagcacuuugggaggccgaaguggguggauccugugaggucaggaguucaagaccagccuggccaacauggcaaaacccugucucuacuaaaaaaaaguaauaauaauacaaaaauuagugguggugcaugccuguaacuccaggaggcugaggcaggagaaucacuugaacccgggaggcagaguuugcagugagucgagaugaugccacuacacucuagccuugagcgacggaguggaacucugucucaaaaauaauaauaauaauaauaaucuuacugagauuauuuuuaguagaaagaggggugauguagaaagaacauauauuucaguagaaagccauauugugcgccccauauuagauucuuguccuguuuaacgucuuugggguuuuguuaucuauugaugucuacaaacuggacggguuccugauguuucuaguuuccuccaguaucuggcugcaacucccaaacuaacacuuucaauuuucucccaccguucuuauuggaaucacgaagaacaaaacugcccuuugcccagaaauccugcaaacugaggcuggacgacuugaaauacucaucagcgagauuaccacgaagcccaggugcgagggacccucacgccuguugcugcgugggccgcccagacaucgccagagaccaaaccgcagaagaugcucggagcccaacaucuacaaaccugccccgccacggcccccaggcucagaaacugguuuuuagucagcuccaaugauuagcuuuuuuuuuuuuucuuuuguuuccauagaaaugccucuucaaagcauuaugggacaacacacccacccaguuucuguaccguggagcuucuuggggaaguuucagacuaggaaacaauggggcucaggacacaucaccccaaaguaugacuguaggagaccagaauacgccaccccuaaauaugacuauaggagaccagaauacgucaccccaaaauaugacuguaggagaccagaauacgccaccccaaaauaugacuguaggagaccagaauacgccaccccaaaauaugacuguaggagaccagaauacgccaccccuaaauaugacuguaggagacuagaauacgucaccccaaaauaugacuguaggagaccagaauacgucaccccaaaauaugacuguaggagaccagaauacgucaccccaaaauaugccauguugacauguugauuacuuugagcuaaaagcaacugagaaccagccaacagaaaaaaagcucuucagcucccuaaaauaaaguaaaaaacucucuuuucuaaagaaaauugacaucuauaaaggacauuuucauuaguaauggucugugugccaggaagagagccgcgcgccaagacgcauuuucucaccaugagacugauagcugcaccacgaggcagccuuuaugcccagacguuuccucccucacccucuccucauuugucucuaccgcuccccagaagcccaggcccccuuuccuuucugucacagaggacggacaucugcaccgcucccaucugguuacugcugagucuccuguuuuuauggcacuuccgggcgggggcacagccuuaaaacuguugucucuugugagucugucuuuugucaaucguuuauugacaagaaccccguagggaagagggaggcaacuuucccuuccccucuccacagcuugcucuuuggggaacccgauuuaaucuccaaggcccacggaaucuuccggccacuguccaucccuaaugugucccccauguccccuccacggucccugcuccaugagaccugccuuccgugcccuugcucuggccccagcagggcccuuccugccaccuggucucuccaggccucacuggaggccaccacugggacggcgucuccucucuguccaacucccugagaggugccucuccagacccuuccgcgcagaccgaugucccccgaccuucuguagcacccacggccagguccagggcuggggcccgggucucgccucucccgguggggcuucuuguucaauaccucugguuucugucccuaacugggggcuaugcggcccaagcaguccccagguagaggagcugcuggaguguguggaacagucuguuuuccaggaugcaggggcuguggaggaggcgccaggcgggaggugcugggggagaggggggcugcccauccccggcugugcccaaccccgaccuucaguguccggguuccaagauccucguccugaaaagaggggcguggcuuagaccagguuucuuccccguuugcgccauggccccucuggcagccuggggaaucucagacgccuuguccgggagaauguuuuaaauacaugaagcaaaauacacaggaucacgaguuacugaaacauagccacucuaguggguuggaugcagccucugggaacgagccucagaaugggauguuauuuggaaucagggucuuugcagaugccacuuagguaagggucucaagauaagaucauucuggauuuuccaggugggcccgaaauccaaggacagguguccaucuaagggacaaaaaaggagagacacacagggacacagaggagaaggccauggcaagaugguggcagagacuggguggugcaucugcaugccugggaaccacaggauggccggcagcccccagauccuaggagggagacaggaggcgagcccccucucagagccuccgagggaacccgacccugcccacaccuggcuucagauuccugccuccacaaccgugagacaacacucucuauuguuuccagccacuuaauuuguggucauuuguaacagcagccugagaaaacuuacaaagugacccuaauauuuaaaaagcaaaacugggaggugaucauaugugcgcuucuuuguucauacauuaagucguaagccugagagcagaucuaaucaccgccauaauugcaacggagcgacaagcacaaaccacuuuuuaagaugcugcagcuauuaccggacaccaugaaaauaucagugguucccacuggugaggucacagguacugcuaugacuguaguuugcugccuacauucaaaacuagaggaaaugcugaaauuugcuuugagguuaauacaaggugccauuuuuccccauccaggcucacagcacccuggacucucuaccccuggcuuagauguucuggaagggcccuuccggccugaauguuccacgguccuaggugucugggggccgugucugagccaacggcagacccaggcaaaggaugguuuggcagccccagucccagcuucguggucauagcuggaguccccacucccguacuuugcagcugugugacccugugcaaguagaauagccaguugaagccucaguuuccucaucuguaaaugggcauaauuauaguaucuacuucaacgggcuauuguggggauuacagggaaaaaaauguaaacuuuuuagccaaguaccagcucacagccaccaugggcuaaaugugaguuauuacaggaaacauuaaaaaacaagaguugggcuggauuaucuuuuucuucuuugggucugugaugugcaacuuguccaggaaaagaaagcacuuuggaugagcgaguguuuagccugcaaagaaauacugagcacagaguggacugccagggggcaggcagaaagucuguaaacaugugcauaugucugucugagcccacuuugguauaagcugucuuacacucaaaugccaaugagcagagggauuuuuuuuuuuuuuuuuugagacguagucucgcucugucgcccaggcuggaguguagugcgugaucucagcucacugcaagcuccgccuuccggguucacgccauucuccugccucagccuccuggguagcugggacuacaggugcccgcaccacgcccgacuaauuuuuuguauuuuuaguagagacgggguuucaccguguuagccaggauggucuugaucuccugaccucgugauccacccgccucagccucccaaaaugcugggauuacaggcgugagccacugcgcccggcugaguagagggaauuuuuagaauaaaauaccuucugcacgacccacagagaaggauuuucgaggcauccuguguaacccacuuaagaaggcaaacuucuaagaaagccauuguguguuuucauuauacacgaguggauguugccagcuacaaguguguuuuguguauuuguuaaaggaaucugggcagaacauggaaguauuaaauacugguaggaguaagugaucacucagccuacuuacuggugauaaaacauuacauuuagaaaacuuucaccacauucagauacaaauaacacgggaauucaaaagaaaaguaggcguuauugucauuuaguaacucaucucagcuuuuuucuuuuuugcuuuuaaagcaaaaucacgaggaaauaacauacagauaucuuaaaagguugccuuagcccuccccacacuggaaaacaaaggcaagccgcaaaauggcagcucguuacaugaaacacacaccaaaaguauuuuuugcguguuuuuuugagacagagucucgcucuguugcccgggcuggagugcaguggggugaucucggcucacugcaaccucugccucccaaguucaagcgauucuccugccucagccuccugaguagcugagacuacaggcaccagacaccacccccggcuaauuuuuguauuuuugguggggacaagauuucaccauuuugcccaggcuggucuugaacuccugaucucaagugauccacccaccucggccucccaaagggcugagauuacaggcgugggccacggcgccuggccuuaaaggauguuuugaagacuuuuucugacuuuuugcaaacacaggguucaccguguacgcgaugucacuuuggugugcucggaaucucaggguuaauaccgccgcugggcaagggcagggccucguccggguucuggagugggugugcggcuccucucucggcccucagccucuucucuucucuccacuuuagccgugccuuucacacgugcucaguguuaucaauccauucuuggaccuggguggggcaugcccuauaaauaaauacuaaaccaggcauccuugccccagugcauacuucugacagaugccaucagcuuccacccacgccuugggcagaugccugccucacugccaucccuccugcccuggagauaccuaccagauacuaaggagccgggucucuccccagggcuccuggcucucccagcucuggaacagcaccugggacccgaagccaucaugugugaggacacugagugggugccaggcacucucccaagcccuucggacggcaccucacugacuguucuccaagccucugaggcaggaacuacuauuacccgacucugcagauggguaaccugaggcuccaagugguuaagugacuugcuggaguaaauggggaagaggagauuugaaccccagcauucugacuuccauacuaccccauuaaccacugugccagaccagcuucuccaugcgacuggccuucgggauuuggagacagcuacuguucgcuguagcuuucacgagaaggacugcaaggcagggcucacaucccgagccauucucugguggccgccgcgcauagacaagccccgcucagguccgccuuccguucaccccaggcuaccucugauugacaauaggcagcugccacacugcagccucugacaccaacuuuuaucuuauuucaucuuauuuuuugagacagagucuugcucuguugcccaggcuggagugcaguggcaugauaucagcucgcugcaaccucuccaucccagguucaagcaauucuugugccucagccucccgaguagcugggaguacaggugccugccaccaugcccagcuaauuuuuguauuucaaguagagacuggguuucaccaugauggccaggcuggucucgaacuccugaccucaggugauccacccaccuuggccucccaaaggcugugagggaugacaggcgugagcuaccgugcccagccaacuuuuuaucuuauuuuaaaaacuacauacguaaugcauacauucauauauggcaacauuucaaacaccguguccuguucuuaaugaaaugcuuuuuaaucuuuccccgaauaaauccaaagagggguggcucagcgcucaguaagugccagaggccacgcgcuuuguuuacuccucccccagagcuaaggcugaacaaauaaacagcaaugacagcaacaaaaaacaaaacaacaaaaaccaaagcauuguguuaaugagccugagccauuuccaaauguccagacagugaauaaacagauggcagcaucuuuggaagcaaaugaccucuggucagaaguuuggggugcauugcuuuucccugcacccuugcugguugaagaucgucuaucuguccccuguuuauguagcagacgugugcauacuacaugggcuuaucuccuagcguccaggccaaaauacaagcugagcaaagguaaucaucgcuccccaaguccaagccccgggaaaggcaggggcugcaggaggaggcggcccaggagcuaagggggcgugaggugucucccuccaggccggcccgggccauuucuucacgggcuuucucuaccugggaccgcuccggagacaggccaggagcccucgacagacaaacucagagccacagggagcugucccucgggaaaccaucgaaaccgcuuaguaaccaacuccaugggucaaggcccccgcccagauccuucucccuguccagaggggggccuggcccuggcuccucagggaagcugaggccucgggauuggcacagcccugcaggucggagggagcgcgcgggcggggaggagcuugcuggcgauuuccaccugcacccgcgccccgcaccccggccucuucccgggguuacccucccaacggcccucggagcccgggguggagaggggacagcaggaggagggcccucccggaaccccugcggggcugucuuuggcgccaaaggcggccggcgcugagggcaggacccgcgucuccucgcaggcuagacucuggccgcuccagccucucgcgagcgccaagucccaggggccgauccaacuccgagggagccccugugucgccuugucccagcucguccccgaucgcucuccccucaccucccagcuucggagcugcgagcccaggugccugcccagcgcugcgcuccagcccccgcccgcggagccgaaccgccccccggcccugggccuccuaccugcagccgucgcagccccgggcaucggcguccgucccggcuggccuggcgcgggccccgguuucgcugcguccccu

SEQ ID NO: 192875 - RNA, 83637 nt, Homo sapiens
aggggacgcagcgaaaccggggcccgcgccaggccagccgggacggacgccgaugcccggggcugcgacggcugcagguaggaggcccagggccggggggcgguucggcuccgcgggcgggggcuggagcgcagcgcugggcaggcaccugggcucgcagcuccgaagcugggaggugaggggagagcgaucggggacgagcugggacaaggcgacacaggggcucccucggaguuggaucggccccugggacuuggcgcucgcgagaggcuggagcggccagagucuagccugcgaggagacgcggguccugcccucagcgccggccgccuuuggcgccaaagacagccccgcagggguuccgggagggcccuccuccugcuguccccucuccaccccgggcuccgagggccguugggaggguaaccccgggaagaggccggggugcggggcgcgggugcagguggaaaucgccagcaagcuccuccccgcccgcgcgcucccuccgaccugcagggcugugccaaucccgaggccucagcuucccugaggagccagggccaggccccccucuggacagggagaaggaucugggcgggggccuugacccauggaguugguuacuaagcgguuucgaugguuucccgagggacagcucccuguggcucugaguuugucugucgagggcuccuggccugucuccggagcggucccagguagagaaagcccgugaagaaauggcccgggccggccuggagggagacaccucacgcccccuuagcuccugggccgccuccuccugcagccccugccuuucccggggcuuggacuuggggagcgaugauuaccuuugcucagcuuguauuuuggccuggacgcuaggagauaagcccauguaguaugcacacgucugcuacauaaacaggggacagauagacgaucuucaaccagcaagggugcagggaaaagcaaugcaccccaaacuucugaccagaggucauuugcuuccaaagaugcugccaucuguuuauucacugucuggacauuuggaaauggcucaggcucauuaacacaaugcuuugguuuuuguuguuuuguuuuuuguugcugucauugcuguuuauuuguucagccuuagcucugggggaggaguaaacaaagcgcguggccucuggcacuuacugagcgcugagccaccccucuuuggauuuauucggggaaagauuaaaaagcauuucauuaagaacaggacacgguguuugaaauguugccauauaugaauguaugcauuacguauguaguuuuuaaaauaagauaaaaaguuggcugggcacgguagcucacgccugucaucccucacagccuuugggaggccaagguggguggaucaccugaggucaggaguucgagaccagccuggccaucauggugaaacccagucucuacuugaaauacaaaaauuagcugggcaugguggcaggcaccuguacucccagcuacucgggaggcugaggcacaagaauugcuugaaccugggauggagagguugcagcgagcugauaucaugccacugcacuccagccugggcaacagagcaagacucugucucaaaaaauaagaugaaauaagauaaaaguuggugucagaggcugcaguguggcagcugccuauugucaaucagagguagccuggggugaacggaaggcggaccugagcggggcuugucuaugcgcggcggccaccagagaauggcucgggaugugagcccugccuugcaguccuucucgugaaagcuacagcgaacaguagcugucuccaaaucccgaaggccagucgcauggagaagcuggucuggcacagugguuaaugggguaguauggaagucagaaugcugggguucaaaucuccucuuccccauuuacuccagcaagucacuuaaccacuuggagccucagguuacccaucugcagagucggguaauaguaguuccugccucagaggcuuggagaacagucagugaggugccguccgaagggcuugggagagugccuggcacccacucaguguccucacacaugauggcuucgggucccaggugcuguuccagagcugggagagccaggagcccuggggagagacccggcuccuuaguaucugguagguaucuccagggcaggagggauggcagugaggcaggcaucugcccaaggcguggguggaagcugauggcaucugucagaaguaugcacuggggcaaggaugccugguuuaguauuuauuuauagggcaugccccacccagguccaagaauggauugauaacacugagcacgugugaaaggcacggcuaaaguggagagaagagaagaggcugagggccgagagaggagccgcacacccacuccagaacccggacgaggcccugcccuugcccagcggcgguauuaacccugagauuccgagcacaccaaagugacaucgcguacacggugaacccuguguuugcaaaaagucagaaaaagucuucaaaacauccuuuaaggccaggcgccguggcccacgccuguaaucucagcccuuugggaggccgagguggguggaucacuugagaucaggaguucaagaccagccugggcaaaauggugaaaucuuguccccaccaaaaauacaaaaauuagccggggguggugucuggugccuguagucucagcuacucaggaggcugaggcaggagaaucgcuugaacuugggaggcagagguugcagugagccgagaucaccccacugcacuccagcccgggcaacagagcgagacucugucucaaaaaaacacgcaaaaaauacuuuugguguguguuucauguaacgagcugccauuuugcggcuugccuuuguuuuccaguguggggagggcuaaggcaaccuuuuaagauaucuguauguuauuuccucgugauuuugcuuuaaaagcaaaaaagaaaaaagcugagaugaguuacuaaaugacaauaacgccuacuuuucuuuugaauucccguguuauuuguaucugaauguggugaaaguuuucuaaauguaauguuuuaucaccaguaaguaggcugagugaucacuuacuccuaccaguauuuaauacuuccauguucugcccagauuccuuuaacaaauacacaaaacacacuuguagcuggcaacauccacucguguauaaugaaaacacacaauggcuuucuuagaaguuugccuucuuaaguggguuacacaggaugccucgaaaauccuucucugugggucgugcagaagguauuuuauucuaaaaauucccucuacucagccgggcgcaguggcucacgccuguaaucccagcauuuugggaggcugaggcggguggaucacgaggucaggagaucaagaccauccuggcuaacacggugaaaccccgucucuacuaaaaauacaaaaaauuagucgggcguggugcgggcaccuguagucccagcuacccaggaggcugaggcaggagaauggcgugaacccggaaggcggagcuugcagugagcugagaucacgcacuacacuccagccugggcgacagagcgagacuacgucucaaaaaaaaaaaaaaaaaaucccucugcucauuggcauuugaguguaagacagcuuauaccaaagugggcucagacagacauaugcacauguuuacagacuuucugccugcccccuggcaguccacucugugcucaguauuucuuugcaggcuaaacacucgcucauccaaagugcuuucuuuuccuggacaaguugcacaucacagacccaaagaagaaaaagauaauccagcccaacucuuguuuuuuaauguuuccuguaauaacucacauuuagcccaugguggcugugagcugguacuuggcuaaaaaguuuacauuuuuuucccuguaauccccacaauagcccguugaaguagauacuauaauuaugcccauuuacagaugaggaaacugaggcuucaacuggcuauucuacuugcacagggucacacagcugcaaaguacgggaguggggacuccagcuaugaccacgaagcugggacuggggcugccaaaccauccuuugccugggucugccguuggcucagacacggcccccagacaccuaggaccguggaacauucaggccggaagggcccuuccagaacaucuaagccagggguagagaguccagggugcugugagccuggauggggaaaaauggcaccuuguauuaaccucaaagcaaauuucagcauuuccucuaguuuugaauguaggcagcaaacuacagucauagcaguaccugugaccucaccagugggaaccacugauauuuucaugguguccgguaauagcugcagcaucuuaaaaagugguuugugcuugucgcuccguugcaauuauggcggugauuagaucugcucucaggcuuacgacuuaauguaugaacaaagaagcgcacauaugaucaccucccaguuuugcuuuuuaaauauuagggucacuuuguaaguuuucucaggcugcuguuacaaaugaccacaaauuaaguggcuggaaacaauagagaguguugucucacgguuguggaggcaggaaucugaagccaggugugggcagggucggguucccucggaggcucugagagggggcucgccuccugucucccuccuaggaucugggggcugccggccauccugugguucccaggcaugcagaugcaccacccagucucugccaccaucuugccauggccuucuccucugugucccugugugucucuccuuuuuugucccuuagauggacaccuguccuuggauuucgggcccaccuggaaaauccagaaugaucuuaucuugagacccuuaccuaaguggcaucugcaaagacccugauuccaaauaacaucccauucugaggcucguucccagaggcugcauccaacccacuagaguggcuauguuucaguaacucgugauccuguguauuuugcuucauguauuuaaaacauucucccggacaaggcgucugagauuccccaggcugccagaggggccauggcgcaaacggggaagaaaccuggucuaagccacgccccucuuuucaggacgaggaucuuggaacccggacacugaaggucgggguugggcacagccggggaugggcagccccccucucccccagcaccucccgccuggcgccuccuccacagccccugcauccuggaaaacagacuguuccacacacuccagcagcuccucuaccuggggacugcuugggccgcauagcccccaguuagggacagaaaccagagguauugaacaagaagccccaccgggagaggcgagacccgggccccagcccuggaccuggccgugggugcuacagaaggucgggggacaucggucugcgcggaagggucuggagaggcaccucucagggaguuggacagagaggagacgccgucccagugguggccuccagugaggccuggagagaccagguggcaggaagggcccugcuggggccagagcaagggcacggaaggcaggucucauggagcagggaccguggaggggacaugggggacacauuagggauggacaguggccggaagauuccgugggccuuggagauuaaaucggguuccccaaagagcaagcuguggagaggggaagggaaaguugccucccucuucccuacgggguucuugucaauaaacgauugacaaaagacagacucacaagagacaacaguuuuaaggcugugcccccgcccggaagugccauaaaaacaggagacucagcaguaaccagaugggagcggugcagauguccguccucugugacagaaaggaaagggggccugggcuucuggggagcgguagagacaaaugaggagagggugagggaggaaacgucugggcauaaaggcugccucguggugcagcuaucagucucauggugagaaaaugcgucuuggcgcgcggcucucuuccuggcacacagaccauuacuaaugaaaauguccuuuauagaugucaauuuucuuuagaaaagagaguuuuuuacuuuauuuuagggagcugaagagcuuuuuuucuguuggcugguucucaguugcuuuuagcucaaaguaaucaacaugucaacauggcauauuuuggggugacguauucuggucuccuacagucauauuuuggggugacguauucuggucuccuacagucauauuuuggggugacguauucuagucuccuacagucauauuuagggguggcguauucuggucuccuacagucauauuuugggguggcguauucuggucuccuacagucauauuuugggguggcguauucuggucuccuacagucauauuuuggggugacguauucuggucuccuauagucauauuuagggguggcguauucuggucuccuacagucauacuuuggggugauguguccugagccccauuguuuccuagucugaaacuuccccaagaagcuccacgguacagaaacuggguggguguguugucccauaaugcuuugaagaggcauuucuauggaaacaaaagaaaaaaaaaaaaagcuaaucauuggagcugacuaaaaaccaguuucugagccugggggccguggcggggcagguuuguagauguugggcuccgagcaucuucugcgguuuggucucuggcgaugucugggcggcccacgcagcaacaggcgugagggucccucgcaccugggcuucgugguaaucucgcugaugaguauuucaagucguccagccucaguuugcaggauuucugggcaaagggcaguuuuguucuucgugauuccaauaagaacggugggagaaaauugaaaguguuaguuugggaguugcagccagauacuggaggaaacuagaaacaucaggaacccguccaguuuguagacaucaauagauaacaaaaccccaaagacguuaaacaggacaagaaucuaauauggggcgcacaauauggcuuucuacugaaauauauguucuuucuacaucaccccucuuucuacuaaaaauaaucucaguaagauuauuauuauuauuauuauuuuugagacagaguuccacuccgucgcucaaggcuagaguguaguggcaucaucucgacucacugcaaacucugccucccggguucaagugauucuccugccucagccuccuggaguuacaggcaugcaccaccacuaauuuuuguauuauuauuacuuuuuuuuaguagagacaggguuuugccauguuggccaggcuggucuugaacuccugaccucacaggauccacccacuucggccucccaaagugcuaggauuacagacgugagccacugugcccagccuagucagauuaacuuguuuguaaaguaagucuagccucauuaaaauuggccugauuauuugcacaagugcagcaagaauaguaaguggccagcuaggcuuucuuuaggucagcuuugcuggaacuuuuaauaaaucucagguuaggcuuucaaaagccucuugaggcuaagaagucaagccaaggacuugauaucagacuucaccugcaauaccuauagauuuggguggauuccucuuucucaagguucccaacguauucuugagaauuacugccaaaaaaucacagucuuuccucaacccgugaggcugcagaagcccuuuaauccagguacaagggcaauuuuguuuuccuccaacggguuucauuggcuccauaaagucaaccuuaguuccuuaaagcuacucacaucugauuuuaugcacaucacucucaaauaugauauuccggucaaacacuuggugagcuaaccaacauuuccaguuguuuccuauuacaaggcagcagauucaucuugaacuuaagcaaauaacucuauggccguaaaaauaaaaaugcuaauaguuucuaaauucuggagagaucagguagggagaaaagucaucauuucaauuuugcuuauaaaaguguaauguaccagaaugcuguaaguuauaaauaguuucuucauuuacauucuggaaauucuugccauccaguggugugaucuuaauguaucagaaaccuguacuggucaaagucuuccccaugaaaucuucucgaagacacaacauuuuagaauuauaguugcuugcaaaagcuuucgggaaagcaucagagccaaacaguuaacuguguaugacagaaaggcuuaaaauggccuuggcuaaagaugugaugacaucauuacaauguaacugaugaggaaguuugguuauuccugugguguauacuuucacauaauaacuagaauuacaacuaauauagaauguaucagauuucuaagaauuucauauaauuucuggaacucuuauaugaauauauauccaugcaaauauaacucacccagagaagguuaaucaucacuucauauuuuacagugcuuccaugcaaauuuaguugaucaaauaagcccaauuuauuuaauaucuuuuuauuuuaucuaaaacaauuuucccuuuaacauuggcaaaauaaucuauguuuuuauaaggagagaaaauaaauccuuuugagauauuccaggggccaaucuaggaaaucccaaacguuaauucagggucaaaaagacuuaauuuagagugugugauuuuggaaaguugucaaaaugucaaaagguugaaagcacuugauuaaauagaaucccagaucauuaugaaauaauacuuaauucucauuuaaucaaaguaacaaugaaauauucaaagagaaaugcagaaaguuagauaguuuaaaauacucuuagaucuggccaggcauggugggucaugccuguaauuccagcacuuugagaggcugacaugagcggaucacuagagcccaggaguucgagaccagccugggcaacauggcaaaaccccgucucuaccaaaaauacaaaaauuagccaggcaugguggcacaugccuguaaucucagcuacucgggaagcugagauaggaggaucccuugaacccagggagauucaugccacagugagcugagaucgcaccacuguacuccagccugagcaacaaacuguauauacacacacauguauuuuguguauauauauauauauauaauauguauuacauauauacauacacuauauauaauauguauuauauauauacauacacuauauauaauauauguauuauauauauacacgcuauauauauaauauauguauuauauauauacacacaauauauauuuuuuauuuuauuuuuuauuuuuuauuuuuuuuaauuagcugggugugguggugcccaccugucucccagcuacucgggaggcugagguggcaggaucccuugaagcccaggaguugaggcugcgaugaacuaugauggugccacugcacucuagccugggugacagagugagacccugucucaaaaaaaaaaagaacuaguucacacccauguuuccuccugcugccccaaauugccacucuccuggagcagccccugaagguggagaccaggcaccugcuggagcaggaacucuuccuucaccggcuucuguuggggccccaggauccugcagcuguggcauccacagggaguaaggccagccacggagguccuuucaugucaccaagcugcaggggaggaaaagugacaucagacagaucaacaggagaaaacccauuuuaaugauauguccacgaaugggagucccacacggagaugaaacugggggaaggggccagauggcggaggcgucugcgucauccucagcugcaggaagauacaggacuguggggcugcugcaggcugaaccagcuauagcaggggaguugacuggugaaugaaggugguuucgucacgcggacaugcgucucucaggcgaucagaguuaccuggagccgcucuccucccggcauagagaccuuuacgaauggaaaugucuuucauuucucucccagacaggcagcugggcagagccacuccugugucugcaguuacucgaaauaauggauauacccaaggcauguuugggguggcacauucugcccccucaagccauguuuuggggugggguggcguguccugagccccaacccaggugucagggcuauggaggggacauugcaagggggccuagaggggccucuaugggccuuggagauggaaucagcuccccaccaggccccaggacagaccuggcuggggagcgcagggagggguccccagugugaggacagcauggggcugccucuuccagcagcuccgagcgcucucagagaaaaacgaaauucucuuuuauaagagaaacuugucucuggucccauguguugcccuuugggcacuggcaugaguaaucugagggcggcgcuuuccucacugcaguggcaucauacagaugagggcuuugcugaucauuaucuggaaacagugaucacugucccauucacagauggggaggcugaagccugggagaucaauucaugccaccaagaucagcugcaggccgggccacccaugccugaggggagaaggggccucucuucuucacgaggcugguggcugcggcaccuacaaagacagguuaacaagaggacccucugccuaucacgagccugguggcugccguaccaguaaugaaagacaaguuaacaagagggccgugcaggcuuauuuacgagaaguuccaugugacacaggagccuugagaauggaacacccaucgaaccggggaacucugcauauuuuccuccuggguuugugggguguggacagcacggagcgugaugaaaggauacaggcggcugggcgugguggcucacgccuguaaucccagcacuuugggaggcugagucgggcggaucacuaggucaggagaucgagacuauacuggcucacacggugaaaccccaucucuacuaaaaaauacaaaaaauuagccaggcgugguggcgggcgccuguagucccagcuacucgggaggcugaggcaggagaauggcgugaaccaggaagguggagcuugcagugagccaagaucgugcaacaaugcgagacuccaucucaaaaaaaaaaaaaaagaaagaaagaaaggauacagacauccugaaccgggggcuggggccaggucugaaggcucugaucuuccuuucuucugggucuagggcacaugagggucugugaccuaauucagaggaaggccagagaacucuuuuauggccugccucagggugacagggagcaggagagagcauaccugcuuucccuggcuucucagaugccaccgugccagguuuugggguagugguaugucuugagcccaaucaguacccugggggucguggccggccccccucccuccaugccacaggcucucuggagaggccacugcuguauccccacugugagcucgaucugagcugccuaugggaccacaccugagaacccccaaggguggcacuggcagacuugaggugcccaagugaggcuggugcagccccucugcccugccagucugggcacgggccccugggcaucgcgacuccuaccuuccuaccagcccagaugcagggccugagccggcagggcuuccacccagcccagggugugucccccuaccagaggcgcugcauuggauaggaaggacccaccuguuucccugcccaguaccagcuggcaggccccccguggcucagggugccugugaggaggggugggggcucuaauugcucaccugcugcucugaggugucaggcaggguuggggguggcaccuggggaaggcugggcugagggggcaggcugccccuccugcaggagaggugcaguauuucacuggguccuuuggaaagggcagggaagcuccugcucgcccguacugcaccauuuccugugaucuuagcaaugacuuccuggcuccauuuucuccaccaguccgaauacaugagccagacccgcagcuuucucuuccacagccuccuggccuccggguccaccuggguggugcccacccgccagacuggggccuggugguuguaggggacggggagcagccuugcuucagugugggucauuccugacugugagaugguuggggggcagggguuguagagucugugggaggccucggcugggccucagagagggguaucucuucugcagaaaacccagccacccuuaccagaugcggucaggcuacaaagggaagaugugcucccucuuuagaggcaggugauuccugugaauccgaugaccgagauaaggugcacgauucagugggcaaggcaacucaccauccucucuuuaugguccucgcaauuugcaccaugcacaaugcagggugaagucagcccccaaauuacagaggaaagacucugcggucuuugucaguuaaacaggagaugcaaacuccaagcuaguuaaugagcugugaucggccacgcucacgauucagugcaggucucuccuuccugcuaucacagucuuugccggcugcaucaugacuaccaaccaguccccucauaauuacaagagucuccugucauguuuucuucuggagcgaggcaugcuccaacuugcuucuggguucuuaauuuuugaucagggacggcuccuugacuaauuauuuggcaguaaugagggaggacagaucgaguugugaaagucccccccaagcuuuuagaaggaagcugcaaauuaaaaaaugagguauugguaaacaggaugcuaauuggauuaauaugaaaaugaugaauucugauaaaaauagcaaaauacaccguuguaagauugaggccaguauaacuccaagaauucauugucuaauguucagcuggucagucuggucuuugaaaguauuagaauaacagaaagagucuacucuugacgaugaaguauacgguuaguaauuuaugcaaaacagaacuuuaaaaccggaaggacuugauaugaguggggugcauggaaaucauucguauuuugaaguuucauaacucugaccccuagguccuuugguuugucucucuuuucuuuuuuuuuuuuuuuuagacaauuucucucucugucacccaggcuggagugcaguggcaugaucuuggcucacugaaaccuccaccucccagguucaagcgauucuccugccucagccuccugaguggcugggauuacaggcaugaaccaccgugcccggccuuuuuuuuuuuuuuuuuuuuuaagagacagaaucaccaggcaagguggcucacaccuguaaucccagcacuuugggaggccaaggcagguggaucaccaggucaggaguuugagaccaaccuggccaacauacagugaaaccccaucucuacuaaaaauacaaaaauuagcuggguauaguaauuccagcuacuugggaggcugaggcaggagaaucgcuuuugaagccaggaggcggaguuuguggugagcugagaucgcaccauuguacuccagccugggcaacaagagcaaaacucugucucaaaaaaaaaaaaaaaaaaaaaaaaaaagagagagagagagagagaaucucacucugcagccuaggcuggugugcaguggugcagucacagcugaccacagccuccaacugcugggcucaggccauccucuugccuguguccugaguagcugugaccauagacacacaccaccacauccaguuaauuuaguuuuguuguuucuugcuuuuagagacagggucuugcuauguaucccacacuaaugaauguaaaaucuuaaaauggugccuggugcagaguaagcuguguguuggugggguguaauuaugggucauauugacaguuucacuucugcggcaugcccucaggaacucacugaugcacacagagggaccugcuggcaaauacugaagagcuguggggagaaaggaaggggucugacagugaaggugggugcgugggcggggggcuuuuaauggucccucugcuggcucccuccccaccaccuccugcccaccucccuggccuuggcugcaggcuagggugcccuuugaccucaaagaggccuguccugugugucucacugagcaggaacaaaccgucccagaagcccuucagcucggaagugaguaagcauuggcgguggggauggugcucugagcagacgcgacucagugccaugcgggcgucucucccagggcggcuuucagacugacccccaaacagagggcucagaaaagauguuuuucaaugagggacauuuaugguuggcaaaaaaaaguggcuccccaaaggucuucacgucccaauccccagaacccgugucuauguuauuucccauggcaaaggggaccgugauucagcuauuuugagauggggaggccaucuggcaggauccagguggguccagugucaucagggggccccacaagaggggugagagagggagcugaugauggaggcagagguuggagggaugcauuucagagauggaggaaagugucacaugccaaggaauaugccugcggaagcaggagaggacggggagguagggauugucccagggccuccagaaccaagagaagacaggggaguagggauucucccagggccccccaaagacaggaagagggggaaauguauucucccggggucuccagaagcagccagcccugcccgcaguuuggcuuuagcucccugguacccaucucggacucugaccuacagaacuguaagagaguaaauuuaucucauucugugcugcucauuguguggucauugguuacggcagccacagaaaacagacagugcgcacauccgcaugguccccucuccagcucuugccugauaggcauaaacgagggcagcugggcgcgguggcucacgcuugcaaucccagcacuuugggaggccgaggcggguggaucaugaggucagaagauugaaacuauccuggcccacauggugaaaccccguuucuacuaaaaauacaaaaaauuagccaggcgugguggcacgugccuguagucccagcuauucaggaggcugaggcaugagaaucgcuugaaccugggaggcaaagguugcagugagccaagauggagccacugcacuccagccugggcgacagagagagauucugucucaaaaaaaaaaaaaaagaaagaaaaaaaguaaaaaagaaaaaaaggaaauaaacaagggcuugcccuguaguucacaucuggaccacccagcuuaaaauagggcaggggaguucaggaauagcuuugcaacccuuguguuacggugcacaggugugcaaaaauucuccuugaacucccccuucaguguccccccagggcucauggccacugucacucugugcuaguugcucuucagaccagggaacagacuuggccauggcuauggccaggguccagcugcuauugcuccuccugucacccacccaccuuuugucuccaacaaggauguugagaggagccaggcaccagccucccuggguucaggucuuuccucuccccucacuuuccuaugaacuaggggugggggaggaggagugccugccaggaggucacugcagccaaggaacccaaauuggugugcuugagaaugacccauggauacacuuuccaaagagucacccggcugcgaugaggggccaucuccccuccuggagccaacagccaugaguagcugucacacacauccgugcagcaccuagacacacauccgugcuguccacuccgugcugcugcaauugugggggaggaagguggcacaguggcagcgacacacacuucccucuccaaaauuggggcggggcuccucaaaauccucugaccagcauuaaagauucagaauuugauauuauggcugcauauaauguugaauuaucugaacuugcugcacguguguguguguguguguguguguguguguguauuguugguaggaccaaaacgguuaauuaucagcaauuucaugguuugaccuaauauuuuaaaagagagguucuuaccugcuggaagcauguacugguguauuacggaugagacggucucauagguggaauuugcugugaaaugccccaggaaacaaaaagccagaggucagagugaugagagcuggggacggguggauggguuccugggccguucccuguagugcugagugugcuuggaaguguccacaaugaggaguagaaacgaguacaaagcuggguggagacagcccuguccuggcugcccugagcucggcccugucagucgccuugaggaggguuggggggagcagggaugcaggguggcgcgugcaugccagguggcaggcggcaggugcuggcuccaggcccgucuccagccccagggcuccaggccaugcuccgcccccagcugcccugcagcuccaggccggccacgcugccgccuaguuucgcaacuccaaugucaucaccuaggugacagggacgcugcugccaccgcccgccugcgggagccaggagccagccgagggccacuuccaccuggccccaccgacccuccggggcccaggcuuagccaagguaggcuugggcuuggcucgcccuccucucggccugagucggggggagucuccuugccaccgugggugcaguggcuccgggggcccacccuggggugcagagagccccucuacggccucccaggaggcggcuuggaaaugcaguacuguucaggccaggguggggaggccuugcccacaguucuccugaugggacaagccacagcucuggggagccaucugccccaaguggcacaucagggcuccucgugugacccuaggaucgggggcagaaguggcucugguaccgccaccuccaccccuuggacccaccaggagcucuuuccacuuccugccaaggaggcgcagagugacugccccagccuggcacguccgggggcuucccggcugggggccgccauccucagccucacacagcugauccagaaccucccaguucuccccagcccccucacucuuuuguggccccggagccucucccggcaacagcaagccaugccccggccuccccggcacucacgcagcuacucccaagccugaccaugacguggacggcaggaaggggcugggcauguccuguuccuucugccuggguccugcuuccagggcuggacucccaggcuggggaauccucagggacccaucaaacugggggacaggggaggggcuuguggggauuugcugugaggagggcagaguguguacguggcagugccugcggacacaugugugcgcauaugugaauagguguguccaugugcauguaugugcaaguguguugcuagaggugagaggguggguagggaaacugagugaccagcuccucccugaagccuugggggaauguccgaggggccagggccucuggauccuguucccuuggcucuuugcaaagucuccagccuggccuccuggaugggcauguggcucggggggcgagaccaugggcucuuccuggcuugcugugucgcucugggugcguuuuacaccacucugaggaucucucugcucaucccuaaggcagggaugaugauggggccaggggaccacaugggcacagguaaggcagggaugaugauggggccgggggaccacaugggcacaggcuucuggaaugugggugucgucucccuggggucccgcagucugaacucaagacucaagagccccauguccagguggggauguacaggagccccuuagaaguggggaagaaggccaggcgugguggcucacaucuguaaucccagcacucugggaggcugaggcggguggaucaacagaggucaggaguucgagagcaaccuggccaacauggugaacccugucucuacuaaaaauacaaaaauuagcugggcgugguggcgcacacagcuguaaucccagcuacuggggaggcugagucagaagaaucauuugaaccuggaaggcggagguugcagugagcugagaucguaccacugcacuccagccugggugacagagcgagacucuaucucaaaaaaaauaaaauaaaauaaaaaagauaggaaaagaaaaagaaaaagugaggagaaaugaggaggaagucgagcaauuuaaccccaaauggugcuucuccagcagucacucuguuccuguccugaccugaccugcugggccccgcccgcucaaaccaaaucauggauucugucaucgcuucuucacggagcaccuacugugugccaggcgggugcuggggcugcagcgcagagagcagucagggcuugguggucuggcccgcaaagagucagcaugugaaugucucuccaugcgaugggugcugggagggaggagcccuggcaggucuggggaagaccagcgucucuuaaaugggggugcgcgggcccugaggagugaggcuuccugacagccgucccucgugggugccaugcuggucagaguggggucuggcugcacagccucccucagggcugggcuggaagcacaggucggcuggcaccuguccagguuucaggguuccagggcuccagcuggaacugccucagggauggcaggggugggccugucccuggagaggcguggggugugggagcugggagcgugacgggaagcagcccccucagaccuggaguagcauggagccuaggauccauugugaccuuggugguccuguacccuguccagcuccaguugcuguuccugccucucccugaccuacuggcugcccaggcugccccuuggccgagcuccaccauggccagugccccuccauucgcuugugagucccacaagaucacagcccugcccagggccuaggcagcucuugggcugacccagccaucgucgggagcccccuucgugacgggggcaaaggcuggaucguugucugcccugcaggagccggggccuccagaggacgggcugccuggcgggaagguggagcucaccggagcccagccuaagccagcuguggugcuucugagaugugcggcccugggcaggcugcucgcccucucggggccucugggaacaccuggggacuucccgcuggguuccucugaggauugaaugagcuugaaaauauggaggauuuggcacagggaaugcugggcagcaauaucagaaaggcaacccugagagccagcggacagccacucugaggaacagcaguggcugccucuggaaggagugagggguggguggacccccgugaucgcugcacgggggaggucacggggcugagcggccaccacugugcaggggaggucacagggcugagcggcugacuccagaacaggaagggaacacgccaggagggaggauugcucacugagucagggcgggacucagagggacgcaugacaaguucagggaguugacagcugucuggaagggcacgucugcucagaccgcaggguagggaguggucagcagggagacauguccacuggugcagcgggcgugucccagaccccuuagagaaaagcccagagccaggggugagggguauguguaggguggggacaucucagaguggagcauccccaccaaggguguccagaggaggguggccagguggggacagcagcuugagaagggucauucucucuugguuggaggaguggaagugcuucucuggggaaagaaagaagauucuggaggacagcacaggcacuuccaacaugggcgcuggccgcacaaaggcuagugacacccggugugaucccuugggguagaaagggggugugagaggaggaucggagggggcagaggacagggaugugucugugcagaacgaggcuguggcagcuccagcgaaggcggcugcggccccaucagucaccugcccugcugagggcagcgcuguacucaucaccugugaacacagguaucgacucagacacccacucuggccauaagcuccgcucugucccagcccuggaccccucacccccuauccuuggcagucgguccucugggucuucuuccugugcccacugugcuggucugaaccucccuuagugacagaucugcuccuaccacccccgccagggucgcccuuccucuaacaggugggcuccuggcaggaaacaucaccaagcucagcgccccaguucccugacagggccccacuucccuccugccgccaaccucguccccccaagggccaugucccugcccaccccuuccaccccuuucuuagaggaagcucagcccaucaggccgcucaugcuucugaccccaccuccaaacccuccugacccgcuuacccccaggagcaccgcccacuccaaggcgcaagcaagcuggggcuggggugcagacuucucuuccaccacccacccuccucauacccagccucugagggccucacagacauacaugauuugccuccagugggccaggguuaucuguuuaccgcguugcaugcccccgggcauggagcuggcaccggcugccgcugcaacugggcacuacccguuucgaggacgccucauucccugagagacugaggauaggcuggugcucugcaaaagggugcggagaccacuguaaaaguggggugagacacgcgugcugaccaugaaauggagaggcacucgaaggagccagggacccggcagccagcagaccccaccuuuccgcccccgugugugcaguucugucgcucagccuggugccuuugggacccgggccucauugguucuuccuccacugccaccaccugauacuaaauaaccgucggucaauggcaacucgauacgguuuauggggcauccacggugugcccagauagaggagugcuuucgcuuuugauaugcguagaguuacuucauuccaccuagcgcuucuaggaggcacuacaauuaucuccauuuuacagacaaggaaacagaggcucagaaugggcaagacaucuaucugaggucacacagcuagagcgcggcagaggugggcugcgugggcagagcaggagagggaacuggagugugugcccggcagugcugggcuucagggcacgaagcgguggggcaggaaucaugugucuugguaugacccaaacacauauaugacagcaagaaggccugggcaggcagcagaggacaaggcgggccucuuggaugucuggauguggauugggccucaauguaccggugaagauagauggacaggcaggggauuuccagagaggggcuucccaggcagggugcgggguguggcugugcggugggaacacggacuggggaggggauugcagccgggcccgugccucccuugcucagcuccaggucaggccaggguagagccaggcugcuggguucgaccuccacccugaccagcugugugcccauggagggcuggucuucccucucugugcaugucuccugguugguaacagguguguggccucacugggccgucgugggguggcuggaauccccgggaauuagccaugcuuugguguuucuacauuucacuuggcugagugugaacugacccaggaagcugguugggggcacccccacccacggggggucgggcauuuugguuuggucauggccucaaagcuucuggggugaggcucagggauucccccagacuguccugggcaucugccuccccuccccucccgcuucccgugggccacggcccaggagagagagggcagcuugcucaggcaccuccagcuguccgcauauuucacacggugcacgcuaccccaccgugggaggcuguguuugucuuucauccccaugcugggcuuccccaaacuaggggaguggggcagcaggcgugccaucuguggcggugaggggggcucucagccgcauccuccucaccaggcccugcggacaggccuucgucccugccccugaccugcugacgaagccguccuggcaacccugucugaaggaccuggccccaucguacccacagagggaggccacaugguccuuagccucugucgggaggggcaggcaaugcuggcagagggccuugccccugagagggaggcccuccuggcccucacuccgggggaccccuguccuuggccccagccugccaagcgagagcggccccucuucuugcgguggcuggaggggagagugaggccccuuggcacagagggccccaggaggcugggcucugaugacgcccugcaggaauuccgcugggcugcugccugggagagccgcugucucacacagggccagccugccuggcuucauucuggugcgcugaccgcccgaccccucugcccaggcgggggcucuucuggguucuggguccugggaccugccugagucccugggaaaagggcacaaggggauugagacggucuccucccacaauggcccaggugucuccucccacaauggcccaggugucuccucccacaauggcccaggugucuccucccacaauggcccaggugucuccucccacaauggcccaggugucuccucccacaauggcccaggugucuccucccacaauggcccaggugucuccucccacaauggcccaggugucuccucccacaauggcccaggugucuccucccacaauggcccaggugucuccucccacaauggcccaggugucuccucccacaauggcccaggugucuccucccacaauggcccaggugucuccucccacaauggcccaggugucuccucccacaauggccccagguuucuuugccacuucagauuggaaucguugaucugcugaaauaacagguaaaaucauuggugguuugggaaccaccggaaucagaagugcauugagauguuugcuuuagggguggcccggggcggguggaguuccugggggcuuuucccuccucccugaauggaggaggacacccugcaccccuccugugaucccccuuaagagccaguguccgggauggcugggccagacggggcagaggggccugugucuccugcccaggcugagugcggacggcucggucucagagcuccaccgagggguggguagguaacagcagcccugcggccagggccccugcaggugggaguggguguccccauggggagugccucuuccagagugggcucagucgggguggaguguccuggcuuaucaaaggugguuguggagcccugucugccccaggccugggcagagguggaagggguuggggaacugacgaggccuuaccugugggcccauggccaaggaaaugucuggucucccaccuccugucagguggugaggggagaggauggggcgucagccggagacgggguuccuagaggaggcuggguccuggccuggccuggagagauagggaugagaugggagggcaggaagggggugguagacaaaggcugaacacagagagcacauagccaggcauguggggacuggggacaggggacaaggagggcacccauggggacaagagauagggagaggacagagggacaggagacggggagggacagaggaugggggacaaggaggggacaggaggacggggacagggaggggacacagaaacaggagcuaggacggggacagaggaugggagaaggagaggucaaagggacagggaacagggaggggacccauggggauagggcagggaucuauggggacaagggacagggaggggacagagaaacaggagauggggaggggacagagggaugcagacagggaggggauagaagauggggggcuaggggacaaagggaaaggggacagggaaggaaccuaugggggacagggagacagggggacagggagaggacagaggaacaggggacagggaggggaugcuuggggacagggagggaaugcuugggacagggcagggggacagggggcuguggcuuucgugggaagcuauggaagacgaggccagagggguugggcagggugagaugagagaggcugagagccccucaccggcugcggacuccuccccacagggcagaggggagcauucgggugcggccaggccaucagaggaccugggcuuggcuggagucccagcuccucagcccucaguagcuuugggccagccacugggccuccuggccuccacuugcucaucucugaacuggggcaggguuggcgugugagccugaggcccugcaaagugccuggccagccucagcucggagccauggcacagcacccccucuccgccacggccccgacagcugggcgugcguucugcugugggcagcugcccugagcaacguagggugcuaagcagcaucccugucuugcacacuagauuccacagcacccucugaccccguggaaaauguccccacaugggaauauccucuggggguggaacugccccuggugagaaccccuaggcugagaccucagaaggcccugagucaaaccgagaagucaucagagagccuuguuuucagcuccagggagcuugggcaggcugguuuucugggccacacaguccccuccccagcccaccugugcuccgugggucccggggaagcugugggggccuaauugcuggugugaguuccuuuccuguucugagucacacgugugugggggcucucccuguggugcagcugguacagcggccccuggaguugaggauccaagcaggcugaggucuggguuugccggagggcccucgguggcuggucuuuguccugcucccacugcugugggcacuguaggacuuggaacgcuggucaccuuuccagccuggcaaagggaggggacuugucugaggccucauggaaguuggggcagggucgaggugcccugcuuccugggugugccagcagccuacagccuggcuacagcguaaccaggaacacccagcacaacuguccuuugcaacucugugcccugacuugauggugccagggcugggggggugccggccagcagcuccccaaugaccacccccaaaugcuguggccacacaaagccuuccacugcaagaccugugguaauacacacuggacgccccuguuacaacugagaacucauuuauuucauuuccuuccuucccuuuuuuuuuuuuuuuuuuuuagaguuguggucuagcucuguugcccagacuggagugcaguggugcaaucauggcucacugcagccucgagccccugggcucaagugauucucccaccucagcacccugcgugguuuggacugcaggcacaugccaucacgcccucaugcccagcuaauauuuuuuuaaguuuuuggagagcugaggucucccuguguugcccaggcuggucucaagcccuugggcucaaguaauccucccuccuuggccuccuaaaguguugggauuacaguuaugaaccacugcacccagcccaucccuccuagacuaaaucuucuuagaaaaaccuacacuuccaauaauguauuugcauuuuaugauguugauaaaacuuccuaaagaugucuuaugaaauuggucuccuuuccccauugauacacaugauuuuuaaaacuauuggcaacguuucaaaagcaauuucuguuuugucccagaaccgugauccccuugugaacgaauuuucaaauuaaaaggcaaaugguugggaaaauuggauuuaauugaaaggccauuuuauuagaauugacuuauuuuucucgccacugggauccuugccugaaaggcggcugugggcagagggcacauacucccccugccccagcgcagcgucccugcacccccaacagagcuuccuguuccucaugcccaguacucccagaugccugcggagccagucaucagcucaggugugugaggccgguugggggagccccugccuggcgccugugccugugagcaguguuccuguggggcccugggaccaaugcuaccagcguuggcguuuucccaggaaguugggaaucaggcaucucguggcuuccgguucaaguuccuccgugugcuuuaagucugggcagguuuccggguccugguuuuggcuaaugaggaacccgauucccaugggggaggccgguggcugcagcagggccccgagcaguggcaaggcuggcccucaugacaguguccuccucagggggccugucccaggcucuucaugacuccccuggaggcuuguuaaaggggcagauuccugggcccugccccagccccacuguggggagggguguccuggaagaugcaucugcccagggcuuccggcugguccacacgccugcaccuggaggcccacugcccacaucucaggcaaacaggccuggggauguuuggggacccaacuccuggcguggaggaagccccuuucccaccccacaugcuccuggugguggccuguccugugagccuggagggccggacgggugggaucggggacccacgaccacgcucgcuggccucuguccugugcccaggcagggaugagaggccaagcugguguccugcagugcacagugggugccggucaggggauguggaagcugggucuccggcaggcagaggcgcgcugacaagaagggucgcuguuccucauucaggguucagugggaagagagggugucgcuucagggggaguucacaggaugccgacuugaaaauacagccaacgcccaugucccaggcauaagaucacaaaucauguuuugccgaccaguuccugugagcccugagcccugcgcggagggaugccccgugcacaccuguucacggaaccccuggaccuccaguaggggugcggcgggaugccgucggcucccacgcugucugucucccugucccucucucuuucccucuguuucucugucugucucugucugucucugucucccugucucucuccaucucucucugucucucucccugucucucugucucugucucucuccaucucucugucucucuuuguccuugucucucccugucucugucucucucacucucugucucucuuuguccuugucucucuguuuugucucucuuugucccugucucucugucucugucucucucucucuuuguccuuguaucucucugucucucuuugucccugucucucucugccuuugucucucuccgucucucuuugucccugucucucucugccuuugucucucuccgucucucuuuguccuugucucucuguuuugucucucuuugucccugucucucugucucugucucugucucucuuuguccuuguaucucucugucucucuuugucccugucucucucugccuuugucucucuccgucucucugucucucuuccugucucucucuaucucuuucccugucucuuucugucucucuuugucucucucuuugucccugucucucugucucucuuccugucuuucucuuucuuuguccuugucucucucucucugucucucucuuccugucucuaucccugucucuaugucucugucucucuuuguccuuguuucucucugucucucugucucugucucucucugucuuugucccaccuuagccuugggaggggacagcucacaggcugacagaugaggucauguguccugagcaugagguuuucaggucucacccacgcuguagcaugucagagcuucguuccuuuucauggccgcguaauguuccauugcuugcuggcaccacaucuccugugcccggcccucugcugaugggcgucugggcuaugugcaccguucagcuaccaggaauggugcugcugugaagggagcugggauuuugucauccaccugcuguggauggcaaguccauuuccaucucuggacucagguggcccaucuacaaaaugaaggggaugcgacccagaggccucuggcggcaaaaccuucccaggcuuguccucuuggaucuaagggaauuucuuuccuccgaguccagccccuccagugcuccugcccuucaggaaacaugccugggaccccucacuugugcccacccagccuuggcccacauaccugcaccaagaggcuacccuacucauacugcucagcccaaagggacccaccgugggguaugggcaagggcggguucugcucucccccggggcccugugccagccucagcuggaccugcgguucugcuuccugucacacucucccauuuuaaauuaacggaauggugcgguccccaugcacacccucagcuccacugggguuuuagcccagcccaggaucggaggccugcaagggcacacccaccuggccacgugauggugaagugggguggggcagggcaaccaaauuaacuucuaauucuaagagccccuggagcauucaucaccagcacuuacagccgugugaccucacacaagucacuuaaccccucugagccuuggggcuccugaaaaguggauggagcggucacgcccaccugggagagguggcuugggccagcacccucuaagcugcuugucccaggccaucauggcucacggaccgccccucagccuggccugugccacuucuccagggcccggcacguggcagccacaggcuucuaucagcucccgccugccuggggaaggacaaaaacgacagguuccaggccauggccugcacccccgcuggccgugggcagguccaggccugccugccugagcauugcagggcgguggccaagccugucccauagcaccucaccgaggaccugggaggcuggcccaggggagaggucaccucagccggggcugggggcugugggcagggugggcucggguuucccuguccccucccccagcugugcucugccuggacacugccaccuccucauggguguccagggccacugggagcugggcccagggguucucaggggagcaaugguggagacaaagaccagcggacgggcgcuggggucagagcucuccaaucccugggugucuccuucucaaggcgugaccacccaggcaguggccggcugcaggacagggcagcuucaaguucccagccuugccaggcuucccuguggcccuggggugcaggaaggagccccagcucagaaggcgagggggcgucuguguccugcagcagugggcacagcuaggcucuagccgggggcuuggcugcagccuccagcgcagcccucacacacgcuguucccaagauggggugaccgggaccggagccaccuccaggucccgggcaucagggagaccccaaaccuggcugcaucccccaggccaaacccagacacaggggaucguaacagaccacaggccucacacacuuguuccggcccaagcaucccccaggccaaaccuagacacaguggaucauaacagaccacaggccucacacgcuugucccggcccaagcaucucaaagagucugcucuccugaaggcccucaaggcagccccaggagcggguguugcugucacccccucuuccaaggcgacggcucugagaagcuccugccugcccagggcacccccacggaugggucugauccaggcccgccaccuccaaggcagagcugcccaccuggccuucgguuuccagccgcggggaacaggguggacgaaaugacaguggagagggcacagggagggcaaggcgggggcaccugcuccagggaugccccaggcaggcccacuugccugccgcccccaccgaggcugucacaggaggacagagcacgaguucccagggugcucaggugucauuccuuccuuccugcagagcgagcugcccucggaggccggcguggggaagauggcccaguccaccgccaccuccccugaugggggcaccacguuugagcaccucuggagcucucugugagugcgcuuggcuggccagagcugggggccccccugggaggcacucugggcuagccucagccaccuucgcugggcuaacugggccagagcaggagggguggccccgggaggacucugggcuagccccagccacccucacugagacuuugggcuaaacuuggcaacccucacugggauucugggcuagccucgaccacccuugcugcacuaacuggaccagagcaggagagguggcuccacacuagucuugggcuagccuuagccacccucaucagcuuggggacagggcgggucggaggggcagggaagagggacugcugcccuaggccuucccuggggaugcaggaccaaaauucagacucuuuucucuggccagcucuggagagggcccauggccagcagaggcccagaauaacagagcccaugacuggcucugccucucuggcacucacagcagcccuggaauggcagguggaggacagagaugggaugagagggaaugggaagggcaggagacguaggccucaccaggagucucaggcuagccuugagcucugggccugggagguauuggggugacacccaaacuggggacugacgcuucuauuuuccucucccugccccagggaaccagacagcaccuacuucgaccuuccccagucaagccgggggaauaaugagguggugggcggaacggauuccagcauggacgucuuccaccuggagggcaugacuacaucugucauggugagugggggggcugcccucugcaagaggacuggaguggggacaacaaauguggccuguccugucuugggagccuggcagaaccaggagauagccucuugguuguacagcuuccccuguggguuucugaggacacuucaaauugcaaaggagaaaauguaucagcucauguaacugucaauccagagauaggaauggauucaggcauggcuggauccagguguaggaagggcuucaggcauggcuagauccagguguaggaagggcuucaggcacagcuagauccagauguaggaagggcuuuggacauggguggguccagguguaggaagggcuucuacugguggauccagguauagaaagggcuuugggcauggcuguguccaggugcuucacagcugccucgcucagucucuuggucugcuuuccccugcagugacuuuguuuuuaggccgcaucuccucucauggugaagaguaccaggcuccaccagcaugcccuaucccuguggagaggagaucccucuuuucccauaguccagcaguccugccucccguugaucugaauguggucaugggcccaucucugagccacaucugugccucugauuggccuggccuccaccaucaguggaacagggugacaauggaauggaguggggugggccuccccacacagggacccccaaaggaagauggaggugcuguuuccaggagaagaggacuggauagggggcaggcagggccagugaggccuccggcaccccaucuuggcaggcucccccauuccugggagucucaagcccugccccauuggcugcuccucugggggaaaaggccaggcugugggagcuggugggggccacgcuccugccuaccucucuggcugcccauagccaggccucgacugugccgggagguggauggcaggugggcaccacacgugaggagagagcaaagaucccgaccugggaggcccagcgaggccagccguccccgcuggacucgucagcugcucggccccgcccacaggcuggcugccccgccccgccuccgccgcccagggauucguagguggggaauuuguuugcgcugcggaaaaccagcccgaacuguggggauacgcggaacagcgcgucuggggcagggucgggccucccucacuuaugcucagcccgaaagggagggaggcgaugcugggccucugggggccugagagcacccggccuggcccuccuccucccucaaguccccauuccaggagcuggagccccuuccuugccccugcgcacgacugacugucugaggcaugggggugggcggcccagccacccugagcacuggagggagugggggcuguggggcuccagucagaacgaacagagugaagcggggugggggaguguagagguggaggggccguguugccuguuccgucuccauugcggaugcugggcuggcccagagccauguggggccagagaaggcaccuccuugggcagccacagucccggggggucaauuccuccgaggagccccucagccuguaucugaggguucgaccgccugccccugcccucccaccccugcucaggagaccgucccaguggaaacacucgacagugucugcgcguguucuagucccguguuaugggugaggaaaccgaggcagaugcugggaaagggugggcuggggauggggccggguagugcaagaaagugagacugcaaccucuccccucucucgcuuuggaacaguucugccggcugcucucuggggacaaggguccugaccccacccccuccagguccccuucuggacauccguguccuccaaucuggggaggggcaggaacuggccgcuggaccccagggagggagggaggaagacccauaagauuguccccugagauccagaagccaccucccaaccccaaguugcucagccacucccccugcagagggcagaaggccccuaagauggcacagacccacccugugucgggaggaggaccuggacucagggaggcagaaggagcaguucuacauuccugaguggguggagcgugcuuguccuccccagccccggaggguucccugagcuccauaucggggucugguccgagcccccgccugcuggaacgugccacuccccagccacagggugacagugggagccucgaaccuccgcaaacagcaagguggcuggaucugucuggcagcgacacgccuccucccaaagccauguaugaaauuccuaggugcacagcucgacucacggagaugggggauucccuggaaugaaggcaggcccaggccugcguggggagagccaagccucauucugaccccagggcccagcccccucacaacaguggcugcugggccaagagcaugcuguccccuaccccugacucccaugggagcgccagguacaaagacagagacuccgaagggcgccaacgggugggcucgggcagccuggcacagggcccagggcuuagcugccuugagaauggccccuggcccgcuaacuccaggggucccagaguggggcuggagcugaacuggggggcauuguuuuaaaguucagcccaggagcucagggaagcugcugugcuggggcuggggaccuggacccgguucagugcggaugcgggcauggggggcucugagugcccccuggaaaacugccaccugcagcucaggggcccaguucuagccccaccacgaggcuggugaccuuggacaagaaacaccacacaggcccggccucgggucagacaggcgguucuagugccggauguuuccggggcuaccgauaguccugaguucguggcucagguggggggccugcuuguggaaguggcugcacacgcaccugcccccaccugccccuggcggcucccucuggccaccugucccuggguguugguggcaucuggcugcucccauacucaggggcgggucugggacucauccagcaaaggggccucagcucgggcaggcacagugcuugagcgcaggacacugguccucugcaguggggcgugccuuccgcaucugggggacgugggucuccccgaaccacgagcaggcagauugguucccguuggacacagggugucugagggaugccuuagccaccugcuuagcagccgugggagacaggcggagcaggugguuucaagcucccacaauucucugagccuccauguccuugcuggugaagcuggggugacaggggguaggagcccagagcagagagcccuuugggagguggcauagacucugggaugccaggugcugggugcuggcucugcccaaccccgugggccucggacaacccuccugccacacuggccccugcagaggaggcugaguuuaggcaguucaggagaguggggugugggcaagagcaguugaacccucagugggcucuagaggagucccaggccacagacuuauuggggagacugugagcucuguguggccauagcaggaaacagaccccguggucacuguggccaucugacugagguggcccagaaaguccagcaggccgagguggguguggcugggggcuccgaggccagguuugcugagcucaggaccuaccccuucccuucugagcugggcaacuuuuaaagaauuacauagcccucugggccucaguuuccugucuauaaauggcgcuacugagaggcuccaagucacccacgaugugaggauguccaguggugccgggcccaucgggaguaugugacaaacgcuaggugugagggugagggcagggaggaggcccuguguuuaagaaagcugcuccucggacaccagaacagcagagccaggagggccuaggauaggaucugggaccagggccugcugccuuugccuggcacaguuccugccugagcugucccgugccuuaggcucuggcugucccugaagacccuacauggcucacagggaccucacucuaaaauagggccccguucugcaagaggagagcagggggaagccuguggcccgggccuccccaugggcuggggagggugggccgaggagccacagcuaaaacuggcccagccccugcccucucaggacccuggcugguucccugaaugaggaaggcuugacgggcuucuggaugccaccuggguggggucugcccuggccacccccacaccgucugggaagagcugcagaggauaaagcucccucguaggcucgcaggcugcgaggaggcagugugggugugaugguggggcggggguccuauccucacccggacccacccgaggagucucugcagugcugggccugggcuuggaagcgaaucccugccccucugagcgcuagcguccccucggacaaaaccagcgcagggcaaugagaccugcggcccuugcuggcucucaggaugcuccacaaggagggaggacacaggaggggagaaaaggagagagaggcaagugucuccucccuccccuccccuccacucugcuccgcucccguccucuccccuccccucucugucccuagagccuccuccagggcuggccccuccccugugccccuuccugccucuccuggcgccuuucucugacaacagguguugugggcaggugggccacagagcggggucuacagcugguggggcagaaggcaggcugaucuacccugggagccccgggaacccaguggcaggacagacacccggggucagaaccuucggacacuugggggcuugagacccuagaggucaccccagauaggccuuggugacuucagggagagguauucuccccaggcccaggagaaggaagggcgcaggucccgugcauguguggcccccaggaaagggcaggcggacagagggagaaggacaccccucccuuccagggaggaucuguagcuggaggaaggguggggucaugcgugggagcagggagggggcucagcucaccacggucagcucugagacuccagcccacccguuacccccucccagagagcccccacucagccuuuccuuuggugggcuuucgugacaaagcacuuuggggcugcacagaagugaaccccacccagcacccaggucucagagccuugcagcuucugcggccucuuccaugcggugggaugaagccagcugcccagcagggacccugugccaugaguuuggccuugaacugacacaucacuggcaccaggaaacgaagucccccugucuguucuggcacauaaccccucccacuaacugguuccugaagagugccguggccugcggcagcgucguuccccccuguccugcggcccaggguccugcggaaagucaggcggaauccccggugagucagaagcagaaugaaagcagaauggaggacccagcagggagggaaccuggaggaggcgcuaagggccacgccaaggggguguggccccagauccccugucccuguccucugcaaggcugggccuugggaacguuugcagaaagcugggugccgcucuggggcagaggccagugguuuugggugcuuuugaguuggaaacguguagcucagccgcacugggauccccgcagccuggcccagaugcuaaggguggagagaugcggggucucaggcacggugcccugggcauggguggggcucgugcugaaggcagccuggcugucuuccuuccucacguccuuccacuuggcgcucuccuuuuggcuauuuauaaaaccaucaggccggcccugugcaugggacucgccugagucuccuuuucaaugcaucauucccuuuggcaggagaggacaccgccuacagaggcugaggaugugcccugugggggucgggagcggaacccaggccccgccucggcccugcucugagggucuguccaucccuggggagcccgcccccaacccaagaggggucccaggcucagaagcagaaggcacccucauccccagggcauccccgaucccagcaggagucuccuagugcucgcccugggcucuccugcaaggaggcugcugcuuuccccagaacauccagucugggccccagccgacccccugcagggggcuucccagagacgcccuuccugaaccugaucuaccagacaaaacugucuuuuucucagucgucuccuccugagugcugcugcccuuccuguugggggcugagauccucugccacaggaagagacgggcguccaggacucaccugcugccucccggcccuagggcccugagcugggcucuccaggccccagccccuuggggcacaacaccuggaaucguccuuucguccucagcccggccugcugguggggcagggcggguccccagggcuccucaggcagcugcaguccaaaccuccccugcccucacccagcucugcccgcucucccggggguggggguggggagcgaugaggccccugccggcucucgguggggacgacagggaggaaggaagcuggggagauggagacaagagaaagcaggcaggugguuugggauuuggcaggaaaagguuggaaggaaaggggaaagggucuccgcauggauuucucagcuccccauggauuucucagcccucgugagagccacggcgcccuggggacuggaaguguggguccgcaggccccaguccccagguuugucugagcauagaugcccugccugcuuccagggggacucgggccccucugccagggucaacuuuguacccaagacggcugaaauacaauggaaauucagacggcccaacagggaguggcagucaccucaaaggccccacuagacgggugcggggcaccacugcagagccccucccuggcugugccaaggccguccacgccugcagggggccccacugccgggcuguucuuuggcaacaguggcuugucccuguuuccugggggcuuggccagugccagggugggcuccaaacgcacggcucugggcucuuggacucaccccugcuuugggcaggcaguggaaggcaggccccacaagagcugcucacucccgucaccugucucccucgggggucuagggucgaaccuccugugagccccuccucuccaugcagcccuuggacugguccuggcggaccaccgaguuccccgcgcagggggcaggugcgccccaccugggugccaagggaggcgacaccaucucucccccuugggguggcccagccuugccuaccaugaucuccagggccggggcucagcccucaugccugggaacagaggcugcuuuacggggugagggccuggggccccccgagccuuccccaggcaggcagcaucucggaaggagcccugguggguuuaauuauggagccggcgcugaccggcguccccgcccuccccacgcagccuccuuggugcgguccaacacaucaccgggcaagcugaggccugccccggacuuggaugaauacucaugaggaauaaaggggugggccgcggguuuuguuguuggauucagccaguugacagaacuaagggagaugggaaaagcgaaaaugccaacaaacggcccgcauguuccccagcauccucggcuccugccucacuagcugcggagccucucccgcucgguccacgcugccgggcggccacgaccgugacccuuccccucgggccgcccagauccaugccucgucccacgggacaccaguucccuggcgugugcagaccccccggcgccuaccaugcuguacgucggugaccccgcacggcaccucgccacgguaggugugacgcgccauucauaggaucucuucggggacuuugcgggggauuuugcugcaguguaggguucagaggggcauccuucugccugccuuccuggccuggagucugcugccaguuggggugagcagagguaggaagggaggcguugaggggcuagaggcaggucccaggcauggaggcaagcagauucgggcuccaacagccugugcccaccugcugggcagggacccgcagccagggagaggaggccggguccaugccgauggggcugcugguguuucugccucgugcucgggggucucugaugcuccuuggcuuuggggcuggcggcuugguccaggcucagaguuuccgagcugcccugcccugccccagcugccaggagcucagugcacccuagaagucaucuuugcuccugggcuugggugugaagcugcccccgcccucaucagggaauuugcucauuugacagcaguggcagacggugcuucuugucagccccacgggcucuucucggugugggucugagcuccagggccaggaccuguggcaaacugggcuugaggccucuugcgccacccgcccccugcagugggcugcuggcuuggaagaggggagggaagggucugcagcuugugguuggccccugcagccugagcccuggggaccuggccucacuuccagacuugccaggucccugggggccaggcaggcaccagcugcuaauugagaagguggaaggcucggcacagcugcuccacguggggccguuccuccucccagggaagcagacagcugggaccauggguaccugugccacacgggaaacucagccaugggcagggggcagcgggcagauaggcagaguccaagugccccgaagcucugcuggcacugggauguagaggcccaaagaucuggggacggaggccuuuggagccgugggcuccccaggcagugugaccagggugugugugacagcgaugugugugagcgugcacaucaaugugcauguggcggguggguauuggugugcgugcaugugugugucuaagcguggaugugcaugcaauacgcaggcgaggauaugugcagauguguguguguauguuauggguguguguacaggcugguguguguguauguacacguguuugccuguguguugugguguguguacgugugagcagauugguacugcaggugugauugugugauuuggguggguaggugcucacguguguccguauguguguugcgauggauacauggaugucugugccuguagcuguguguucccaggcaaggcuuugagaagagaggcaguguguguguguggcccagagggugggugagggugugggugacccagccccacagccugcccagaugcuggguccaugcacucgagucuggcggcaccauggccucuccacacgccugcgugaucuuuuuaucugaaacccagugcugggacuguagcccagagcguggaacggcuacaucaggcauggggugucccucucucccuugucuggcugucacccacuugugcauugauacauguauccaccaacacguugcuauuagaaacgcacagcaggccuggggcuccuggggggcugccuuguacccccagacucucccaggaggugugugagcugggaggggcuaucucccggcugcuggaccgccuggaacccgagguggauccagaagccucggguggagaggccagugucgcugccuggccagccgagaagccuggggaccugggggacucuaguacaaucuuuucccuugaauggagcagaugucaccaugugacucacccucucgggggacuccaccaagguugaguaugugguugcgcagacgccauucccgggagggguggggagguggagcccugcugcccuggccugcagacccucacugccugcaggagcugcugguguccacucggcugcugcugcccggugcccugggcgucagcaauggccagcugugccaucacuguuucuuuuuacaccaaggauuacugugguucguucguucauuuguccauucauucaucccaucagcaaguguuaacugggcacguuuuguguguuaggcugagugccaggagcagguggaggcagugcccagagccagccaugucuccagcaccucuucccucucggggggaggugggcuaggcugggccauccuaaugggcggaguggugacucaguuucccuguuucugugccagagagaguauucaugaccucaucuuacugcaggaacguauuuugagagagaaagugguauuuggcccaaaggguuuuaaacccaaagugagcgaauagaguuguauuggaguugguggcuuugugaggcccugguuauuccuaucaaagcacaguagcugcuccggagcccgcugggccagccuggcccugggaagaggccccuggguugcaggacacugucugagcccccagcugggcccgccaauugcccccagccuggcacaggguuccaggugugggcuuggggucugucucucuggcaucugccagcugagucuuuggucagugacgccgcucucugagccucagucuccucuaugaugaggacgguguucaccguagcugcucggcugcggggcccaaugggagccacugguuacuugcugcagauggggacgcaggggggccuggccuggagagcugccgccucagccccuccucccacaaucccacccaugcagccuuagccccuccuccugcaaucccagcccugcagccucagcuccuccucccacaaucccacccaugcagccucagccccuccucccgcaaucccagcccugcagccucagccccuccucccgcaaucccagccaugcagccucagcuccuccucccacaaucccacccaugcagccuccgccccuccucccgcaaucccagcccugcagccucagcccccuccucccgcaaucccagccaugcagccucagccccuccucccgcaaucccagcccugcagccucagccccuccucccgcaaucccagccaugcagccucagccccuccucccgcaaucccagccaugcagccucagccccuccucccgcaaucccagcccugcauucucagccccuccucccgcaaucccagccaugcagccucagccccuccucccgcaaucccagcccugcagccucagcccccuccucccgcaaucccacccaugcagccucagccccuccucccgcaaucccagcccugcagccucagcccccuccucccacaaucccacccaugcagccucagccccuccucccgcaaucccagccaugcagccucagcccccuccucccgcaaucccacccaugcagccuccgccccuccucccgcaaucccagccaugcagccucagccccuccucccgcaaucccagcccugcagccucagccccuccucccgcaaucccagccaugcagccucagccccuccucccgcaaucccagccaugcagccucagccccuccucccgcaaucccagcccugcagccucagccccuccucccgcaaucccagccaugcagccucagccccuccucccgcaaucccagccaugcagccucagccccuccucccgcaaucccagcccugcagccucagccccuccucccgcaaucccacccaugcagccucagccccuccucccgcaaucccacccaugcagccucagccccuccuccugcaaucccagccaugcagccucagccccuccucccgcaaucccagccaugcagccucagccccuccuccugcaaucccagccaugcagccucagacccuuccucccacaaucccacccaugcagccucagccccuccuccugcaaucccagccaugcagccucagccccuccuccugcaaucccacccaugcaucuucagccccuccucccgcaaucccagcccugcagccucagccccuccuccugcaaucccagccaugcagccucagccccuccucccgcaaucccagccaugcucuucacuugcuucccacacuguccuuccacaugggggacuggauaauccugugguggcucuggccaaacaaggccacguucugagucugcggcucccacggacugggguugaucaaugcccaaccccgagguggacacagagacauuacccacuucugccuguagcaaggaaggagccgauggcuggaugaguggggccccucuagaagaggcugagcgcuggagacgucggagcugggugcugucuaccaacacccaggagucucccugacuucccaaauguccaguucauggccccuugccccccacuuccuccuggggccgcuguucuucagcuuuagggucucaggagguuagccagggugaugggagacaccccuagcucuccugcgcccucucuauggaggggcuggagccugucucgccgcagggccugggcugugcacccuugggccuggccuguucccacccugccccuccgcauggugggcauccaugcguugcgggaacguggccaccccugugcugaggagcagcacggacggaucuggagcuuuggacacccccacucccgugcgccccauggagccaguguccacucuguuccugcagaaagugaaaccucugggcaggaugggccuccaggacagggcccuggggcggggggaagccaaucagugcagcaagcugcaguuacuaggcaccuacucuguacguggggcuacggaaccaagggacgcagcuggcagacguucugggagggcccccggcugcagugcuggggauagaccacaggggggcagggccaaggccaggagccgccugcaggcugggacgauccagggaauggggcagccccgccggucaggugguaccacaccgugggauucugggcaagauuugcugaugggcuggauaugagggaaggggugggggagaccccaaguuuucugcccugagauugguagaacugcagcagagcaggggugaaaacgccgcggucggccguggcuguguuggagaugcccggcagccauugcauagcugagaaggagccgcaugcagggaggaggacgacgagcgagcaguucccaaagccccaugagggagggguuuccagugguccuggggccugaaaagugugaccaccugguggcucaguccugugugcaucagaggagguggugggugguggucaggcuuaggguggaguuugaaggugaccuuagaggaagagcaggggaggauuccagaaagaugcugagguuccauuugcacccuugcaggaggcucugcugcuccccaaggcaggaaaggccggcagggucuggaugugagguggguaaggaguuggggccacacuggcaggagcggccauguggacacucaguugcuggugugggcaggcaggcuguggagacgaccucuagggaguccugcacaugggcacuuacagucagggcucugggggaucugcacggaggcagggagagacagcggcuggagcugagcacugggcacuacgacauccgagacaccaagcagagggggagaugcagaggggcagccugggaggccaggaggcacgagaggcuggcugggagaacagaaaagggacuggggcuuggcaacccagaggcugcugaguucccacgguuuggagagggcagggcccaacugggaauggcucaugggauugcugagcauggccaagggagcccucagcauccucuccaggccuugugucaugaaagaccccgagcagcgguggggcucaagccauguggggccaggggagggaccaguuguccuaacuggagauccagggaucagaggagccaccccacucacccgccugcugugccuagugcacgcccgccuccggccccccugccacccucggccagcugcuauuucugucuccuuuguucugucccccauuggaccuccccccagucaccagccuaauaggaccucaacuugcuaaacccaaacuaaacuuaucuuccccugagaggggauggugccgugucucagccagcaggaaauccacucucgccuuugcucaggccagagcccuggaggcacucuccaugccugagguccugugaauccugccugcaaaugugccuggggccccugcggggcccaccucgcacccgcggcccacgucgcacccgcggcccaccucgcacccacugcucagauacaucucacaauugcugccuuugcugacgcccgcccuguguucucaacaccggagccagagggagcgcuuugcagccccgggcgucucugcucagcuccgaccaccucucccgcuaucccccugggcuccgucucucccugcacaggcccucggcccuuccucuggcugcaggcucucugcccugcugguccccagccuggaaacacccccaggcccacccaauaccuggggcagaucuuucccuuccugcaggcccgccuucaccuuuucccgagcccguccuugccuggacgccagcccuggccccugugccuggcucuguguuucugagaccacuuuugaucccaagccccugcacgcuugcuggcugguuuguuuacugucgucagcauggagggccggggucgugucucgugccggcugccaucuuccugcaccugggagggugcuaggaugucaagccuaggaaaugggugugaagaggagaccugccuuugcaggagcugaccaaggccagugcacugggcgggaccauccgucacuccugagcccacuaacuggggaggggacaggcagagcggggcugggugauuccugagcaagcaugcugcugucucucuggcucuggggccucugcccucugccucgauggccccccacagccguccuggaccgccuucuccaccuuugggcuccugcuccaauguccgcuuaucaccgagggccaucggagguggcacgccccgugacugccucccccucccuguacccugcacugcacgugucauaauucaaguucucggcucagccacccauucucggcucagccacuaaugugugcuggaagguguccaggaagcccugcuaagcaucugucagugucuccagcacagcaggaggcuguuacagguggcgccugauucacaucugcaggacagguggauggaugggcagacagaugggcaggggcaugugugcaaggacacaggaugucagggcugacaccuggguugggcucuggggugcuggcagcaggguucggagaggggagagaagcgugugugagcugugccuucccccucgucuucccgggcacucggcauucugggugggagggccuggaccagcccguuuccaggugguuaaauaaagucugugcauccuguuggccaccugccucucauaggcagcagcacagggccugauggggauacagccuggauaccccacuggggccucccgcagacacucaggguccaggcugccccucgccacaaccuggaagggaggggcuggugggccagcccucuggaggaggccucucaggggaggugggcuuugagcgggauccgggaggcagggggcagaagcugagggacguggagaagggucugggggaggaggcggcggcaccgugaguggacuccggggcgguuagcagguggaaggcagugaggguugaggagaggguggggcgaggcccuugcaccaggccacagugggcggcucaaauguggguccguggaggcccggggggcaccaggcuacccuggagucaucugaagucaccugggcguguggagggacaugcaucugcaaggcccccauguggcgcuaagcacagagugggugcugcagacgggcucagccgcugcgggcaggugcaggcaggauagcagcgguggcccugggccucgcaguccugcagacacacgucuggggacugcuccugggggcgcguuucuccggugugagguguggaaaguuccacauggcccuggcacgggauugggcaaggccucgccucagccccgggugagagcagagggugcugugggugagagcacagggugcugugggugagagcagagggugcuguggaugagagcagagggugcugugugcacauugucgggagagggaggcuuccccccagccgcaugucgaaucuuguuggcauuuccauucguuuaaucacgggcuccgggagaugcugugggaaguaccggcaggacggaggucuugcccuggugggaugggcucucuuccuccgaagcccaggcugcuugucagucacucaccccugggugagguuggggcccaaguucagacaugcccacgagagaucagggaguuugaggagcggcauacucucaaaaaaccacaacagucuggucucaauauucuccagggaacgaggacacggaccuccuuguucuacaagagcuggggucacagcucagagccccuguccaggcuggagggagaaggccaggaggccagagggaggccagcugagcccucaggagacuccaggcaggccccgaugccagacuccagcccucaaacaugcugccuucuggaaacgucugucacgggcacaccaugcaccaugccauggcugccagugguggaugaagaagagcaugucucugccccgucuggagcucccgguuccuguccuaguugaacagaaugaaugagagugcgggauaaaugccgggcggggagcagggaugcucgggcgggggcaggagcuggagaggugacaggagcgagggaggcggagguggagcuggggaggggccagcggggcgucaggauuucagcugacaucccuacuacgcuuuuucacgugccucccucucugacucggauccuaagugauuaggaucagaggaaucucuguuuccaagagaagggggacugcauggccagaccgugggcucgggccccagucuccugaucuccgccaagcccagggccccaggaagcggccccauccuugggagcuguccuggccucagcucccaaggauggggucccucgggaagcuguuauugcugucuacggggcaggagcuccgucuuucgagccucugcacuuguggagacaaagguuuccgaaugagcauuugugccccgcccuccccaccaccccugccaggcccaaugcagggaccaggcugcaugugccuuccccgccucacaucuccuccgcuggaggagucagccaaaaccguggccuuuggagauguggccagagucauugugaauuuugcuggcagguuucucuguugucauuuccacuaaaaaauacguuccguucuggacaguaccacaucuguccccugucauccgauggcacggucgugaccucccaugccuugcuuugcauugugucuuaaauauccuaggcucugauaaaaggcacuguggauaccgggaagcgagaggaguggacuaggggggaacagggacacaaacuugaaaaagauuuauuucccaucuacuuguaaaaaaaaucacucaaaugccccacgccuguaaucccagcacuuugggaggcugaggugggcagaucaccugaggucaggaguucgagaccagccuggccaacauggugaaacccccgucucuacuaaaaauacaaaaauuagcgucuguaaucccagcuacuggggaggcugaggcaagauaaucgcuugaacccaggagguggaaguugcagugagccgagaucccaccacugcacuccagccugggcgacacagugagacuucgucucaaaaaaaaaaaaagucacuugagacgguuuacacauuuuaaacagucaacaggugcaaugggaaucuuuuaacaaaaccacaaaauccaacuuaaucugaaauagaacagaacccaugcggcgggagggugaugauggggcccagcuccccuccagcuccuggccggugaggacaaagagucuuucaaggggcuguccccgcccuccacauucugaggaaggcagccuggacccugggcacugucugggcuuggggcuguggccgacauggcgggcaguggcacaccguggccacuucccccaguuggauggcccgcguggauuucagggucuguuucauccaaccaagaguuucugagcguccugucgguacuggcuaucuggacaccucggggaacaggagagaccccgaccccugugagcaccugcccccgagagcaccugcucuuccccauccgucccugugcccagggcuuagcgacuguccucugcguagugaaucuggauucccgucccuguuccucggcggagccugcccagccgucguuccuccuggcuggguuuuugugccaaggcguggaggucaugccucgugcaugggagcuuccuggacauugguuccaggagggcucccgggcgagagucacuuccgaugaagucucagguuaccauacuucuggacccucuugauccccacaaccauccuacgaaguccacguugauuucuuuuuugguuuuuuucgagacagagucuugcucugucacccaggcuggagugcuguggcgugaucucagcucacugcaaccucugccucccggguucaagcaauucuccuugcucauccucccaaguagcugggauuacaggugcccaccaccacgcccagcuaauuuuuuuuuguaguuuuaguagagacgggguuucaccauauuggcuaggccagucuugaacuccggaccucaggugauccgccugccucguccucccaaauugcugggaugacaggcaugagccaccacgccuggccaguacauguugauuucauccccacucugcagaugagaaaacgaagaccuagggagguggagcgaugggccagguuacacagguggagcugagacuuggccccaggacuccugaccucagagcccugcuuggccccccaggucccugggaggucucuccugccccucuccuggaugggcagagaggccugguuuccaggaugguggcguaggggcaucaguagacccagaagaaccugcuguucugggaugggcagcccuggccaccacuuccugcccaccuugugggaacccccagaccucagccaucaccguccccagcuuggccgacgguagaugcuggugcuuggauugggguguccagccagugggauggggcuucagggcugggcugagcucuggccucccccacacugcuccucucugcucucagacaggcaggccagggggcaggcgggacccuccacagcccuccuggagggggcccagcuacuggguggccucucagucucugaccccucauuuuggagcaaggucacuggccugcugccaccccaggggcauggguggaucaaaccagugaggucugggaacuguguugauaccugugacuggcccaggcgagagagcagccccauuuaccacugccugcugcccacaccccagcccccagcccccagcccccagcccagagcuaaucuccagcacaggugcacccagggagguccccaacccauccgcagggaggagagaugaggccuccugggugggugcgugggggcugcaguauuuccccuggcagagcacuccugccccgcaacaaggcccuggggccccagcagggccuggugcguccgcggccuggaggcuggcgggaaggccacccgcuggcucucuggcucccgcgcacuccuugggucaggcccaggagcccugcacacacauguaggcacuuguggccgccgcgggccgggcguguccuaauuagcccacuaucuugggagcucuuguugaaagcaaaacaaaccaaaaaaguccugguugugcccggguuccuccccguggcuuccgggggcccucugguugugggagaccccgggcuccugugcaggccuguguuagguucaggguucccuguuucagcagcuugaccccgagcaggagccaggccccagggaaagcuccuugccgccaggcaggaagcgaaagggaagaccagagucccccgagccagguggaggggcuuguggaggaugccuggggaggccuaagggggaggucagagacccagaaagcccccuacacuucccagaugcugcguucccagcugcauucauaacugcagcugcaaagccucugccacccacugggggugugacaggggcggugaccacaggcagggccagcgugcagggagagagguccccuggaagcaggaggagaggacagcguccccugggcagaggacaggcccaguaacccuggggaggagggggcuucagaggcccccaccccgugucacugagccugaggaugagaggggaccagagggagaggccgacaucggggcccugccugaggaaggcccugcuaagggagccugccuggggcccugggccacagaggacggcaccgagagggcuucaggccugcuguccggacacuuguccacuaauuaggauucccgcguggggccgccugccgcaagggccuggcucacucccgcugggcugugcuaggcgcagagauccuaucagcucuucuccucuugccucaaugacuaauuccuuggcaccuuccucagaucauacaagaauguggacaaguuaaaauaugaaacacguugucgugggucugcauccugcuucucccaaacaagggaggcaugggcuuuuugccccacuggcuguccuguucucagggauggagcagggaugggagucgggcagggggacccuggagccugcccuugccugucauccugaccugagaagccucagcugggcagcccuugagccccgggauguucuugcccgggggacucaaaugagucaggaauggggaagucgugcaucccugaggccauccccgggcccaaaacagggaagaccuuuccaggaaggccaccgcuggucaccuggaagagagagggcaccacggagaggggagggugggcaggcuggcacccgguacccggugaugggaggggccggcucaugucccacacucacuccugggcagcuggacugggggagccguccugcauucgcuuguucguuuguucugccagcucgcuuguucagcgagccuuucaagcagccacgcuguaauaggagcacggacugagggugucggcuccgagccguguguguaauucugcuuuuucuaguagccgcauucaaaaagguggaaaggagcuggcggaagucauuuaauuauuuccuguauucacccguaacugugaucguuucagccuguaaucaguaggaaauggugagcgagguguuuuccguucuuuccgugguccugagcccuuggaaucggggugcgcucacacacugggcucagguccauccacauuucacacacccccacccuguguggccaguggccaccguauccaggguccucguggguucacagucgaguaggggagacagaagccaugggggacaugcgagccugcccuuccggagaauggcuagaaagaugcucaaaccgggugacgaaagagaacaccugaggccugggcgcugcuccugcccguguggccagggcugaccccucggaacagugaccucugagcccggacagggcuggugaagggucgugugcagaccacaagugcaggcuuccaggaagggccugggcccguggucguaagcaggucucagacaccucagaggccucuugggccucggugaggagucugggagccggggacucuggggcggggccugggcugugcgaccagagccuggcacugccccuugucacccccaccaucacccaaccucccauguguguagcugaggcagggguccauccucugugccagaagccuacuggcagcucgccggugcccagggugacacccaaccagacaccaggaggagcaggaguagccuuucuacaucuuucucugaggggggcaguggcugcuuccccagacccccucacaauagcccaggagccaggagaggcgagggucacccuucccugggauguuauauuuuguuucguuuuuugagacaaagucuugcccugucucccaggcuggagggcaguggcgugaucuuggcucucugccgucucagauuccugggcucaagagauccucccgccucugccccccagaaugcugggauuacgggcguccccccgugauguuuuuaagcuggcaccauggcuuauccacguggcagcgugugggagcuuccuucugucuuauggccgaggaagaggccacuguacagacacacuguuucuuuauccauuugccauucagugaacccugggcuccugggaaggaccuguggugcaggaaguuagggagguuguggggagcgcgacagaccaggaaggaggcugcaguggugccggagaggugggcagggcccgugcugcaggggguccccguuccacuggugggugggcuccccagguugacagcucacagccagcuuaauggugccagaugauggcagcuucagccgaggccucgugccaagacccuugcaguggagccagggcacgggucgccccugacggcucaggccugcuggggcuguuggcuguccugggcuggagcacacagggagagggccugccuggccuuugguggcccugggaacaguggugauggcucuggugagcagcaguccccugccuccugccccuccggcaucccgggcugagcugccuccacguuggacugcacucaguggaggacucaguagaggacucagagaggacgcaaacucuggacuugccuggcguccuucuccauuggaugcuggaggggccgggggaugcggcccucgucagggaccucaguggauguguguccuaggaccugcagagccgagggccucugggucacuaaacccaaccaccucugauggagaaggcugaggugcaggaaggggcugagccugggagucccggcgaggccccugcacccuccugugcgggcagugcacguuuuguuuuuuggauuggagggggcaggcuggugggagggaagagugugcucacagcacaccacagcuucucuaaagagggacacagggcagaaugaccgccccccgcccccggcccgccuccgccuggcucugccccuuccugcccugcaaucccaguucacggucugggggucucagccugcaccuugcugacugcuggugaccuuugugccgucugcuggggccgcuagaucacuggggucaaucguuuccccagccccauagcucaguuuccucaucuguaaaauggggacaaucauggugcccaccgcaggccuggggagagggguaauagggacaaucacggugcccgccgcaggcccggggagggggguaauagggacaaucacggugcccgccgcaggcccggggagggggguaauagggacaaucacggugcccgccgcaggcccggggagagggguaauagggacaaucacggugcccgccgcaggcccggggagagggggguaaaggcauuuguuugcguugagccucgggggucacagggaaagcgcuguuuauacaugugcagucuuccuccagcacccgccucuggauuuggaaggagggucuuccucagcagcccaccaagugaggucugcccugcccuggaucugagacaucgaggccagaccagcacccccucccucagcuggggccucccuuaagcuccuggcagaggcugauccaugcuggggucccggggcgccacagacgguggcgcaggggacacacccacagggguuccuguuccuuggugugugguccuggcgggggagcugcggguaggggccuaacgagagaaccccgggccagggggcagcaggggugaggcuuugccggccccugagcguggagcggccuuuccagucggggugaggccguucaccgagagaugaggccgcccaacugggaaaauugggcucagccauugaacagcaguuccaccuuaucccaccaccuagagggccagaccuagugagagcccggaucuggucuccagcaccucaggggcacccacgcacccaagcccaggugugcgcacccugcacucagggcccacuugugcccagcccaccucccccacugccuggcucccuggggcuggaucuccccacuuugagcugugagguccagaccccgaugccgcccggaggguacagugaagcccgugugggcaucagggccugggagccucccccacccgacgccuccccuccaggugugcagagagucuauuccgccucaucaacggcuggguggauccccagaaacccuggcaccgggaggcugauggaggggagggcgaggugaauaugucaguuuaucccaaugcaaguaguggccuguugggaugggggagagacccggggaaauauuugggaugacuggagccgcuggcccuuuaaggcuccuguaacaggacaccuccuagacgggacaggacgacugacuguguguguuucccccucccuccuccccuuucccgcgccaggcccaguucaaucugcugagcagcaccauggaccagaugagcagccgcgcggccucggccagccccuacaccccagagcacgccgccagcgugcccacccacucgcccuacgcacaacccagcuccaccuucgacaccaugucgccggcgccugucauccccuccaacaccgacuaccccggaccccaccacuuugaggucacuuuccagcaguccagcacggccaagucagccaccuggacggugaguuccccuagucccugagggcugcgggcugcgggcugcgggcuggagaggagguggcugcguuccccgcaccucaagaggucugagcucgccccacugucugcucgggguucccaccuggcccgggccaggaggagcaucgggcaggaggcgggucucagggccgggcagucugggugugcccaccccucuagacgugaguggccagagccagucagccuccaaagggccacagaggggacggacuuggcccugcuggugagaucucugccaagacuggccagcggcuuccccaugcucaggugggaucuuugguuugaaauccuguccuggacagaggcacgggcucugcugccaagaguugucuguccgagacaggcccacagcccuagggucugcagaaccugccuccuccaggcagcgagacgcaucugcggguggguggauuugggcuuugcuggcacugucucuggagugucauuuccaggaauuggcaugcaccaaggagaugggguggaaccaccgugccaagggcucagguccucacugcggugccccuggagacagacuggcccacgguggggaucuugcuaauucugauaacaucaccugugcacaaggccagucuccucgagccaggcaccaugcucagggcuuugaguugagcuaacucuugcacccaccaacaacgcacagggcugacuccaucacugcuccccuuuuacagccaaggaggcugaggcucggggagggaagugguucgcccagaguucugcucauaguaagugggggcagccaccucugcaucuguauuccuaaccacugagcugcccugcccagacagcuucaggggagggggucugucaggaggggcaaggugaaggcugcaugaccccagccaggaguggagggcacgcaggggcugggcgggaaaagcagccccaagagcccuccgggucuccccuccugcaccgaggagggggcaagugagcccugccugggcacccaggccauggcugcaggaggggcucuaugggacacauguugguccggcccacugggcagcguccccucccccacgaggccccgccuccccgggcacagcucagugcuggcccccugaaguccaugcagggcggccgcauucccacccccugucgggagugcugagcaaggggccccucagguuuuuccgcuuuaagaaucgggucccacugcccugcuggccauagcugcgguuuucccacgcuccuggagggccgaggggcagggcggagccuaagguagacugucaggcucugcagguagccggacaguccugccgggcuggucuggggucuggguuccaggccccgcccgcccccaccugcgguuguuucugauucucacuccagccacgggcucccccagcugcuggcuccgggcuaagagaaggcucagcccggacucgcugggcuugaugggagggggcucugugggcuguugggcugaggggcagaggaccuggcaccuccuccggggccucccaccuccaucuggcaggcaaugccgaccccagugcuaacaccccguuuucuccauuuggaaauuacuccuccacgcaccuuacugcacgauggagauaaggaugggaagaccgugccagggcuguggccagcacggugcuuagcucgcagcaggaggcccaugcguugucuuaauuguggugguggugugcuggccugggccucccaaaugagugguuccguggcagcugcaccugccuguggggcaagggggaccaggccuauccuuccaccccacuuggaggucugaagccaggucagaaagccccaaggcauccucaccugcacaccuccagcagcaggagccucaccacugcuucucucccacacucaggcuuguugccuaaguccacucucuccccucuaaggacacugaccuccugcccugggguuuaugaugcuggugguuucuggagagugucucccuggaguccuggcaggcagcuugugggagcucugccucccuuccucccauggucugaggaugcugauggggucuucaccaugcuuggaaugcacugcauguggucugagcugauccucauggaaggacaggagcaacccccucucuggcuggcuucccccaucuaggguaucugccacccccacccccugccagguguguggcaucagguucaagggacuucaugguuuugucucaacugccuuguccugcaggacgggguggccuugcccugugggaugggcuggucugcucagaccaggcaucccgggcuggucagcugcaccagcgggaggggaaagcugugccuggugcccagcagaggagcagugacaccuccucgcucccucccugcugggcucuguggaugcuggggcggggggagggugggggggcgcgaacuggggaggaaaaugcugucgccugcacccagggcuccuccuccgaagcccuguggauccagggggugggacaaacauugauaaugagauuuuuggcaccucagcucucuggggccagaacccccuccaccagggcuucuuuccuugcccagggaggggcaggcaaguggucggcucacagugcagaacggggccgccgggcagcccgcuugcucccagcucuggggucccaccaugcgggugcugcccagcccugcugccugugcuugcguccggccucugcaccgugacuccuggggcucccggcacgccagccggcugguaacugauagauaauucauauuuuucucaaguacaaguccacauuggcugccgcccuccuuucuccccgaucaggaaaaacacccucaccagcccccaagugaccacagaucagaccucagaucuccuugggcacugagaggucuggaggcugcgguucacaggucugugcauaugugugcauacacacgcaugugcacacacacagacacagcacccucccacaugcaugcacacacguggauacacaaguaccuuaugcacacgcagacacauguaaacacacaggcaugcguguacaugcacaggccuccccccaucacugcccaggguucuaguagcucccaccccauggaaacccaggaggaggaggaggcgagucguggguaaccgagcagccagaggaaggauuuguguuuagccacgagaguguaaccagugaccagugacagggcaaggccggcauuuggugagagggacccugcauggugagagggguggagcuggcgucugcuggggucccaaucccagagcugcccgugagcaccuucugcuucgccccucugcccuggcauccucaccugcaaagagagguauggccugccagccaugguggggacaaaggagcuggcucuugggacuucuuaggucagggcaggguaccuggggagcgcuccacacacgugagcucugagugcagugcugauggugacaccagugcccuucucccaguucaacacccucugugggacagugugggcucagagugugggcagagcucucugcagggcaugcaugaccuggccucugagcccugcuggccacuccuguccugggagcccugcagguuggcagugguguggacagcugguuccaggaggcccucggggcagagaaugaacaggaguuccucuagcugucagaacagcccgacgcgaugggcaucggaugcugugacaccccggcucagccguucugcccccagcucagccucaucagggaagguggcuguccuugguguuugggaaguuuggggacggggcucugaggucaggcaagaaggcagugugggguuggaagcccuggcccagcacagcaucugugggcaccucagggcaugcugagugacaccacccacagcccacgaggcaggcugccauggcaggauggugaggacacacacaggugcgauggccagcugccccagcauuccuccagacagaaagauggcccggacacagcccccugagugcccuccagcugcucucagacucagcgugugugugugcgcgagcguguguaugugugugugugugugugugugcgcgagcaugugcacacauguuugucuuaggggagagcuggcuccacggguaggaaagccccccguccaggagggacauauggaaggacggccagggaagcacaaaggcucugcacgggauuccuggggagaaugaggcugagucaacacuaaugggucuggagcaaccuucccagcgccucggaggcuugcaagcaggagaauaauagcggaggugucccaacacgaucaugguaucaauugcauuauccuaaaaguuuauggaaugcaugaguggaauuaauaccuuuuacuggcaccagaagcaauuauaugugcguaaagcugagggaagaguucuaacaauguuuauuguggagaugaaacguggauuauuaggggaaacaagaguacuuagggcgaaauugcagcaauugcugauaucauguggcgcagggaucugcagcagggacggagcuuccagcaggccugcucuggcuguggucagcgccucggggcucguggcccgagccgggguuggcucuucucucuucacuuucuggagcagccagaggaacucacucuugggcccuggaggucacagaacuuagccuuggaggccccaagugaggcuggggaggccccagcucugagacccuggguccugcugccccaccccacacugccugguucuuggaggagacaggagggagaaccccuugggggacaggauucccuuccauaggcaugagacuguugggggagaggcaugauccaauuuacguuuuaggaagaaucaucuauuuucuaggacuucuuuccaguuuggggacagcccuguggacccagcaugucugauuaguagcguuggcagcagcauugccccuaugugcagggccucccacacuccccauuuuacagaugaggaaacugaggcucccagagggcacaccagggucaccugucagcagagggcagagccggaccuggccccagcagccagaccccuaaccuugcccuugcagcccguguggugccccaccccggccccuacaggucccuggacagguccccacgagcagccccugcccccugccccacccucugcucccagcucuguggggcaggucccugugacccucagggcccccaggggaaccagugauaaggaggugcugacaccucagagggaccugccugucccuaggggagaaagccuuggaccgaaugggguguggggggagcccaggcuguaccuuggcccccaugagccuuccacugcugucugccagugaaucaaacugggacuggggguggagagcugucccugucugcuuucacugcuugguuuuguugacaaaggaaaaucccucaagaacgcuuuaucacuggagugcuccgaggcuggcgagccucaugggcgagaagccaggcagcugggcuuggggaccggccucuccuggugccucccugcccccucugccuucaccccucccaggccuggccucacugccacuaacucccguugacagggggaaagagaggcccacaggggagggccgucccaggcuucuccuggacccagugcugacgccaagaugcggucguaggugaccuggaccuugggccgugugggacucggggcaagguggggggcucagcugggcagugaguuaguuuugcuucccggucugguggguuucugccaccccaggccaguggucacuucugggauuuucugagauuccaaaaguugaagccacggacccuggagacccggacccuggaggcccagccccugccucuggguagagaaggcccugagcgaccuccagaccuucugucccuuuuccgaggagccucaggaagagggggacagacaauuccagggugucccggcuggaaagaaaagcaucuucucugcacuccaggcggacagcgugaggcucagagauuacguggcggccgaggcugguguccacagccagggguuacgauggggcugcagaggccgugagcggaacagggcauuuuagggcagaaagacccuuuuggagaagguaacagcacuccaggcuucagugaggcagaagucagagcccauggggaaaccgcacagggggauuaccuaaagcccagagccaccccaaggguugcaaacccaccccucccccagccaugccacuggagcgaggcacccagcuccuugcaccuggcguuggggagacaccacucucugcaggggucagagauucggaggccaaaauucuccuucccccaggcauuucaaugaagauuuacaaaguuuagcaaaaaccuagauucuagccaacuauuaccuuaaaagcugaagagggaccaccccaccauguccacagcuuacuccccucccuccgcugucuccggccaccuccagcugcugccaauuccagcccccaaggcugucccaggaagcuguggccagagacuccgggacuguccugugagcagagggcacccacugacccuggggcacccuuccaauccccacagcugacaaagccgggccucaaaaggcuggguuaauccuggcuucuccucaaagccaccagucagggugggggugaggauggugggggcaaggauggugggggcuuccuccccaggaguuaaggggcccucucugcagugagcagagcaggccuguugccagccugcugggccccucgugggacagcuccagggccuggcccacagucccgcuagcuagguccuugccagaggccggaggagaggccaggcuacuggcaacgggcccuccagcuggcgcugucaaaaagcaaguugcgggcagaggacccugcgcuuggucccggcccagggcagaggcugaguguggugcuuugaacacucugugucuucagagcggaggggcagcugcuggugggcauuccggggcccucugcaagccccagcuuuugucucugcggacccagggcacugcccugccacccccucuguccccaaggccccagaugggguaccuggguccuggaauaagagcagauggaguuccucgcccugccugggcagcucauuccuucccgggcuugggcagagugacagugauaguagcagccacagggcacccgcacgcggucucagugaaucaggacagcggcgaccggguggggacugggcccugagcuccucacacagcaucucggcagcaaaguggaggcuggagcuguccaggcugggccacccaaucccagccagacacaaggcagucugugugagucucagucucuauuguccauggagacccauccccagcaggaccagggcaggugaggccccuggcuguuguuccccuuaccccuaaggggcuuaaguccagccacgggguaagaagcccaugucccaccugacaccucuguaguaccgucuuucuggaacccggggugacgccucugcagugcccagucuuccuggaacccaggggugacgccucugcagugccgucuuccuggaacccaggggugcuuaaggcgggucucugccuagaccccgaccccaggccccaggacccaagucaagcccagcagugacaaagggcugggagauggagcuugggggucagacagcuauggucugggugcugguccaccccagcuuagcaggcagguuugggucacuaaacggagugacagugccugaccucccagggccaaggucaggugagggccccgcgcagggcaggcaccagugggcaguggauguggccaugaggguggacccaggugccccauucccuggcagguggacagcacucacugucuccccaggucuccacaccaacagaggcagacaccuugggcaaacgcugccucgcagccucccccaacacuaggccccucuuaucuccucugccuguggcccucgucuccuacuggaccccugggccuucacuaugcacuggagacaaagccaccaagucuauccugggcucagcacauaccugcuucccuccccuaccccgaucauagcccaggauggagaucccuagaggcagccgugcaugggacgaggaucgagcaggcuccagcuccuguggucugggugcacucagugucucccagggagccgcgcuuccaggccguugagagucccccguguggcuccugcucaccuguuuaggacauggcucaaggucgugguggggcagacugcccagcuccucaggguucccacuugccccuggccugcccuccccagugagcaguuucuuguccacagccucuggggcucuagcaggccuccgucagggcugaggaucgcuuggcaucugcagaggauguuucugccucugguucauccuccauagagcuccuggccugggagccccggcuggccagcaugggggugccagcagacacaucugucuccugcagcccccccagccaggagcucuuucacagcagccucuuuucuugggcagcgcugggccuggcacuggcuguggccucacaggcauucugaagcucgcuugggccucucaucugccuggcccaugggcuguggauguccuggugagugagccgucacugccucgaccaugggagccccagcuuaacaccaagguguucugaaacaggggcgauugccacauguguccuuucccccuccccaggcuaguggcuucccuggggcagggagggaccagcccugugacauccugccaggccucccugacaucugucagagcccagccugugcucccagcagcucucugagggcgacagugacugugcaccagugaaggccacagccucccacgaagggggcugucaccaagggggcccuguggcugccaccugaggauacccuuccucucucagaaggagaaagggacccaggaggacccuaauccacaggcuguugacccuggcucaggcauguguuuuaggggguccaucugugaacccacgaauuuaauggaaaggguucuguggcucagccccaggagcuuuucuagggagaggaaggguccagggccuuggcagagggugggcucaaagaggcccguaaccccagagaggagagagaugcaccccuaaacacacagacgcacacacaagcaagggaacuggauaaaagugagcaauaaaaaaaaucguuuaaaaaauaaaagcccccacugcaggccccaucuuccagaaucuguugcaacagauucacccacgcugguuaacgguauuugcgguuugcaagaugcuacacgucccaggaaaaugacagacaaguuauuaucaccucuccgcuguccuccugcccaaaccugcccgugccgggcacccagcugccggggagcgaggagcgggcacaaggaaauuagcagccccccgcugcacccuccccucacccacccccgcaccagcccugccaggcccagggcucccagccaggccgggcccauguuguacuggggcgggggaggaggggaaggagaggagggucggagaggagccggcagcguggggagggaugggcacaguggcguuugggcaaacccuuuccugcaagcaggacggugcacgcacccugggcaggcaaguccaggcggcuccgugucaacagccgaagauaaauacgauuuuaucagcucggaaucuguugaaacacauccaucuagcgguucuagggaaggagaaggcaggaggggggcggcggaggggaagugucuccacgugaccuuuccuauagaauaggcuccaccggaguccuccuccuccugcccguuuuccacagggccaagcccaggccugaagccuagaggccugcuggggagacaggaggaaggagcugggggagcgcuggagccguccugggcucagccacccucuagaaggaccuggaucucucagggcucccuucccuccuguggccaccugugucacccacccccagaugcugccagggcaggggacaucacagacauccuccccgaggccacccagcuccggcccggcugggcaccugggguccaguuagugccagggugaggucugccaggcauguaugccccaaaggccaugugagcacugcacuggggacaccuguggggaggagagccaggcccaggaccuugguggccuuacuggccagaggggaggagaagugcucacaucgccugaggacaggggccuccuugcucuccacccugaggccugggccucccuccgccacuggcccaggucgaagaccuguccguucuaggccgcuccacacuccaguccgagcccccacuucccggggugggugguccggccgccgccugcaccgaguaccagggacagcucccggcgcgcccaagcuccuccccggggcggggcggggcggggcauccacagugcuccccgcgccugggcccccaggaccucuugcagacgggagucccucagacagugcagagacgggagcacgcacugggcccugcacccacuucguagcgcccuggccugggacgccccaccacgcagcuuccagagcaaggaucgccacuucacccugcccggagacccagagggaguggggcgggcucagcagggcgcugcugagaggccgcugccuaggucugcgaaaugggagcacugcugacccugaggcccaggcgggcgggagcucaggcuccgcagaggacuauggccgggggugcuggggcaggggccuaggggaggggcugcaggggccaggcaggagcugugaaaccccucacgcuguugagacuccauggggcugucagggagcgacggcugccggggccucugcccgcaggcuugguugcacccagagccuuacuccaucuguguccaacuggcugaggagcccaggcggccuccccucccccugagugucuggggcuccuugguggaucuaaugacccccaucucaggccaugggcuguggcacuaggguggaagaagccucgggggacucagccccggaaagggaacuguagggaagcggggccuguguggcuccagccccccgcaaccaacaccuccucaccuggugcugagaauaacgagggcgcaguagccacuaacaccugcaggccacuguguucccaggggacacgcagugagucagagaugcagguggagaggcuugugcaguggcuagaggcaucccagcugacgagcacaaagccaaaacugccacccacagggccggaccucagaggcccuucuccuuuugccgccccugagacucugaccugagccaccccggccggggucuguuucaaggggggucugccgcgcccucccugcucugugguuucccuagggagcggcuaggauggauggcauuuguugaguaccaccuguguaccuccaucugcuacacguuacugaggagagacgagggggacagagccaggugccugaauuccagggggccugugugcucugcacacaagaggugcuccauaaaugcucagcaaugggcagcucgcccugcaggcugcccuggccucggagaagccuggcgacacggcugccggcccuguguuccucuccccugcucggggcacuggcagacaagagccugccaccaccuggccccuccuccuucuguccccaaccagcacagauggagaccaggcgugguguguagcuucaggcagggccuuuguccaagagaccagugccuggacacaggccacugcaaguuugggccaagagcccucccugucugagucuccugaggguccgagucccagagggucugugcugcgagcuguucccaugugcccugggggcagggcuaccugcuuauccuuccaagugaugcuguggggagcaaagggggcauuuguaaugguggggacacuguacaucaguggucaccuccagggaagccagacugaccccacaacaaggagacugcuguacuucccgcugugcccaagccugcagcuccgacaguccagggcaggcgcccgcacaggggugggcugcuagcucugcaaggcuguuucugcuuuucuuuuuuucucuuugugugugugugugugugugugugugugugugugugugugugugugacggauucucacuuugucacccaggcuggagugcaauggugcgaucucggcucacugcaaccuccaccucccgaguucaagcgauucuccugccuccugccucagcuuccugaguagcugggacuacaggcgcccgccaccuugccuggcuaauauuuguauuuuugguagagacaggguuucaccauauuggccaggcuggucgaacuccugaccucagcugccugccuuggccucccaaagugcugggauuacaggcgugagccaccgcccucagcccguuuccugcuuuucuaaacagcgcccagccuccccugcagggcugugcaugaugguuccuuccuguguuuuaaacaggacuggggaugggcggcuuccugccuaaggcccugugcccaaggugggggucgcaggcaggggcaguggagccacucuggcuccaggggcuccagguggacggaggaccuaggaggggccagcucuuugguauccaauucccauccugaggaggccacugaaggacccccuuccacuugucccuccagcccccucacacccauggcagggacagaccagcguuccuggcugggucucauucggggagcccaaguagcucaccagagaggggaccgcucccacugcacaggaacaagggcacucagggugccggggacccaggccccacccaccauggcucgcagccuccgucagcuccaucuccccugucucuuuccuuuuuccuuccuggcuuuucgugugccugcaccugccaaggaccuauguggcuccugagagccccucaugucccuugauggccagagaggcaguacugguggccagugggggucagggggucagggcccccuaacuuccuuggcaaagggaagacuccaccugcagcuucccugguucugccaguagcucccugucucugaccucaguuuccccaacuguuccacgguggagugcgaugggacauucuccagggcacuugcggcugcagugacuugugauucugagucaucgggggcuggugaggggcacagagggcaugggguggcagcagaagucauucucugagccugagacuggggaucauuccugauggcccuuuggggagagagcaugaggacucccagcaggugaccaggagccagacgcuugggaaaucagccagcuuggaagugaguggacgccccugcagcggccucagcggggucacuuuuagaacucaugagagccggccuggguccucagaugggcagccgggcccugugaggcaaagaagcuggaggccucugcaggggcuggcucaggaagggugucauccaguccuccugcagcagggcccacgccagcuccagacagaccuauuagcuccucgagucccaagcuggggauacuggggcugugagcccagaggggcccccagaguggccaagaccaagccacacagcucggcugcucagacuugguggccccagcaggagagggugucagagucaccagggcugcugaggccaugagaggccuucacaccaacccagagagcucucuauggaagcuugaaugcauagugggcaaccagcccaucacacauuaaccacuugcucugugcaaaugccagagaagccuagcucuggucuuaaaaacagauucaaugcugcaaacccaccucuucaaaaugccgcagucagggacauggcuuccacaggccuggcucccagcccccguucccgcccucacucuccagcagccccuucuugcucuccuggccuuucuuguccccauccauaaaccuaaagccucucugccugacugccaccggcacucacaccccugcugucauggagcccaaaugacccgauggcuguggagugggugccagggcagcugugccuggauucacgccucaaaggacagacaccuggagggauucagcagaggggcugcuuggggcagucuucaucuggggguuguggaaggggcacccauggggaggacguggcucccaaugggggguggccuggacaggggugcaguugggaccacuggucucacccgcucccucucccccacuccaguacuccccgcucuugaagaaacucuacugccagaucgccaagacaugccccauccagaucaagguguccaccccgccacccccaggcaccgccauccgggccaugccuguuuacaagaaagcggagcacgugaccgacgucgugaaacgcugccccaaccacgagcucgggagggacuucaacgaaggugagggcccccagcuccucugcccacgguggcacuuugcccagcaucccggacagcacagccgggggcugccuaacugggagagaguggggcugacagcaugggcuuagccauuccccugcggagggcuuucagugccuccaccagcccccauuuucccaguucugagugggaccugggggggcccaugcuccugggcaggggcaaguggucugggcagagucugaggggcagcggccuucuggggccccagagauccuaugagucauagccccucucuccagugugccuggcagggccuacgggcuaccccaaggauuagcaggagaaucagggggcagagccacugggcaggcacccccagagcacaagggcugccagcuggccugagccucaccuggaagcccacaggacugggccugguggucucaguucugcugcgaugcaccuggcacagcugggcgccucucugcaccuggcacaggggugggcaccucucugcaccuggcacagggcugggcaccucucuucaccuggcauggggcugggcaccuuucuucaccuggcaugggacugggcaccucucugcaugugacacagaggugggcaccuggcauggggccgggcaccucucugcaccuggcauggggcugggcaccucuuugcaccuggcacagggugggcaccucugcaccuagcacaggagugggcaccucucugcaccuggcauggggcuggacaccucucugugccuggcacagggcugggcaccucugcaucuggcauggggcugggcaucucugcaccugacaccggggugggcaccucucugcaccuggcaugcagcugggcaccucucugcaccuggcacugggcugggcaccucugcaccuaacaggggugggcaccuuugcagguggcacagagcugggcaccucucugugccuggcacggggccagcaccucucugcaccugacauggggcugggcacuucuuugaaccuggcacggggcuggguaccucucugcaccugacauggggcugggcacccuuugaacccggcacagggcugggcaccucucugcaccuagcacaggggugggcaccucuaugcaccucucugaagugucgaccccucccggcaggacagucugcuccagccagccaccucauccgcguggaaggcaauaaucucucgcaguauguggaugacccugucaccggcaggcagagcgucguggugcccuaugagccaccacagguaggccaggagccaggcugugcccagggcccugcagucagcuguacgggucgggggagggguccccugaggcagccccugucccuccucaguuggcugaucugccugccuguccugucggcaucuguccagggcucccugcucugugauaagucugugucggcggcuccuuccucacccacacccgccccacugugcacacugcugcucuguccccacauccgccucgggcacucucggggccucagugugcccagcuccauaguggggagugggucuucagccuugcccucuguuggugcccaacacugguuccggccuggggcucccagacacagggauuugggagauggggagguccccgcccauuuagacccuggauuggcuggggcagaaccaaaccagcaacagcgccugaagggguggcaaauucuacaaaggggguugagggaugguggaaagacuccuaggccaggccaggggcccaggagagguggccugcaggaggcugaggcuggucagcaggguggagagccgggaggccccgcugggcaccacguggguggggggugcaggggacuggggggcauauaggcuggaggggaggggacacggagaggcugggggcuuugacuuuuggcccaaaggcagcauaaguuucugggacacaauucuggagcugauguggggcccaacuggugugaaaggcugggguagggggaaacagaggguuugaaguuacugcgggaugguggggcaggggcagaacaggaggugaggaguggguaccaggcccccaggggaaggcaggcaauggcaggccucugccuucccuguaccugguucugagaccaggcuccaugcuguacccagccccagccucccccaccagguccccaucccuguaccagacccccaggacaccccagacuccuguacccagucuccagguccuccacaagccucuacccuguacccaggcccccuucgacguccccaucccaccauccucuaagagcagccccuuaugucagcagaaccagggcccgggagggcucccugaaacccaugucccacccucaccugccuaggccugccaggaaggcagagcucuaucgcccccugguggcugccgugugacagcaguucugagaaaggccaagauuuucccaaaccccuaauagcuuuuguauuuguccccagggugacaugaaaacugcccacauuguggucuggggacacucauugaucaacgguuuugguucauggcugggcgcaguggcucacgccuguaauccaagcacuuugggaggccaaggcggguggaucacuugagguuaggaguucaagaccagccuggcccacagggcgaaacccugucuguacuaaaaacacaaaaguuagccgagccucguggcgcaugccuguaauuccagcuacuugggaggcugaggcaagagaaucgcuugaacccgggaggcagaaguugcagugagccaagaucgcgccauugcacuccagccugggggacagagagagacuccgucucaaaaaaaaaaaaaagaguuuugguucaugucucagcuguacugcaaaaucccugggaaacaggagugugcuggggguggguucgcuggggacagcucugguuccucuuucugcccaggugagcccgcagcaugcaacacacacguagggccacaaaaucugugcaggcacacucacacccagcaucugggcuugaccuccagccugugucaggggagaagguuggggcaaacagaccacaggacucugugcuucucugagagcagagaccaggucugagcccucccagaacccagaaccagcccagugcuugggguucagugaucuucaugaauggguggcuggauggggugaguggguggauggguggauggaugggggugggugggguggaugaauggauggauggguagguagguggguggauggauggauggauaaauggggugggugggugaguggaugaauggauggaguggugaaugggugaauggauggguggguggacggauggaugaauagggugggcggauggauggggugggugggugaauggauggaugggugggugggugaauggaugguuggguagagggauguugaauggauggguggguagagggauggguagaugggguggguggauggauggauggauagacugauauuguugaauggaugaguggguggauggauguuuagauggauggauagauaauaaaugggggaguggauggauggaugggguggggggguggauggauggauggauaggaugauggauggauggauggggugggugugggggguggauaugugggugggugaguggauggauggaguggguggguggguggauggauggauggauugacugauauugaauggaugggugggugaauggaugguuggauggauggacagauaauggggggaguggauggauggaugggguggauggguggauggauggaugggauggguggauggaugggguggguguggggguggauguguggguggauggauggaguggguggguggguggguggauggauggauuuauugauauugaauggguggguggguggauggauggauggauuuauugauauugaauggauggguggguggauggaugguuggauggauggauagauaauaaauggggggaguggauggauggaugaaugggguggguggguggauggauggauggauaggauggauggaugaggugggugugggggguggauguguggguggguggguggauggauggauggauggaguggguggauggguggauggaugaauggauggguugauauugaauggauggguggguggauagauggguagauaauaaaugggggaguggauggauggauggauggaugggguggguguuggggguggacguguggguggguggauggguggauggauggauugauauugaauggauggguggguggauggaugggguugguggaugaauggauggauggauauugaauggauggguagguggauggauggguagauaauaagugggggaguggauggauggauggaugggguggauggaugcauggauagacggguggguggauggaugggguggauggauggauggauugauugauauugaauggauggguggguggauggaugguuggaugggguggguggauggaugggguucguggauggaugggguugguggauggaugcauggauggauauugaauggauggguagguggauggauggguagauaauaaaugggggaguggauggauggauggauagauggguggguggauggaugggguugguggauggauggauggauggauggaugaauagauaaauggguucgauggauggauggauggacggauggauggauggaugggguggguugguggauggaugaaugaguggacagauauacaaauggcaacaacuauagagcagggcaucccccugccuacguggagccaggaccagacauggagcugggggcugccaccuuaguggauuggggcugcgugcugaugcuagccccucucccugcucccccaugugcagguggggacggaauucaccaccauccuguacaacuucauguguaacagcagcuguguagggggcaugaaccggcggcccauccucaucaucaucacccuggagaugcgggagugagucccgggcacacgggguggaggugggacagggcugggcaggcacggccgggggagaaggggagcugucauggagaccugcaggccaaggcuagcuuggggaagagacuuuggggugugcugcuggaggaaggaaccgcccccuggccugcagggccugccugggcacaagcugggccuccggagggaggugggaguccccggcgaggucucagggcagccucacagcuuugagccucugacucccucuagcgggaacacucgcugccggcacugggugcucuguggugaccgagggcucucaaggccgguccugcaggguccgagguggguggggaaggugggcagguugagggugggcaggguugagcucacaauucuggcugugcccacccgacagugggcaggugcugggccgccgguccuuugagggccgcaucugcgccuguccuggccgcgaccgaaaagcugaugaggaccacuaccgggagcagcaggcccugaacgagagcuccgccaagaacggggccgccagcaagcguggugagcggccggccaggggaacuggacgcgugugggaggagaaggggacacauuggcaggacacaaugugagcccgcgucccagggacagggccagucccugaacggccccccacgcccagacuccucccugacggagccugagagcagcccccauauaagucgcuuguccugggccaagggcaccucagaggccuggguggcaccgcagguuugcccgucccuguggguugcucaccaccggacccaccuggagaaucgauuggccccaaggguggggcaggucucccuccucccggaaggaggccucacccucugguccugccugcucaccccgccugcccugccuggccuuccagccuucaagcagagccccccugccguccccgcccuuggugccggugugaagaagcggcggcauggagacgaggacacguacuaccuucaggugagugugugcuccugcacggcagccgggagaccugccucaccucugucgucugcugagcccaggcugggccauggggagggacucuggagaccaugguggagggggcgggaggagcccagcccugugugagaggguccagagggcagaaccugcuugcaagagccagaccagcaggacccaacugcagggcauuccugagaguccccucagucccaaaaacccagcgucaugccauuuacaaugaagccauguguacauagcacagguaggguggugcggagugccaccaggguagaaguucagcaagaauccaggacccuaacguuggccaggacccguggccacggccagcccccaugagugugccucucacauguggccuccaacaggugaauuaaaucggcacaggcuuggcugggagucaucuuccaugaugugaacuuucuguuuuuugagcuccagaaugagccccaguuggggucaguggcucaugccuguaaucccggcauuuugggaggcugaggcggguggaucacuugagcccaggaguuugagaccaaagugggcaacauggugagaacccaucucuacaaaaauuagcugggcguggugguggcgugcagcugcagucccagcuacucagaagacugaggcaggaggaucaccugagggcaggaggaucgccugagcccaggaguccaaggcugcagcgagcuaugaugaugccacugcacucuagccuaggcgacagagcaagacgcugucgaaagaaagagagagagagagacagagagacagagagagacagacuugguuucuaaaaacccaguaucuguugguaggggaggaagagggaggcuugggggccacaaggagcaggcaugguucuuggggacaggauaccugcccacugagucaggggcucugguuagaccugcuucuugggaagaggaaagaagaucaggggauccugagccucuggggugcuggggaacccccagaaaggacagaugcuuugccaagcccagguccuccugaggcugcggccaccccccucccgugggggucuggggcacgugggcagagaucugcuccucugugcucaggugcgaggccgggagaacuuugagauccugaugaagcugaaagagagccuggagcugauggaguuggugccgcagccacugguggacuccuaucggcagcagcagcagcuccuacagaggccgugagucagcccuagcccaccaucaguguggggaaggaggacauggcuuaaccccccaggagaaggccaggaggaccagaaaccccuccagaaggcaucaucugccagggacaggcagcaggguccagagcagagcccaccccacaucuccuccuccaggaagccuucuagcacuuggggcugcccugggacccugggucauggcccuugcuaugccucugccacugaggggccuuguaaaugucugcugaguggaaaggccaggagggguggccagagugaccaugacccaccaagaccagaguccgauuccaguggcacaggucaucccccugccucccggccccgccauggccaguguccuucucaggcgcaggcccaguggccgugcauggccaugguuggggacagggaggcugggggaggaugaagccacucucugacaucagaggcuccacccauucgcagcaugggggcaucacgggcauggguggucggugggcacgaggcugccuugcuucccacccaugcgagccguugcuucugagcaggagucaccuacagcccccguccuacgggccgguccucucgcccaugaacaaggugcacgggggcaugaacaagcugcccuccgucaaccagcuggugggccagccucccccgcacaguucggcagcuacacccaaccuggggcccgugggugagucccuugggcagugcgggcccacgggcagggcggggaggcccacugggggcgccuagcucaggacacaccacccagcucgggacccagggcaggugucucuguggcuggcuccuuccagcgguuccacccucugggcaggaggcgcagccacggauagcccucucugcccacuccuggcugugggagguggaggggggcgugguuaagagcguggaacccacaugcaugcacugccucuuggcaggcgagggagcuuggggaaggcucuuaacauuacacagccuguuuccccaucagcaaauggccacagaaguaccaggcucacuccuugugaggaauaaauggugcaagaccucaucaggggccccagcacaagccgggggcuccauuggauagaguuugggcccccuuccccuggaagguccucaugugggcaggaccaagcauguucccagugccgugagcaagcacccccagguguuuccugaggcccugggauguggccagcacuccagugccagcugcgauugcccuuacaacccagugccccguacgcacggucacccccgucccuacuaggcggggcgaggagacagggccccagguguucagcccuugcucaagccucuagcuggcaggggugaugcccagcgucacaucgccaggccuugggauggcucccugguguccagaggugucuggagccuggguggaggcugcaccuggaugcccagccuggcugcccugauggccccaccugccucucacccaggccccgggaugcucaacaaccauggccacgcagugccagccaacggcgagaugagcagcagccacagcgcccaguccauggucucggggucccacugcacuccgccaccccccuaccacgccgaccccagccucgucaggugcgugggcugccgagggccugagcaugugcugucacccugucuguucaccucuguccuucuggccaugucagcugcccugccccacccugugugcucaccacucgcaacccuggaucagacaggcgggcgggggcagucaggccaggagcaucugcagaugcuggggaaaugguccacuuagaggaaaagcacaaaaagccgggguccuccacugaccuguccccagcugagcacguccccucccugagggaugccguggccaccugugggcuggagccacccuucggagacagcggcagucuccgccccagccaggccacucucagagaugggggcucgcgcagcccugugcucggaagcuaaugcugcuuccuuucucaaauucucucugcaguuuuuuaacaggauugggguguccaaacugcaucgaguauuucaccucccaaggguuacagagcauuuaccaccugcagaaccugaccauugagguaacgcccggguggaccccgcucugcagaggcaguagcuggaggggccccuguccggagggcaaagagccuucucuuccuugcucucguggcugggaaacuuggaaacccuuucccacgggcaagcagaugcgaugauuugacucuugagagcuuaggcagaugcagccaggcacguggcugguggcgcgggacacaggcccaggccuccggaugcugaacuggucauuugagccuuuuuggacucccagcagccagugugccuuugauuuuaggggaugggcuguuuccaaggcacaaagaacagaagaauguaaggccccgagggagucaguccaguucagugccauuuacagagaggucagcgccauuuacacagacaggaaaggggaccuagggaaggcaagcaccuggcccgaggccacacagcucuuggcacccauggcagcugacugcaggcaccaugauuaaacagccacggcuugucuuuggguuagagacuaguggaguacaaagccugcugguagccuaggacggugugaaccacagggcaccgucagucaaggaagagcaagcccucuggugggaaccugccccccagccagugccgcggcccagguccaaggcccgucccagaccauccccagccuggggcugcagacagagaugagggucagugcgagcuagggccagcugcucagccuaacugucccucgugcagagaguggccgcgucuguguccacuaaccgcccuccccgcaaccuguccccagugacccacgcugagccagcuccaggucacguuaacccuugccuccccugagugaugugugugcuugguguggugcccagaggguguugggagcucagggaugagcuggggguccacuccagggggcagggacauggagaccaaggagggcccugcccugaggcugggaggcaguuccucccccagggccagguagaugcucagggggcuccaugucuaacacucccaggucagggcccaggccccgcacaggccaggagugacucuggugggcucucccccucccccgucuccugccuacucugguuggggguguaggggccagggugugguguggccagaccuccaggcccagggcgacccccccugcucucccugcuccacugcccccugccccuaaugcgccggccucucgcaggaccugggggcccugaagauccccgagcaguaccgcaugaccaucuggcggggccugcaggaccugaagcagggccacgacuacagcaccgcgcagcagcugcuccgcucuagcaacgcggccaccaucuccaucggcggcucaggggaacugcagcgccagcgggucauggaggccgugcacuuccgcgugcgccacaccaucaccauccccaaccgcggcggcccaggcggcggcccugacgagugggcggacuucggcuucgaccugcccgacugcaaggcccgcaagcagcccaucaaggaggaguucacggaggccgagauccacugagggccucgccuggcugcagccugcgccaccgcccagagacccaagcugccuccccucuccuuccuguguguccaaaacugccucaggaggcaggaccuucgggcugugcccggggaaaggcaagguccggcccauccccaggcaccucacaggccccaggaaaggcccagccaccgaagccgccuguggacagccugagucaccugcagaaccuucuggagcugcccuagugcugggcuuguggggcgggggcuggcccacucucagcccugccacugccccggcgugcuccauggcaggcguggguggggaccgcagcgucggcuccgacuuccaggcuucauccuagagacugucaucucccaaccaggcgagguccuuccaaaggaaaggauccucuuugcugauggacugccaaaaaguauuuugcgacaucuuuugguucuggauaguagugagcagccaagugacugugucugaaacaccaguguauuuucagggaaugucccuaacugcgucuugcccgcgccgggggcuggggacucucucugcuggacuugggacuggccucugcccccagcacgcuguauucugcaggaccgccuccuuccugccccuaacaacaaccacaguguugcugaaauuggagaaaacuggggagggcgcaaccccccccaggcgcggggaagcaugugguaccgccucagccagugccccucagccuggccacagucgccucuccucggggaccccucagcagaaagggacagccuguccuuagaggacuggaaauugucaauauuugauaaaaugauacccuuuucuacauggugggucagcuuuuuuuuuuuuuuuuuuaacuuucuuucucagcauucucuuuggaguucaaccuagcgcccaugagccaggcugaggaagcugagugagaagccaggugggcgggacuuguucccaggaaggccggguggggaggaagccuagagggaaccccaggaagggcaaauccaggcaaaucugcaggaaugcucugccaugggagcagcuccucccuugccacggccaccuucucuagcacugcaagguccacagggcauugcuuuccuuucuaggcgguggcagucagggaacagacugagguagguguaggggggucuaggccuucguggagcaccccagggaguuaguaggccccggggagacagagucugcacaggcccuuucuggggccaccuccauccacgaggagcagccugagccuugguggccgaaccuugaccgucccggagcacagcuucagggcagggaaccggagccccuggggggccucacgggugugacgaggcccuucauugcaggcaggugggccaaugggagcccucacccacgcaagccgagacaccacccagagugcaggcugccuggccccuucuggcacggccagcuccacacccccugccuaggguaugugugguccuaagggcuaggagcuuccccuacuaacaucucccagaaaaagcaguuaagccccucagggcacagcaagguuagacacagcccccauccccagaucaggacuccaucuugcuaaguggcaucaccgucaccagccuccccuuauuuaaaagcagcgacugguguugccgcagguaccuggucuacgaagacgcaggcaucccucucccaccguccaccuccccgggggccgcugacagcacagucgccugggugcacgcuugugggggcagcaggaacggggcugucggcucucaggggaucuggcugcagccagggcgagggccuggcccuuccuuccagcuccuuccggcuccuuccagcugaagggcaggaagcucuggccgcuuagcuucuaggguuccaucucccuagaaaggugcccacgcccagggcaucagucaguagcggcagcagcagcagacucggggcuuucccaggguggcgcagccaccccagcugcaugucaccucagcucuccaucuuauugccauuuuguagaugaggaagcugagaccagaaaggcuaagacccaugccccaggcaccacacccaucucuugggggcugggcaccugcuacccgaggccaccuccugaagcccccacucuucccccauguuccacuucaggagccgcgggggcccauccugacacccgggguuccucagcccagcgcagaugugcuucaguuccagagggcuuguugauuuguuucuuagguacguuaccuguccacccugaguccagugaggcugucccaagagccccuguagugugcuccugggaagggcugggggggcugggggggcugggagaggcccaggggcagcugucacuggaaccccagccagauguccaaggaagccggccagaacacggagcagccagauggccccagcugcaccugucuagggagcccaugcagccuccuugcacuggagaagcagcugugaaaguagacagaguugagacuucgccguggucaggagaaaaugcaaauucccaggaacaagaauccuuuaagugauauguuuuuauaaaacuaaacaaaucaacaaauaaaucuugaaggcggaugguuuucccagcagugcagggguuggagggaggcugcuggcacuccuggggccaagggggacaggcagugguccugagucugcucagagaggcaaggcagaaggagcucgccaggcaggucagcucacaucuguccaagucgcucuggucagaaacagcgacucucccccauucccccagcguucccaccaggccugggcugcugggaagcccuugcuguacccaggagcccgacccgcaguauccuggcacagagccacuugucacucagaacagucagugucuccaacgcacaaacauccacuccucuguuaccaguuaaagcacuuuaaugcuuuaaggugaaaacgaaaucccauccguguuuuucguguaagaucgugcuucuccgagcaguauuaauggacgcccuccaaugacauaacaacuguuuuugguaauguaaucuugggaaaauguguuauuuuuuuagcuguguuucaguggggauuuuuguuuuuguaacauaauaaaguguauguuccaauga

SEQ ID NO: 192876 - RNA, 36504 nt, Homo sapiens
agucgccgcugggcaccccgagaccauggggaagcucguggcgcugguccugcugggggucggccuguccuuagucggggagauguuccuggcguuuaggugaguggcaucuugacagggcgucuucgacucucuuucucuccucuuccaagugaggucaggggcugccuggcgcccccuuccuagcggguaggaaagagcagcuuuggaaccucacuccuccaucucacccagcaaaccgccccuugagacucgcuuauggggaaagugagcuacuugcguuuccaaagacugccgagccgaauuagucccauuuauuuuuugaagguuaugaucccccacuuugcuuucugaaggucaugacccccuuuuacuuucugaacgugaugaccccuuucccagcucgcccucaacauucugcuugggaaaaaaggacguccauuggaaacgccggacuugggagagaggaucaggcuaccaguuggauguuuacggcugacugagacauugcccaggucuggcuaaccaugcagaaguacuggguuauggaaccuauccuagauuuaaagagcuggccagacagcagggcaaaccagcugaaaccugcaggcgguaacuggcauuuuguaggcauuugaccuuuugaaguggaagauacaauggugauagccagccuagaaaugucucaggaaaagucaauacugggcuagaaagaagaaccuuuaagugauaauacacauucaugaguggaucgaaagccucugcuugcuuucaguugucuuugaguguuuauguauuucucuuaguugaagcuggucuucuuagaggaucacgucuagaaucuguugaggugccuggugccuauuaguaauacuuccaguuugagaguuuuauuguuacauuugcucccagugcaaccacauggagaaucauaaaauaauaguaauaauaauaaaguagaucuaaggguauuuuuuuaaauaaaugacuguaagauaaguauugagucuuucugaauauacuuuaauaaaaauuuuaaauuaucccugauauuagaagaauguggaaacauuccuuuucacucuggaaacaagaaaauuguguugaaaaauaaaucggccaauuguuuaaauugugguugguuuaaugaauuuacauacuugcggaguaagucagcauaaaauuuaaaaauuaaagcaaaagugauagaguuugacuauuaggagacccuguugaauuuugggaaagcaguuuggaaggaaaaguucaaagggcaagacuguaggggauuaagugcagauuuauaacagacgauacuuuagaaaauuagggcuauuucgugcauuuaaauuaauaauauuguucaauuacucauacuauuaaauagugucuuuuauuugggcagcagaauuuuccauguugaaucauauuauacaguuuuucagcaauaacuggguaagguuagcugauauagguaaaauacccacauaaugucuacauuauguaaauaaacaugaaaggaaguaccuacuuacuuguuaugucauucauaaauuaugauaaagauaguuaaccaacacgaagaugauugaaguccacauuuaaacauacauuuugaaugcugugccuugacuuccaggguuggguuuuaucuucuacagagaaagggugaaugccucucgagaaguggagccaguagaaccugaaaacugccaccuuauugaggaacuugguauguaugugacaguaccaagaggagccagcacagcuucuuggucgucauccaccugacugagcccuaccagcucauuuaauuaccugucacuacuuaagcccucccagugggacaucugccccguccacucugccccaugcaaggucuucagggguguacuaaaugacauucuuuguggguuuuucucagcacauuuccuuacugacaucucuccacauuaccuaaagaaugucauugaccacucccugguuuuccccucacugaaugcuucuccuuucccaucugugguauuucacucuccuccuuguccucuguuaccuuuccuuuuuuugcuucuuucuucuuuccuuccucccucccuuuccuuauugucauuccuggcuucaaguguuauuuuuuuucaaauaauaugacucagccccuccccucaagaaccucacagcaggcugggcgcaguggcucacaccuguaaucccagcacuugggaggccgaggggggcggaucaugaggucaggagaucgagaccauccuggccaacauggugaaaccccaucucuacuaaaaauauaacaauuagccgggcauguuggcggcgugugccuguaaucccagcuacucggaaggcugaggcaggagaaucacuugaaccagggagucaucggagguugcagugagcugagaucgcgccacuguacuccagccuggcgacagagcgagacuuugucuuaaaaaaaauaauaaacgaaggaaccucacagccuaccuaccuucuuuuaaaaaaauucauaaaaaauccauggcccagucccuaaccuuucaaacugcagcccuucuuuuuuagucaguuaaagggcagcuccagcucaaacucucccuaagcugaaaucuauuuuacauuucugucguuuucucccucauccucccacccacaaccagcucugcuucuagacuuuuccuauguaugguacccccauucucaaaagauucaguucaaaauccaggaaccauuguuccccgcuugucccucaugcuucuacgugagacaugggcuaaucucaccuacuaguuaaugccacaccugcuuauuugggcuccacagcuccaauucuuccugacauugcuaacagaaaaauaaaauaaaaucaggcuagauuguguucccuguucugggaauauguucuuucaccuucucaccuuugcuuaugaaauucccuccaaacuuacugauuccucugucucugcuuacuaaaaucagcugcaaaauucaucuccuuccucugaacucucacagcacucugaagcuccgauucacuuaugacaccugccacaugccuuguauuauagcuagcaguguucucucuuucacuaucagauuguaaacucccuagggccaagaacugugacuuauuuauuagaaugugaugagauagcuuauuuugggauaugauuuucuauuuuauugcuauauuuaaaaauacagaaaaaguacccuuuugauuugaguuuucugccuuuucuugccucucaauuucuaaaaaauaaaguaaucugaaccuugcacucccuagucuuagaggugguuugugcuagcagcuggaaagcagaagaaaccaaagaaaacgccuuuccugaauuguuuuuaaaaaccugagccccuucaagggauucuguuggagaagggauaugaauauguggauaucuuugaauaauggggauccuuaccccacuggcugacagcauucugggagaggagcaggaccucagaaggaaugguugcaagguaucuuuagggacgcuggacccuguguuccagcuaagguaaagaccuugugucaaugcauuacauggaaguagcagaauugucuaaauuaaagggaccaguaacuuuggcaaugaauaauucgaugauacguaguguagaaugaaugccagauggccuuuccaaaacauucugcuuagguuuagaacccaccacuuaaaaugauuucauaacccuaacagacaaacccaguaaugacucagauuggauuuuccaucaacuuaguggaauaggauaucagagugauuuaauuugauuuuaaaaauaaggaaaugugacauuuacucauuuguuuacuguuuugugguguaguaguauucauauucacuauacaaauaacugucaaaauauauaagccugcaaauaaucaagagguauaauuagacuagaugauugguagggucuagucugacucgaauuguaucacucaacuagauuugagaagguaaaauuacaguuaauauugugagucuuaggucaauguucugauuugccaaauauuuugaagaaaauggcuuaaauaguuggaagcaggcugggagcagaagaaagaaaugccauguuacuucucaugucuauuggcauauguuuggugaacuaaacaaguuagaaugaugaugggucaugugucaguaggacaauacugauauauauguuuugaaaaagcugcuuuaucaaaggccuggugacuaugagcagccuguugaguccuuuacaaacaucuacaucauccucauaaccaauuuguaaaguggaugcugcuaucuaugcuuugcagauuaggaaauugacauacagaagaauuaaguugcuugcccaaugguccggaacuagggggugaugggcuuagcuuaugagccaagaucguuuccuucuaugccuuuuuacucucuguuguguaacacuaacuuucugaucuacugacaacacauuuuuuauuuuggaagcuucaggaaaguauugcaacaguggaaaacagaaaaucugagaugcaaacagcugaaauauuacuagauacagguuaaucaaaacaaggcagucuagauauuuaaauuaagauaauggauaagauaauacucacaaaucacaacugguugaggaguagaggcuuuacaaagcccugaaaagcugcugaaggauuuuagguaggguauaguaggcuguaacagagcuggagaaaaauucuuauuuguguuuucaagacccagacuuuugagguuuauuuuauugguagaagaaacucuuauuuuguuuuccuucuccagcauuuuuuucugggaagaaaaguugaaaggugaaauauaucuuucucuggaaaucauaucucauagaucuuuuuguauuacguucaucuuuuuauccaaggcuuuugagggucaaggauuguuuuaaccaggacguuaucuggcugcccuugacaucuaaucaaagcugcacuugaaauaugaauacuucaguaggacuuucacuaggcaggauuaucgaguagguggccucuguauuuaauaccuacguaucuucucuuccacuccuuuccauucuauagcuucccaugucuccaauauaugcuucuacuccauaauagguuccauguguuuucuuagcuggcuaucagaaacuucucuccaagaugugaagugacgauaauaaaauuaacugauaguaaugcuuugaugugauccuuuaucagagugccuguaggggaugacuggagaaaugaagaaaagaguaaagaaaugaaguuaugccaaguagcaguaggguugacaggcuaagaagcaguaggcaccuauucauaagacugauuuuagacuuagcagugggauuuuaaugauaguugugcauaggcuaauaagugugugggaaagucucagaggaagguauccugggggcuuuugcucccacaggugccauuguugcugagaugcauggggccugucgugcaggcguaguguaggugacagcuccuuuuucaacuuguucucagucaaaacuuacuuauuauaugucucuuuccauagaaaaaaaugcugaaaacuagcucuuacugagaaaaaagaucuaacuaaacuuucauauuaauauucaguaaucuuucauauucauuuauacucauuaguuuauuacucaauaauuucccaauaugauuguauaauguagcguuuuaggcuuuacguuggaagagaaggaaugcuuggcagagaggccuguaauaaaagaccuucacgauuaugacuuuccagauuuuaucacugagucuauagagcagccuucuaugggggauaaagcugaaucucucaggauaugcccuggaaauuguuacuuaaagaguaaaucuaggauaugaguuuauuuucuagguauuugccuuuuucuccugaaaaugggguucuaaaaaaggauuuaguauuugaggagucugacucaagcuuuacuauagaguagcaugccugugagauucuccaaaguuaauaugguuucccaaguaaaugguugaacaagucaacaauuuccaaaagaaguuuccaaaagauauuuguaguuuggacugugagacguauuuuuuaagccuucauauaugcauuuuucugauucuacccuucuuuugcagaaaguggcucugaagauauugauauacuuccuagugggcuggcuuuuaucuccagugugaguauuuuccaugcugcucucaugcucacaucaauagcuguauagacagugcauuaauguuguccucuggagcugccagauggaucccuaugcucucaucccaccuccggguaaaccagucaacuaaaaaagccaaaacagaauuuuggagggcuaauuagaacaccacaggaaugcccagcuuugacugccucauggugggcaacucccuggggguaguggcauacucaguagggucuugauaaauguguauugauuuccacucgauuccuaggcuagucuccaguucuguccuauugcuauccauucucaucauugcccuauuugacugggcuuccgcuucugguagucaucuucccacuaacugguauuccucucaccaugucugccuuuauuuggagcucugcaaauguuuguggaucgaauauuaaccacguuacucgauuuaaaacucuaaacacguuccaucuuggguucccugccauucuuaacaagucuuucaaagagaaauagagaacagacugcauuuuaauucccaguacugucuucacaggaauaaucaagaaguuacaccagggacagcauuucgguaaacaaacaaaaaaauguguauuuaugagauguugaaauuuuucauauauuaauauuuguuaaaucaauugcauuuugaaauggggauaugauuuugaaaaaguauauuuaccacauuuucaaugugaauucugauugcuggaauuggaugucuaauauuccauuuggggcaauaaaauaccaccaaagaacauggauuuugaauuuaaauauuuuuggccaaaaaagggguacuuauaauaaccguggccugaauuuauaaauucauaaguacacacaguagaauagagugaggcucucauuuggaccuuaaacugcugcuggugucacugcuggaacuggugcuagucugugugggcaauauuuuauuucuuuauuuuuccaucaaaaucaaggauaaaacaaaauggucuagaaaaguuuuuuccuuguugaccuaaauuuucuauugucaguuuagauuuuuuuuuauuauacuuuuaaguucuaggguacaugugcacaacgugcagguuuguuacauagguauacaugugccaugcugguuuccuauaccuauuaacuugucauuuacauuagguauuucuccuaaugcuaucccucccccagccccccacacccugacaggccccagugugugcuguucccugcccuguguuuauguguucucauuguucaacucccacuuaugagugaaaacaugcagugucugguuuucuguccuugugauaguuugcugagaauuauaguuuucaguuucauccaugucccugcaaaggacaugaacucauccucuuuuauggcugcauaguauuccaugguguauaugugccacauuuucuuaauccagucuaucacugauggacauuuggguugguuccaagucauuacuauugugaacagugcugcaauaaacauacaugugcaugugucuuuauaguagcaugauuuauaauccuuuggguauauacccaguaaugggauugcuggaucaagugguauuucuagugcuagacccuugaggaacugccacacggucuuccacaaugguugaacuaauuuacacucccaccaacaguguaaaaguguuccuauuucuccacaucuucuccaccaucuguuguuuccugacuuuuuaaugauugccauucuaacuggcaugagaugguaucucauugugguuuucauuuacauuucucugaugaccagugaugaugagcauuuauucaugucuguugacugcauaaaugucuucuuuugagaagugucucuucauauucuuugcccacuuuuugacgggguucuuuguuuuuuucuuguaaauuuguuuaaguuccuuguagauucuggauguuagcccuuugucagauggguagauugcaaaaauuuucucccauuccauaggcuaccucuucacucugaugauaguuucuuuugcugugcagaagcucuuuaguuuaauuagaucccauuugugaagucuuugcccaugccuauguccugaguguuauugccuagguuuucuucuaggguuuuuaugguuuuaggucuuacauuuaagucuuuaauccaucuugaauuaacuuuuguauaaggugugaggaagggauccaguuuuggcuuucuacguauggcuagccaguuuucccagcaccauuuauuacauagggaaucauuuucccauugcuuguuuuugucagguuugucaaagaucagaugguuguagaugugugguguuauuucugaggcuucuguucuguuccauaggucuauauaucuguuuugguaccaguaccaugcuguuuugguuacuguagccuuguaguauaguuugaagucagguagcaaugaugccuccagcuuuguucuuuuuccugagaauugucuuggcuaugcgggcccuuauuugauucccuaugaacuuuaaaguaguuuuuuccaauucugugaagaaaaucauugguagcuugauggggaugacacugaaucuauaaauuaccgugggcaguauggccauuuucauguuauugauucuuccuauccaugagcauggaauguucuuccauuuguuugugucaucuuuuauuuuguugagcagugguuuguaguucuucuugaagaggucguucacaucccuuguaaguuggauucccagguauuuuauucucuuuauaguaauugugaaugggaguucacucaugauuggcucucugucuguuauugguguauaggaaugcuugugauuuuugcacauugauuuuguauccugaaacuuugcugaaguugcuuaucagcugaaggagauuugaggcucagaugaugggauuuucuaaauauacaaucaugucaucugcagacagagacaauuugccauccucuuuuccuaacugaauacccuuuauuucuuucucuuguccaauugcccuggccagaauuuccaauacuauguugaauaggaguggugagagagggcauccuugucuugugcagguuuucaaauggaaugcuuccaguuuuugccuauucaguaugauauuggcuguggauuugucauaaauagcucuuauuauuuugagauacguucuaucaauaccuaguuuauugagaguuuuuagcaugaagggcuguugaauuuugucgaaggccuuuucugcaucuauugagauaaucaugugguuuuugucauugguucuguuuaugugauggauuacauuuauugauuuguguauguugaaccagccuugcaucucugggaugaagcugacuugaucaugguggauaagcuuuuugauguguugcuggauucgguuugccaguauuuuuuugagggaggauuuucgcaucaauguucaucaggguuauuggccuaaaauuaucuauuuuuguugugucucugccaggcuuugguaucaggaagaugcuagccucauaaaaugaguuauggaggauuccuucuuuucuauugauuggaauaguuucagaaggaaucgucccagcuccucuuuguaccucugguagaauuugucugugaauccaucugguccuggacuuucauugguugguaggcuauuaauuauugccucaauuucagagccuguuauuggucuauucagagauucaacuuuuuccugguuuaaucuugggaggauguaugugucgaggaauuuauccauuucuucuagauuuucuaguuuauuuguguagagguguuuuuaguauucucugaugguaguuuguauuucugugggaucaguggugauauccccuuuaucauuuuuuauugcaccuauuugauucgucucucauuucuucuuuauuaaucuugcuaguggucuaucuauuuuguugauuuuuucaaaagagcagcuccugcauucauugauuuuuugaaggguuuuucauguaucuaucuccuucaguucugcucugaucuuaguuuuuuauugccuucugguagcuuuugaauuuguuugcucuugcuucuguaguucuuuuaaucgugaauaaccagauagcaucauggugauggaucaaauucacacauaagaaugcuaaccuuaaauguaaaugggcuaggugucgauuuuagaucuuuccugcuuccucuugugggcauuuagugcuauaaauuccccucuacacacugcuuuaaauguguuccagagauucugguacauugugucuuugaugucauugaugucaaagaaaaucuuuauuucugccuucauuucauuauuuacccagugucauucaggaacagguuguucaguuuccauguaguuguguaguuuugagugaguuucuuaaucugguguucuaauuugauugcacuguggucugagagacaguuugugauuucuguucuuuugcauuugcuaaggaauguuuuacuuccaauuauguggucaauuuuagaauaagugcgauguggugcugagaagaacauauauuguguuguuuuggggugaagaguucuguguaugucuaugaggucugcuugguccagagcugaguucaaguccuggauauccuuauuaaccuucugucucguucaucugucuaauauugacagugggguguuaaagucucccaguaguauugugugggagucuaagucucuuggcaggucucuaaggacuugcuuuaugaaucugggugcuccuguauuggaugcauguauauauacuuuuuaaaauauauauuuuuuauuauacuuuaaguucuaggguacaugugcacaaugugcagguuuguuacauauguauacaugugccauguuggugugcugcaccaauuaacucaucauuuacauuagguauaucuucuaaugcuaucccucccucuucccccuaccccacaacaggccccagugugugauguuccccuucccguguccaaguguucucaucguucaauucccaccuaugagugagaacaugcaguguuugguuuuuuguccuugcgauaguuugcucagaauggugguuuccaguuucauccauguuccuacaaaggacaugaacucaucauuuuuuaugucugcauaguauuccaugguguauaugugccacauuuucuuaauccagucuaucauuguuggacauuuggguugguuccaagucuuugcuauugugaguagugccgcaauaaacauacgugugcaugugucuuuauagcagcaggauuuauauuccuuuggguauauacccaguaaugggauggcugggucaaaugguauuucuaguucuaguucuagaucccugaggaaucgccacacugucuuccacaagguugaacuaguuuacagucccaccagcaguguaaaaguguuccuauuucuccauauccucucuagcccuguuguuuccugacuuuuaaugaucgucauucuaacuggugugagaugguaucccacugugguuuugauuugcauuucucugauggccagugaugaugagcauuuuuucaugggucuguuggcugcauaaaugucuucuuuugagaagugucuguucauauccguugcccacuuuuuggugggguguuuuuuucuuguaaauuuguuugaguuauuuguagauucuggauauuagcccuuugucagaugaguagacugaaaaaauuuucuugcauucuguagguugccuguucauucugaugguaguuucuuuugcuaugcagaagcucuuuaguuuaaugagaucccauuugugaauuuuggcuuuuguugccauugcuuuugguguuuuagucaugaagucuuugcccaugccuauguccugaguguuauugccuagguuuucuucuaggguuuuuaugguuuuaggucuuacauuuaagucuuuaauccaucuugaauuaauuuuuguauaaggugugaggaagggauccaguuuuggcuuucuacauauggcuagccaguuuucccagcaccauuuauuaaauagggaauccuuuccccauuucuuguuuuuaucagguuugucaaagaucagauaguuguagaugugugguauuaucucugaggccucuguucuguuccauaggucuauauaucuguuuugguaccaguaccaugcuguuuugguuacuguagccuuguaguauaguuugaagucagguagcgugaugccuccagcuuuguucucuuagcuuaggguugacuuggcaaugcgggcucauuuuugguuccacaugaacuuuaaaguaguuuuuuccaauucugugaagaaagucauugauagcuugauggggauggcauugaaucuauaaauuaccuugggcaguauggccauuuucacgauauugauucuuccuauucaugagcauggaauguucuuccauuuguuuguguucucuuuuauuuuguugagcagugguuuguaguucuccuugaagagguccuucacaucccuuguaaguuggauuccuggguauuuuauucucuuugaagcaauugugaaugggaguucacucaugauuuggcucucuguuugucuguuauugguguauaagaaugcuugugauuuuugcacauugauuuuguauccugagacuuugcugaauuugcuuaugaguuuaaggagauuuugggcugagacaaugggguuuucuagauauacaaucaugucaucugcaaacagggacaauuugacuuccucuuuuccuaauugaauauccuuuauuucuuucuccugccugauugccuuggcgagaacuuccaacacuauguagaauaggaguggugagagagggcaucccugucuugugcugguuuucaaagggaaugcuuccaguuuuugcccauucaguaugauauuggcuguggguuugucauagauagcucuuauuauuuugagauaugucccaucaauaccuaauuuauugagaguuuuuagcaugaagggcuguugaauuuugucgaaggccuuuucugcaucuagugagauaaucaugugguuuuuaucuucaguucuguuuauaugccgaauuacauuuauugauuuguguauguuggaccagccuugcaucccagggaugaagcccacuugaucuuggugcauaagcuuuuugaugugcugcuggauuugguuugcuaguauuuuauugaggauuuucacaucaauguucaucaggaauauuggccuaaaauucucuuuuuuuguugugucucugccaggccuugguaucaggaugaugcuggccucauaaaaugaguuagggaggauucccucuuuuucuauugauugggauaguuuaggaagaaugguaccagcuccuccuuguaccucugguagaauucggcugugaauccaucugauccuggacuuuuuuugguugguaagcuauuaauuauugucucaauuucagagccuguuauuggucuauucagagauucaaguucuuccugguuuagucuugggaggguguauguguugaggaauuuauccauuucuucuagauuuucuaguuuauuugcauagauguguuuauaguauccugugaugguaguuuguauuucugugggaucaguggugauauccccuuuaucauuuuuuauugcaucuauuugauucuucucucuuuucuucuuuauuagucuugcuaguggucuaucaauuuuguugaucuuuucaaaauaccagcuccuggauucauugauuuuuugaaggguuuuuugugucucuaucuccuucaguucugcucugaucuuaguuauuucuugucuucugcuagcuuuugaauguguuugcucuggauucuguaguucuuuuaauugugauguuagguugucgauuuuagaucuuuccugcuuucucuugugggcauuuagugcuauaaauuucccucuacacacugcuuuaaaugugucccagggauucugauauguuguaucuuuguucucgucgguuucaaagaacaucuuuauuucugccuucauuucauuauguacccaguagucauucaggagcagguuguucaguuuccauguagcucagugguuuugagugaguuucuuaauccugagugcuaguuugauugcacuguggucugagagacaguuuguuauaauuucuguucuuuuacauuugcugaguaguccuuuacuuccaacuauguggucaauuuugaaauaagugcaauguggugcugagaagaauguauaguguguuaauuuggguggagaguucuguagaugucuauuaggucugcuuggugcagagcugaauucaauuccuggauauccuuuuuaacuuucugucucguugaucugucuaauauugacagugggguauuaaagucucccauuauuguugugugggagucuaagucucuuuguaggucucuaaggacuugcuuuaugaaucugggugcuccuguauugggugcauauauauuuaggauaguuagcucuucucguugaauugaucccucuaccauuguuuaauggccuucuuugucuguuuugaucuuuguugguuuaaagucuauuuuaucagagacuaggauugcaaccccugccuuuuuuuguuuuccauuucuuuaguagaucuuccucugucccuuuauuuugagccuaugugugucucugcacaugagauggguuucuugaauacagcauacugaugggucuugacucuuuauccaauuugccagucugugucuuuuaauuggagcauuuagcccauuuacauuuaagguuaauaucguuaugugugaauuugauccugucauuaugauguuagcugguuauuuugcucauuaguugaugcaguuucuuccuagccucgauggucuuuacaauuuggcauguuuuugcaguggcugguacugguuguuccuuuccauguuuagugcuuccuucaggagcucuuguagggcaggccugguggugaccaaauuucucugcauuugcuugucuguaaaggauuuuauuucuccuucacuugugaagcuuaguuuggcuggauaugaaauucuggguugaaaauucuuuucuuuaauaucguugaauauuggcccccacccucuucuggcuuguagaguuucugccaagagaucagcuguuagucugaugggcuucccuuugucgguaacuggaccuuucucucuggcugcccuuaacauuuuuuccuucauuucaaccuuggugaaucugacaauuaugugucuuggaguugcuguucucgaggaauaucuuuguggcauucucuguauuuccugaauuugaauguuggccuaccuugcuagguuggggaaguucuccuggauaauauccugcagaguguuuuccaacuugguuccauucuccccgucacuuucagguacaccaaucagacgcagauuuggucuuuucacauagucccauauuucuuggaggcuuuguucauuucuuuuuauucuuuuugcucuaaacuucucuuguuguuucauuuuauucauuugaucuucaaucauuguuacccuuucuuccacuugaucgaauuggcuacugaagcuugugcauucaucacguaguucucaugccaugguuuucagcuccaucagguccuuuaaggacuucucugcauugguuacucuaguuagccauucaucuaaucuuuuuucaagguuuuuaacuucuuugucaugaguuugaacuuccuccuuuagcucagagaaguuugguugucugaaaccuucuucucucaacucaucaaaguccuuuuccauccagcuuuguuccauugcuggugaggagcugcauucguuuggaggaggagaggugcucugauuuuuagaauuuucaauuuuucuguucuguuuuuuccccaucuuugugguuuuaucuaccuuuggucuuugaugaugcugacguacagaugggguuuugguguggauguccuuucuguuuguuaguuuuccuucuaagagugaggaccgucagcugcaggucuguuggaguuugcuggagguccacuccgacccuguuugccuggguaucagcagcggaggcugcagaacagcgaauauugcugaacagcaaauguuacuguuugauuguuccucuggagguuucgucucagagggguaccuggccaugugaggugucagucugcccguacuggggugugccucccaguuaggcuacucaggggucagggacccacuugaggaggcagucuuucuguucucagaucucaagcugcgugcugggagaaccacuacucucuucaaagcugucagauagggacauuuaagucugcagagguuucugcugccuuuuguucggcuaugcccugcccccagagguggagucuacagaggcaggcaggcauccuugagcugcggugggcuccacccaguucgagcuuccugaccacuuuguuuaccuacucaagccucagcaauggcgggcgccccucccccagccucgcugcucccuugcaguucgaucucaaacugcugugcuagcaaugagcaaggcuccauggguguggaacccuccgagccaggcacggaauauaaucuccuggugugcuguuugcuaagaccauuggaaaagugcaguauuagggugggagugaccugauuuuccaggugccgucugucacagcuuugcuuugcuaugaaagggaauucccugacccuuugcacuucccggcugaggugaugccucacccugcuucggcucacacucggugcgcugcacccacuguccugcacccacugucugacaagccccagugagaugaacccgguaccucaguuggaaaugcagaaaucaccagucuucugugucgcucaugcugggugcuguagauuggggcuguuccuauuuggccaucuuggacagaugcauguauauuuaggauaguuaacucuuguugaauuguucccuuuaccauuauguaauggccuucuuugucucuuuugauauuuguuaguuuaaaaucuguuuuaucagagacuaggauugcaacuccugcuuuuuuuuuuuugcuuuuuauuugcuugguagaucuuccuccaucccuuuauuuugagccuaugugugucuuugcacaugagaugggucuccugaauacagcacacagaugggucuugacucuauccaauuugccagucugugucuuuuaaucggggcauuuagcccauuuacauuuaagguuaauauuguuauguuugaauuuggcccugucauuaugauguuagcugguuauuuugcccguuaauugaugcaguuucuucaugucaucaauggucuuuacaauuuggcauguuuuugcaguggcugguacugguuguuccuuuccauguuuagugcuuccuucaggagcucuuguaaggcaggccuggcagugacagaaucucucagcauuuguugucuguaaaggauuuuauuucuccuucacuuaugaagcuuaguuuggcuggauaugaaauucuggguugaaaauucuuuucuuuaagaauguugaauauuggcccccacucucuucuggcuuguaggguuugugccgagagaucagcuguuagucuaaugggcuuccuuuuguggguaacccagccuuucucucuggcugccuuuaacauuuuguccuucauuucaaccuugguaaaucugacaauugugugucuuggaguugcucuucucaaggaguaucuuugugguguucucuuuauuuccugaauuugaauguuggccugccuugcuagguuggggaaguucuccuggauaauauccugaagaguguuuucuaaguuggauccauucuuccugucacuuucugguacaccaaucaaacguagauuuggucuuuucacagagucccauauuucuuggaggcuuuguucguuucuuuucacucuucucucaucuugucaucucacuuuauuucauuacuuuggucuucaaucacugauauccuuucuuccacuugaucaaaucggcuauugaagcuugugcaugcaugaggaaguucucaugccuugguuuucagcuccaucuggucauuuaaggucuucucuacacugcuuauucuaguuauccauuuguaucacuuuuuucaagguuuuuagcuuccuugugauggguuagaacaugcuccuuuagcucggagaaguuuguuauuacugacccucugaagccuacuucugucaacuugucaaacucauucuucauccaguuuuguuucuuugcuggcaaggagcugugauucuuuggauaagaggcacucugguuuuuggaauuuucagcuucucugcucugcuuucuccccaucuuugugguuuuuguuuggugaccuacagaugggguuuugguguagaugugcucuuuguugauguugaugcuauuccuuucuguuuguuaguuuuccuucuaacagucgcgccucucagcugcaggucuguuggaguuugcuggaaguccacuccagacccuguuugccuggguaucaccaguggaggcugcagaacggcaaauauugcugccugauuuuucuucuggaagcuucaucccagaggggcauccgccuguaugagguaucugucagccccuacugggaggugucucccagucaggcuacaugggugucagagacccacuugaggagacagucuaucuguucucagagcucgaaugccaugcugggagaacuacugcugucuucagagcugucagacagggacguuuaggucugcugaagcugucugccgccuuuuguucugauuugcccugcccacagagguggaaucuacagcaaggcaguaggccuugcugagcuguggugggcucugcccuguucaagcuucccggccucuuuguuuacacugugagcacaaaaccgccuacucaagccucagcaaugguggaugccccucccccugccaagcugcagcaucgcagguugaucucagacugcugugcuagccgugagcaaggcucugugggcguagaacccgccgagccagacacgggagggaauuuccuggucugcugguugcaaagacugugggaaaagcacaguauuugggcaggagcguaccguuccuccagguacagacugucacggcuucccuuggcuaggaaagggaaauccccugaccccuugcacuuccugggugaggugacgcccugccccacuuuggcuugcccuccaugggcugcacccacuguccaaccagucccaaugagauggaccagguaccucagucggaaaugcagaaaucaccugucuucuguguugaucucacugggagccgcaggccggagcuguuccuauuccgccaucuuggaagcuuccuuucaguuuaaauuuucaauguuaugccaaauauaccacuaaaagugaugauucuauaacuaggaaauuucuuuacuguugugaaauaauguuuguccuuccuacuguauguuuucuuuuuuuuuuuuaauuuucacuggaacuaaaaguucugaaucauugcuauacaggaaguauauauuuucaucacaaauaauuuuaugagaaauguuaacaugaaguuuuaaauaauggaucuccuuuuguaaaugaacaaacaacuuauaggauaaggauucuguuguuuugcuuguuucuaauccuucugcacuguaauaaauucaggaccuuguucuuuugguuucuccuuuuacccuuucuugccauccuagaagauguuuggaaguugcugauuuggagaauaauucugugcaauagauauuucuagucuauuuagggaugacaaacaggauauuuucuucccugccuugggacuugacaugcuucucuuugacuccaagauuacucccuucuucacacuuugccagcuaacucccacuucuuugugaggguucauugugguggcacuuuacuuccucaggagagucuucccuggcacucucuuguggggugaggugccucuucaauguucccucuugaauauucccucacauccccugaguuuaggcuguuauagaccacaccauacuuaagugcuugcucuagguuucaagauccuugaacucaagacuuuggaacauguauugacaugcccaacaccgaacauacuaccaggcauuugcaaguccucgaauauuuacugaguucauguggugauggaugaguauaguggaagaguucauugauuguccacauuuaccuguaguuuguugggaaaaauaagauuccugcaugucuagaugaugauuuucaucacuuucaccagugaaugguaugaaaagaauugcuuacagucauuaacacacaguugguuugcugccacaaauuccuaccuaacugcuuuacacagaaaacuaggugaaugugaagccauuuaucagaaguguuucuuugaucaucacacuuaaucuagaccaagcuuguuugcagugcccugcccuuaucuaucuaucagauuauuuuauuucuguaacauccagucuuuucacuagcuggcuaugcuccaccuucccccaagcuaccaagguacuugccauuguguucugucuugagcugccuuccugagcaauacuguuuacuuccaaaccuuucuguauguguggcagagagagucugaacaauaaaugaucugagugauuuaggcaaaucacucuucuaggccucauuucccucaugugaaagggaagaugugagauaagaugccccuaauauauuuauauguauauaauuauuauauauuuuuuauuuuuaacauaugugaguguguauauauauacauacauauauacacacacauacauauauauguauacauauacauauauacguacauauauacacacauacauauauauauguauacauauacauauauacauuaaauuuuuucuucaguacuacuauuaucugagccauugagcuuggugacaaauugguuauggggaaaagaguagacugaaaauugaauuuuauguucugauguuggggagcauagugauguccuuaacugagaagaauagauauaaaugagaggauggauucgaggggagaguguugauuuugguuuugacuaguugauuuugagcugcccuuugggaggagguugggaaggcaagcuagaguuacagaguuacaaauaaaugugcagacuugaaaguccuugauauaaaggaaauaccugaaucuuuauguauaagaucugcaaggaaagaguauagagugagaagggaggagggaucgauaaaaacagaaggagguauaaauccaagagucaggaagaggagcaggauuucuaucugggaacucaacuuuugacguuuugauaagaaagaagaagguauacuguagugucaaaugccacagagaagcagaucagaaguagaaaaguuaucaaaauaaaguaauuuggagaccauuuauaugaucuuuauaaggguauuucuacaaacuggugggaguggaauacuaacuucagggaauugagaguuggagcaguucacauuaggcaauaagaucaggugauguuucuaagaaauuugauggugaggggaagagagauaaaugcauauaugaagaggcaguaaaguuaagaaaauauuuauuucaaggaaggaaaccuuguaauuuuuuaggccaaagaagaagcuguuagugaaaaaugagugguaaagcaagagagagaggguguaaucucuagagacagacccuagagaacagggaaccaagaaagcagguaaaggauuuaaucuaagaacagaggagggacauuucuuacuugagaaaagagggagaaagaaagagaaugaauaaaacugaagaagaauuacugggacagaaaggaaagaauuauaggaaauucauguuaaaugacaugacauuuucagagaaguaguaaguaaagucauccacucauaauaaagaggaagaaaguaugggcucuagaacaguggucccagcauuuugggcaccagggaccaguuucguggaagacaauuuuuuccacagaucauggagggggaguggggaauggucaagauaaaacuguucuaccucagaucaucaggcauuagauucucauaaggagcauccaaccuagaucccuugcaggcucaguucacaauaggguuugcacuccuaugagaauuuaaugccacugcugaucuuacagaagguggagcucaggcgguaaugcucacucaccugcagcucaccuccuguuguuccuuguaaggcccagcuccuuacaggcuacggacagguaccagucuguggcacagggguuggggaccccuacucuagaagauaaugaaauaaauuuagaagugagacaugaggaaauccaauagauugccuaucauaaugagccaaaaaaaucaauaaacaguacuaaaugucuggcugaaguugggauagugacuuuguaguggaguuuuucaaucugauuuuagacuugcccuauauaagagcuagaccaaggcaaagggaguucgcacagaaugugauaaggaagcaaaggguguagcuauugaugacgacaggauuauggucuggaagcagaaguuuguggcuagggacaugccaaucccuucuccagaugugcugacuuaaggagaauaaagagggaacagugccuccucugaugagcuucaguagugccgguguugucugggaaaagccagguuucccucagacaacauugggacauacgaauugggcauagaaggacuguucuaaaaaaaguuugaagauauagcugggguuguucagaaaagauugacuaccucaagagggagcaguggaagagccaguaauaguaucauaaguguauguguacguguguguagaaaggacagggagagggaaagaggcagaaagacaaggugaaauaggaaagagagaauugcaauagacuguaaaagaagauaaagguagcagagaagauauaaaguuauugauauugauauauauccagugauagauaggggacauggagaggaaguggacuguuuuguaacugguguagaauaaaccaaccccaagguuugucacaguggacucagaugcagcaaaggcuucaugcauucaggaugccuauuguugauuaauagcuaccugauccuaauaguagaaaggaccacuguccaaguuacuggaauaaacuuuuugugauguuugaguaaagcauucaugucagaauuuucagacauaccuauaggaacaaaauaggucaaaaauagucaacuauauaagacugguauccuuauguuaauucuuagccagcuauacuguuugccacuacaugauauaaucgauguaggaaugggaacaauacaauuaaacuauacaccccuucucucugcuuugaggaagguuaguuauagaauaccaggaccggaaauaaucuuauaaucauguauuugaacuucuucauuuuauagaugaggaaugugagguacgggcaugugaagggauucacacaaaguaacagccuagucucuucuguuauauuuuuuuggcuuaacuccuuuucucuaaauuaaaaacucuuccuuaucuugaauaugguucuuucuguguucauagccaauguuuagaugacaucaguaacaccccagaucagaucauggaaacagcugacagagugaaaaagcccaguaaucuaaaugaaauuuagaacuuugaacauuuuuauuuggcuuugagauuuuaaauuccuuaugaaaauauuguuuugauauguauaugugugcacacuuguucuuuauuuuuaaaagggauuaaaauauccaggcaugccaaacuuugcgccagaugaaccaggaaaaaucuucuugauggaucugaaugaacaaaacccaagggcacaagcgcuagaaaucagugguggauuugacaaagaauuauuuaauccacaugggaucaguauuuucaucgacaaagguaaaaccuguauguuuagggauaagggggaaaugagggaaauagaaaccauuuaucuccagccccucaauauuuauguaacaggaagagagaagaugcuauuuuaccauacagauguguuuuuuuuaaaugauaaauagguauaaaaccuuguaaacauugcauuaaagaaggaacacuaguauuuuuggcccuauguggccuccuccucuuccuucuauccacuugucuucuuguuugacugucacaaccuguuugaauacuguucucagaaaucuaacauguaaacuaaaggcccuuuaguuuaguugucacuaaagacaacugugagacguuaaaaaacauaacauaagggggaaaaaaacaaauuagacucaucaaaguuaaaagcuuuugugcuucaaaagacaccaucaagaaagugaaaaacaacccaaagaaugagagauaguauuuguaaaucauauauuagaugagagacuuguauucagacaauauaaauaauucuuacaacuuaacaaaacacaaauaauguaauuuaaaaauggacaaaguaucuaccuagauagacauuucuccuaagauacacaaaggccuguaagcacaugaaagauguuuaucauccuuagacauuaggaaacuacaaaucaaaaccagaaugagauaccauuucacacccacuaggauggugauaauuaaaaagacagacaauaacaaauguuggcaaggauguagaaaaauuggaacccucauacuuugccagugggauugugaaauaauguaaccacuuugggaaggaguuuugcauuuccucaacauguuaaacauagaguuaccacacaauccagcaacucugcaccuugguguaugcucaagagaauugaaaaccuauccaugcaaaaacccauauacaaauguucauagcagcauuacuccuaauacaaaagguggaaauaacccaaaugucuaucaacugaugcauucauaaacaaaaugugauagguauuuauacaauagaacacuauuuggcaauaaaaagaaaugaacuacucaugcaugcuauaauauggaugaagcuuguaaauauuaugccaacugaaggaauuuagucacuaaaagccacacauuaugugauuccauuuauaugaaguguccagaauaggugaauucacagacagaaaaauuguuggcaggagccaggggaguggggaaggaggaaugacagcuaaugaguaggugauuucuuuuugggugaugaaaauguucuggaacuaaauagugguuaugguugcacaauucugugaauauacuaaaacccacugaaguuuacauuuuaaaagucugaauucaguggugugugaauuauaucucaaaaauauauuauaaaaacauaaguuaucaauauaccauauaugcuuuaaaaacaauaguuuccaauauuauuuuugacuuguucacaguucauaauuucaaacauuuaauuuuaaaauauuuuugggucuauacagcaugaagaaaauuaagaacagggaaacuucacuaacaguaaccacaugaaaggaggaccaaauugaagugcuagaauuccaugaaaucuuauauacacuuuuauuugcuuagcaagcucugcuuuaaaagauaauugaaucuaacaauuuuucauugguuuauaguauacaaacuauuuucauauauaauggugucuuuacuucucgaaauaaaauccugggcccaaccuugacacuuccucucccuggcccuuuugaucaacucauuauaauguuuuguuuaauguaucucuccaauaucucuccagucugaaauaucuguccaucucuccccauccucacugcuaccagcaguucaaggccccagcaugccuucccugauucugcaugggcccccaacuguaccuuccuucucauaccaccucaauucauugucauaguaaggauuucuuuuuaugcaaaucugauuaugucccucuuuucaucaaauuuuucauauuguucugucacucugaggauaaaccccaaaucuccagaacggccuggguuccugggugcuuccccuguaccuucuggcaccuguaugcucuccaguuucacuggaaaccauucuccuccagacucucuggaccagccauacuggauuucuuuucauucagugaagugucucaugccucaggaucuuuacaucugcuguucccucugccuggaauguccgucugccacuucuggcucacucuuugucaucauugaagacucagcuuaaauaucaucuucucagggaagccugcccaccaucuuguuccaauuuguguaccuuucuauauuucuucucaauguaccucuuuuuuaaaaucauucauuacggugguaacuaauuuuuuuuuuaugagaugaaguuuugcucgucucccaagcuggagugcaguggcacaaucuaagcucacugcaaccccugccucccggguucaagcaauucucaugccucagccucccaaguagcugggauuacaggcaugcgccaccaugcccggcuaauuuuuuguauuuuuaguagagacaggguuucaccauguuggccaggcuggucucgaacuucugaccucaggugauccaccugccuuggccucccaaaguguuaggauuacagguguaagccaccacucccagccuacaguaguaacuuuuuuuuuuaaauguuaaaggauaggaauuuucuuucccucuccugcucuugcucuauagcaaguuccuaaacuuaacuguuacucuucaaaugaaugacacucuaugaagaacgugucuccccacucuaguauucuuuguuuuaauuuauuuaauaauuuuuccuccuuguuuuccucucucaaauauaaucaccauaaaagcauauugauuuguccauugcuggauucugagagucuagaacaguaucugaugcacaguagguacucuaugaacacauaucaaaugaauaaauaaacgaacccuauaggacaggcagagcacauaguaauauucaacuuuauagauggauacaaugaaguuuagaggaaugcagugaagugugacuucacuucugcaauuaguaaauggcugauccagaacucagacagaggaggucucacuucuaauccugugucuuuuacuaaaaugagauuaggacucuauuuaaauaauuuuaaaacugcaacuguuuugccucacacuguacaagacauaagauucugcauuggagaugguauaauaagugauuagauuuaccugaaacuauuucauugcaugggaucauauuagagguagagguggagguggguuuggggcuuuuuuucuuucuuuuuuuuuuuuuuguuuguuuuuguuuuuguuuuugagaugggacauguuuauacaauaacagucauauaaucaggcuuccauaaguugaguauauuaugauucacagcuuaucuuauuuguuugucaucucccuuaauuauguauuuaauucauaaggccaaaauauuacauauagaaauagagauggaaugaggagauggagaagaaaaguacucucacuaaguauaucuuauuuggaaagagggauucaguagaugcacuagaagaaaugaaaucaggcuagcacaagugauuguucacuauugugucuagcaaaagacugaagguccguguuggggcugaaauccaacccauguucuguuugccacgcccugagccuuggaacagagcuggaucagaccagaaggaagauuuccucugugagcaagcaccuuuccuuaauuugcaucaaagugcccaguguguuucagagguccugguuaugaauuuugcaucucaggguuugggcuuguuccaucacgugcuuaaaaacuacauuugggaaaggaauagggaagaugaauacagaucaaguccuacagugggaggaugggaccagacccuuuaaaacuccagagcucaucaaaccuagaacuccugauaagucagaagacagcauucucagaggccaaauuacuacccucaaucuuguucacagcaguucacauuccaauugaaauggguaggugacauuucugagguggguacuaccuagaauuaguuaguuuguuuuaucucgcauucauauuuacaugccauguccauugagcucacuaaauauuguuauguuggcuugugucagaaauucauugucuagcugggaaauguugcuuauuuuaagguguuuacacugcccugacauucacugagcuucuguugcaauguagauaauuauuguacacacacaacaucucagcaaaguuuuguuugcuugcacucacuucucuugcugaagggccaucuggggaaaccacaucccuguuuaugcaucauuauaguucuguaggcuccuguuagacagguuaugcauauaagggugaagugacuauggcaaaacaucuuggcucugccacuuuguggugaugaaauugcugauggaucauucgccuccugagcuucaauuuccucaacuaaaucuggauucuggcauuugucugacuuaccuaucauguagacugugaggguaaaaugcaagauguaagaagaaaacuuuuggaagugaccaaguuuuaaaacaagucuaauauuaguugugauagggguaacuuucuuggaaauuaucccuuuuuuccauguagacaauacuguguaucuuuauguugugaaucauccccacaugaaguccacuguggagauauuuaaauuugaggaacaacaacguucucugguauaccugaaaacuauaaaacaugaacuucucaaaagguauggaaugaaaguauugugcgguucuauuuacuuugcaccucugcugugugcuuuguauuuuuugguucagcaggcuuucuuaaacuuuuguuuugaaauuguuuugauuuuuuucuaaagcuuucuaaugauucccauggugacucuucccagcgccucacuagaaauugccauguuagguauugaauaugccuauauuuucgagcauuuugaaagcauuuuaauccuauaaaggugcucaauuaaauucccagcucuaauuccauucucuuuaccacggcaacucaauaccuacuaucggucucuguuuaaacaccuacacccuuuuuugguuguccuaguagguuguguucugugagccucacccacuggguguuauaaccaaccuccagaugagccacuucuuuguuuaauuacagcuuuaaaguagaauuuuuuaaaaguccuugggcacuuauaaaaauuacauuuguuaagcauugacuaugugccaggcacuaugccagaauacuuaauuuaacuuaauucucacaaagccuuuaauaauaggcauggguaaacuaagacuuagagaagguuuggguuagauaacuugcccaaguuacacaauuuguaaguggcagaaacaggguauaaacccagauccaucugaauucaaagcugagcucucaauugcaaugaacaucuuucuuacugcauucauuaaaauaacaggcuuuucaguggagaggcugccuguuuaaaggcuguagcaaacaauaaagaauucaucuuuuaucaaaugggcuuaacauuaaaaaacuggcuccaaaacaguaaauuguuucaugggauagaagaauaggaaaagaaaagaaaguucaucuucuuuccuuugcucucuuucucaacaucauguauuaauuucuccccacagaauaugggggaaacgagugcagagcauagaaguaagagaaguugaaguuauugaacucugcuccuaaugcaccguaugggguucugaggccauagcggagaacaggacuuccacaggguugcugggaaacuguggacaagucacuuaauuggugccucaauuucuugagcauaauggggauucucauuugccugacuuaccuaacuaguggauugcgaggaucaacugcuuuagcauaggaucucacaggaagagucucccagaaagugcagccugagggcacaccugauauuuggccacuucauuagggaguacaaucccaggaagcagacuugagaaaccagugugaggcaaggaagggagaagguuauggguugaauuuugugucccccugcccuccccaccccacucccccugccaaaaaauauguuaaaaucccaaccaccacuuccucagaaggcgacacuuuggaaauugagucauugcagauguaauuaguaaagauaaaaucaugcugaaauagaguacccuuaaugcaguagaacugguguccuugcaagaagacaggcagauauacagggagaaugcuaugugaagaugaauacugacauuggagugauauaucuacaagccaaggaaugccugggacuacuggaaugccuugcuggaagaggcaaggaaggauccuucccuagaaccuucagagauaacauggcccuaccaauaacacgguuuuggauuccuagccuccaaaacugcgaggcaauacauuucugguguuuaagccacugaguuugugguucuuugcugugccagcccuaggaaacacaugcagugagggagguacagcaaaggcgucauuaagccaaccgcugcuaacugacugcuugaaaucauggacuuauccuccaguaaucagcguaagcugcaucucaggacaaucuggucaaggagaaaaagggagaaggguuuauccaccagccccaucuccuauuagucaaagguuugccucaagaggccuucauuuucccacauucuugguuguugugcaugugcaagucuaguuuugugguauccuaugacucaaugucaacaugaaaucuggaagugggaggcaagaggcccacaguaggcaugagcugagacacugcuaggcugccccucugggaaguacaucagaccugugcagaacugguugaaauagcagcagcuggaacaagguaggugaggcuaugaggaucuaaagaggagccugaggguacacuggcacaggcauugauaagcacuuacaagggggcauaacagagagcuacagaaacaaauugugaggcaguuuaaccuaauuuaugaugucaggcaauacuuuuuggaguaaagaaugcuuaagcugagauacaaaaggugaguagccgagugaccuugggaaagucauuauaugucaaaacuucaaaguauuuccugauucacccaaauuuuccucccuaaaauuuaaucuaaaaauguuuaagcauuauuuuuucaagucacuuuuuuuuucuuuucaaaaauaaaaaugacuuuauuuuucuuacggauuguaagaauaagacuugcucuauuuuaaaaugucaaugauauugaagaacguaagaaagaauaucacccauaauuccaucuacucagagaaaauauaaagguccagaugaacuggguuaugcuaugauaacaggacagcaaaacccuaacaucuugguggcucaaaacugccaagguuuguuauguuuuuucaugcaugcuauguauccaguguaggugauuuagggacucaguuucauauuauccucauuaagggcccuaggaggaccacagucucuaucaucauaaaaguugcucauuacuguggaaacaugagggaaacauggugaagcaagcagugguucuuaaaaucuuccauccacaagccacucaccucauuucauuucauuucauuggccaaagcaagucacauggcugugccuaacugcaaggggauggggaaguguaauuccugaaggaggauaaccauagcuaucagugaacugcacuacaacugucacagauaaccaugaucaacauuuacaagucaacagauuuugggguuugagauuuauuugugaauuuauuucuuuucacugauuucugugaaagagaagaguaagaaaauaacaaauggcuaaagaaaacccaucagggcaaugcagaaucaugauuuucuguggaauuccuuaauccauacuaguucauguauccuuuuucaaauugaugaacguauuagucuauguagagaugagugauuuugacaaggauaaaggauauuuaaauaccucaugggucucuuuuuccaccucccuuucacuuuagugugaaugacauugugguucuuggaccagaacaguucuaugccaccagagaccacuauuuuaccaacucccuccugucauuuuuugagaugaucuuggaucuucgcuggacuuauguucuuuucuacagcccaagggagguuaaagugguggccaaaggauuuuguagugccaaugggaucacagucucagcagaccagaaguaagcucuuuuguguauuuuucuauccuuugcccuugacauuuucguggacuccuuuccuuacgaggaaguuacuuccuuacuuaggcuuacguagugaauauauguguggagggaucaguuguggccaggguucacacuaaaucugucauccuaagcaauccauuuguuuccuuggacuuuagguucuucccaguuaaaggagggauguggacuuaaggauauaaggaccucauuccaaauuuuuacauaacucuugaaacacacuuuccuaacacacuacaaaggaagauaaaugagcaauaccccugccccuuaugaaaguacaaaguauuugaccacuuaugcuaaguucaguuacacaaaagcucuuaggagagagggaaggcuaccuuagauugggcauagggauuguauaaguuucagaccuacugacuuacaacagcagaccauucaaugagaaaacccuauuuuaaacagcaugaaauuuuaugagaaaacacuuuuaaaaaguguuuaaaaauuggagguuuuuuuauaaacagaaguaccuugaauauuaacauguauauuugagauaaugagcaaagaugaucccuguagaaaacaccucucaguguccuuccucuuuuaaaauauugugauugagcuuuauggucauuugauacuuuuuuucaagcacuaguuuuuagaaguauauacacuuuuggccuuguaagagauccacuuaccuucauucaauuuaaggaaaaaguugugacuucgaaguaauaagauugagccuauauaugucaucuagaaacaccaguuucauuauagucauaacucauauucaaagccuguuuaaagcacuucaagaauauuaaaaauacuaccccauuaucuucuuuuacugugguuuagaaaaggauugcagugguacuuucaaggagugugcauuuuuauaccucuucuccaaaauaaaagugaguguugucucucauuaccacuugcuuaaguguaaaugucauuuacuucaaagguaugucuauguagcugauguagcagcuaagaacauucacauaauggaaaaacaugauaacugggauuuaacucaacugaagguaagaguacccugucuggcccacacaaucugacuucuuaccuuagucccauacuugacccaggaaugugccccuugaaugaggaaaacauggcuauuugagagcaaugccagugagauuaugcaugcguuucuaaaauacagaagcaaagcccccuaaaaacaccaacuuuaggugccagaagaagcuguagggguuguggggaugaauagggaagaaagcgaggaaucauugagacaaugucuucacuacucccucuuuguuguaaggugauacaguugggcaccuuaguggauaaccugacugucgauccugccacaggagacauuuuggcaggaugccauccuaauccuaugaagcuacugaacuauaacccugaggacccuccaggaucagaaguaaguuccuauaccucucugagcucacaggcaaagcugcaagaacaaauuuguuggggugacuuggaagaauuuaagccagucacauuugguguuauagaacuaaagaaauuuuacguaugagaaaaguaaaguuuuugacagguagggagauaagguucguuaacucuuuuaggccaccauuaacuuuucaauaacucuugcuguugggaauaauggaaaaacauaagcucgauuauucauauugacccagauugccauaucguauuuccaaucaggagauagucucugagcagguaggucuugcaguuagacaaagagagaguuguauaugguaccaucuucuuucacacuguccaacaugaagcuaagauuaaaggauuuaaauaacugucgccucaaaauaaaaugaguuuuugccuguaaguucuaacauauacgaugguguugaaaauugucuuauuuucaagauaucauuuguguuauuuuaaaauaucucuucuaaaacaauagcauaauccauugaauuuucuacauuaaaaacaacauuauaagacaacugcauuuucuauggcauuaagguuaacaauuuaaaaaucuuuagugaauuuauauauagcuauaaauucuaggcacacauacucagagauuuauucacaaaaauuuauugaguaccuguaaugugucagacauuguacuuauguuuaggauauaucagaaaaaauauacagagaucccugaucuuaagaaagggggacaaacaaugaacaauaagcauaagaaauaaguaaauuacauaguaacuuugaagauggcaaauuuuaugggaaaaaaggcucagcagaguaaaggggaucaggauuacuauaugcagcaggaugagcagguccuacuacuaaagucagagaucagaguaggccucauugagaaaguacaauuugaaaaaaauuaaaaugugugaauccacauuuggugauuugagaaacugaaauucaaauucaaacccaguaauuggccuaguggguaaauuaggacauacaguuauuucuacuuccaguauugcugucuuucaguuaaaaauaugauuauuucuuuuuuuauuaauguauuagucacagcuucuuaaaaagaacacaagaaauguaaaaagaaacaaaaguccaaccuaagccuagaaccagaauuguuacccuaaacuaggaagcaauccuugccucagauauguaccccuaagagugauagacaaaacuuuccuuuaaaagcccaaccacaaugucugucuuaaggaaaugaaauaugauacauaggauuauuggagaauuguuuaggaucuuuuucguaucucuauuuucaaguugaauuauuuuuaaaauuuuagauaagacuuuuugucacaauuacugacacccuuuaauuuugguugaaucucauguuuuguacaugaaaucaaagcuuaaguauuuuugucuaacaaaccugagaugaaggaucucccuuaagauaaaaaaaagaacaaacucuguucuaauaagagauaucaauauagacucguaacucauaaauuucuaauuguuuuccuuuaauuccaaaauaaaaauuuuauuuuauuuuguuugagugaacuucauccagccuauuuggaagccugagugcuuaaauauacacugauuagcaaaguuaaguguauuaauccugggaucaauaacaguacuaggcagugaugugucaaaugaaauuccaaaguaguauccauuauuuaugcuuucuagcaacuuugcagaugugaaggggcuccagcugugaugacugccaucccaucaguuaccauguuggguuggcuggauaacuggguguuucuucauuauuuugucuuguuucucuccccauacuguaaucucaaaggcaagauucuucccacagagggaggaccaccauccacuugagaacuaaauaagagcaucuuaacuccuucuguaagggaugccugcacuaaaaaaauuguguaagucaucccugaggaauuuggcuaaugucagaaagccaguucacuuuggugcauagauaucuaugacauuaguacuuucaucagaagaagaacaauuuauugaagauauacagauuuuagcuucugauuucugaaaaauagauuuauccuagaauguuugggaaggacaucaugaaacagguguuuacucacauaauauacuaauaaacgaucuuuucucgacagguacuucgcauccagaauguuuugucugagaagcccagggugagcaccguguaugccaacaauggcucugugcuucagggcaccucuguggcuucuguguaccaugggaaaauucucauaggcaccguauuucacaaaacucuguacugugagcucuagacucuagauaguaaaaaaaaaaaaaaaaagucuacauauuuuguaaaaguaaacugauaauuguaugauaaguggcacuguaaguaaauagcaaacaccaa

SEQ ID NO: 192877 - RNA, 184490 nt, Homo sapiens
uugcaaagugaaaguuguuuauugcuuguuacgauuuaacaggcaaaauacgacaccagggauguaauaccuacaaggcggucuuccugaaaugccugcccggaacagaaugcugggaugcacucaacugugaauuuuucuugaggucuuccuuuccuucaucuggaugaaguggagcccagcccuccugugucagugagacuggaagccucugggggccaugugcucugcccucugccaucucugcucauuguucccccauguucacaccugccugcauuaaccaugagcagucacacauuuguacucagugcgcagucacacauguugaagaaaacaaaucguacugcuuguucuuaaaaaugagaugaaaaaauaaaucuaaacacacuuuucaaguguuacucuucuuuaaacuuuuauauauguuaaggcucuucuuuuucuuuucaauauacucuacuuagaauuuuaaaaaauaaacuuucuuuuuugguaccucuuguuuccuguauuagccugggaaacauuuagaaauacaucucccuagaacucuucugugcaaauaauaaacauaaauaauauuaacauuuauuuauauauauuaaaaaaggccauuucaagguuuucacugugaccgccuugaagaugcuccuauaaguagucuguggucuggcccuugaaguccugaucggccugaguggggcuggacaggaaguccacgucccgcuuguccaucugcaagcugcuccguccgggagaacuguaagacacuccccagccugcugaccagcgaccaggaggaaauccaguugaguaagcugaagguaggcaggcugaagagggaagacaggggggucacccugccggugcuggcagcucucaccuuggacuccucaggacacccuccuggacuccucaggacagccuccccuggcgcagaggacaugggggccggugcgcucagccccuccagcagggugugcucccucacuggcaugcucauguccacugugcugggcuccccgcuggccuccagggagcagaccggcugcugugugugccaagaaggcugggacaggggcacagaggucuugacuguccucccugaugagugcucgguucccgaguccuucgggaggcgucccugagcaaaggucucuuugggagcacugcaucuccugggggacuuccuggucaacugacgugccagcugaaguuguguggggaaaacccuccccuggagggaucugaaaaacaaucuagaaaaaguacauuaaaacaaaaaguuagauauuccugucgguggugucuuugagcuuccagagacccacauagagcagaagcaaugccaaugucgucugggcucacucggggcucagaggcacuaucccgcuccgacacccaccugggcagcagugcagcgacaggcgucaucaggcaagucaaguaaaacacugggucacccaguaaggcuugcauaguccaguaaggguuggacggaggauagcacguggcacaagacgcauuguaaaucaaagccacggugaaaaacaaaaggacacugaagccacacguuauccaguugagccaggucugagggggaaugagaaagaaagggcuuuuauuuccaccuaaaagugacaacaaugacaauaacaaaaacgugccagucaucaaugagcaggugugagguucugaggccuucagacacacugcggucuaugacgcggguaaccgguggggcucaaugaggccuccagaacccauggaccgcccugggagaugcacaugaggugagauggagucaggggcgagagggcaagacaggagggaaaggagagaauguggugguggaagcgggaaagaggcgggagggagaugagcauggccggggaagugcgagcaucaggcugcagcggcuccccacaccacagggcucgggaaugugucauuguccuucucaucacacugaggucagcuuugcagucuccugucuacucaaaacgaccucccagaccucaugaaucugcagggaagugugggguccacggcaucagugcucuucugagacguggccaugcaggcggcucuuacccagguuuugguuucaaugcccagguggagcaggaaagugagcagcgcgauugucacaauaggggucccccagguaaacagguccacguucgagucauaguaggccugaaagacagugggguccuggaucuguagguccccggauccagcugguaagaaaaacugcacccaggggccaacuuaccagguaaggaauggaaaagcaaaccaggcucuggaaggcggcgucggccauguuaaaccagaacguucguggccgguauuccugggacacaaaaacaaucagugauguuacagugaagcauuggcauccucugugaaagcaguuagaauaaaaauggagucacuuguguuaaaaacaacaacaauaacaacaaaaacccacccugaggaguagagcugggaaaggccaugaagggaggguucucaugcauaaauaccugauaacaaaaaugaucauauccacagaaaaauauaucuauaaggacaugugcccagcaacugucuguccaaccucaaacaggcaccaucuuugucguuuauccuuguagucaaggaaagagcaucucaaaacgaucaugaaauuuuuuccuuuaaauacauuugucuuccuuuaccucgcuaaauaugcacauagcuuacuacagcacacacauucccauugcagugcccuauucccgaauaaacaccauucucuuuuagagagccucucucuguuugcuauuuagguugacaccucgaaugacauuuccuaggaugcuacacguaaguuaaugcacaaggcaagcacccaaggaaaacucacucucucaggacuuuuggagacgcgaggccccagaggcccgaugaaaagcacuaccaaacaccuacaaaacuaucugcagcugcgucacucacugggaacaccugcaccaaaaagacgagcuucaguagcuccagguucacaguaaaaagaugaaacuggcugggugcgguggcucacgccuguaaucccagcacuuugggaugcccaggugggcggaucaugaggucaggagaucgagaccauccugguuaacauggugaaaccccgucucuacuaaacauauagaaaaauuagccaggcaugguggugggcgccuguagucccagcuacucaggaggcugaggcaggagaauggcgugaacccgggaggcggagcuugcagugagccgagaucacaccacugcccuccagccugggugacagagcgagaccuugucuuaaaaaaaaaaaaaaaaaaaaaaagaugaaacugcuuucugcaucuucccagggaacaugucucucaaguaggaaguaggaauagcaccugaaauuccgggcauucucccccaguuugagcccuucuauuccuuccacuuugaccaguuuuugccucucuugguggugggucccuuagaauguuucuuaagagcgagucuucacuuuuaaaauuacacgauggaugugucccaauguuaaaagcaaacagcuauauacccaugggcagaaaugaaaauaaccuugauauagaugaauagagucucuauuacccgggugaccaaauguguauuugacccugccaaguaccagagcagcuggcacgggaccugcaggaaacacacacuggggaaggagcucuggcugagcacuuagggaaagugcuggcuaggcucuuccugugggccacuuaauuccacaggacaggacacacucccagcgucuuugucccacagguggccgaggaggcugaggccuggccaaggaugggaacuccccugaagcaacagauaacaagcagaggcccugcuccccucccuggcccuucgccuccuggcaccccgugcaugcggccugcuucugugggaacugaacauucucagagguggccaggggaaguuaacucaucagugaaugaaucuggaauuagggauuauugcaggagaaaugagacuccauguucuuuuugcccacauggaauaauucaaggcaaagaaaagcacuugcugucuauuuuaauggcuggcuagaaacagcuggucaucagugugugaaucuaugugguauauuaaugccaguauguauuuaaaucuauuugcucuuucaguggcucaguggcuuccuuguggguuugucuucuuguuaauucccguucaaaauaagucacauuuucuuccuugcuuuagaaaaauccccccucuagcuucagugauccccugugacugacuggacucugggcuuuucuugggcuccuggagacucuuggaggggggacaguuucgcuuacaacacuugaugcacugcagccaagcagagggcagcccuuuuucuccauccucuagaauggugaauucuagaauuucaguuuguccaggguguccaucugaagggaggcugggggacuggcacuuuggaagagugaacguggagggcagagcucaggagguggaaggcggagacucgggggagcuuuaccuccauguucuggccacucuuguagagcugcggguuggucagcagcacauuggcuggcacaucccuguccagcaccccagucacgagcgggggaagugacgagaagagcagauuaaagaagauuagauaccacuggucaaucaugguagaugcagagaagccacagaaaaacuggaaccaaaacaggaggcccacgaacaucugaaaucaagaaaggaagaacaggaacaggcgagucuucagccauugcugaggauucucauccgagggagcugacaggccugcagaguuucacagucaagauuaaauguauuggcagcgauuucugccaaagacagccaugaccuugagcccugcugcuggccucugccucucccucuuccucuuucccuucgcccuccucacucccuuaagaaagaagaacuggcagugggaauugggaauucccaggagcagcacuugcggggaugagauuuuugugcuugacaagcucuggaucauuaacauaaaacaaaaucaagguuucacagggguguagggcugcucacauuucaagagggccaguugaguaugagcuguggcaucuucccuaguggcccuccucugucugugaccccagacaaagccuaccuguggcuauaucucugcuccugucucuucuuuagugaccugcauacucucugaggaggugcaguggacagugacugacucccacugaggggaggacacacaaaagcacaauagcaaagccaaugaccucaucaacaucgcugcagugaccugauuguccacggggaccucugcuggggggagagggagaggcaucaucucugauccucauagcuacagcuacccagcucagcagaacaggaaagugagauucagggagguggaacagccaccucuggccccugcucacuggggugggagcaaggucagaucucuucucacuauugcuagauuccugaauaucagcagccugagugcauuuauacgguggacaugacaguuuagugauugcaaagcauucuaacacucaugagcuauguagcugggcacagagcaugaacuccucagucucgcuuuccuugcucaugacaugggcauaccaaugauacucagccaaugcagcugcugugagcgugaagcgacccaguacauuuagaggacucaccagagucccuggagagcuauaggugaucgccuacgguguaugguggugagugguaucguuaguucccuuguuugggacucaggcagggcgagugcucuuaucccacauacagagagggaacuugaaguuccaagacaucaaaugacuuggcugaggucacggugugaguaaggaacccaacuuguucaacugcgaugggucuuggcuuggagggcaggcacagucccagcagggaacucugacgcuagacagacauuuucugcugggcaccgcaaggccugggcuugguucuggagcugcaacuaucuacccuuuugacccugacucagucacuucaccucccugagcuuuuggcuucuugaccugaaagugacuugugaagaucauaagaaauaauagcuuauguugaaauaacccaccaugccacacagccuccaaguccugugucagacuaugauuuaaaugucuuaauaugcagccuuucccuacaugcugaaaacgaacauuugguuuuuauucauugacuuucuucccuuccucacuccuacggcuggcucucgcucacucacccccgcaggcuuggccuagugagucaucgguagcaaauacagucaagagaaagagaagauaaguacucagauaauugagauuuuuuuuccuauaguaccaaaaagcuuucuucccaaaccacuguuguuauggaaaccuuucuucucugcuuuuuauuggaaagaaaggccaccuuauuccuaaaacuaaugaauuucucauuucaggaggcagagugauuauccuugaacuccucauguagauuaaugcuuguuaacaaaggccuggcauuuuuauggaauaaaaacaggcguccucuucuccuuucugcacccuucaauggggagggacucaucgcagcaggcaggaggcugugcccguuccaggugaccacuagggccuuuguuugcaucugaaguguuuaaugauuuggccuacaucauucuugcccucccuucgaucugagacauuuuaacugggaauuagggaucagcuggcucaacucacaggcuuugcuuuguuuuuuuaagauuuaaaagaagacuggacauggugguucaugccuauaauaccacacuuugggaggcagagaugggacgauagcuugaggccaggaguuugacaccagccugggcaacauagcgacacccugucucuacaaaauagaaaaaauuagcugggcaugguggccuguagucccagcuacucaggaggcugagguagggggauugcuugagccuaggaguuugaggauacaguaagcuagaguggcgccacugcacuccaaccugggcaacagaaucagacccugucuuuaaaaaaaaaaaaaaaaaaauccaaagcaggaauuaacuugcucaagaacccacagcuaacaagugauagaaagggggcuuggauucuucccugcccacccccauucaucccuccacuccuucgggagcugagaaccuuuaggcuuacaacugugcacuugaggccucaaaguucuggggauuuaaugccagggcugggagaaaggagguaugagccggcaagcccaggaguggugugacacagccuuccucagauagucccaggcacagccuaaucugaauuaaugucugggaccaaaccuaucaaguuaaacaugcccugacuggaucugagcagcuguaugcauuugcuagaagacgcuccgaaaaaugaagggggugagugugaaggggaaagagagguugggaaaagaaaggcagguguagccuccagaaaaacaauuaagaacauggagaaccagccugagcaacaaagugagacccugccucuacaaaauuaaaaaaaaaaaaaaauuagaugugcguggugacacgcaccuguagucccagcugcuugggaggcugaggcuggaagaucacuugagcccaggaaguugaggcugcaguaagcuaugauggugccacugcacuccagccugggagacaauagugacacccugucucaaaaaauaaaaauaaaaugaacaugaacaaccacugacaguuuagagcuagcuaacuggagaguuuuuauacagaacuggaaaaagaauacaccuuuuauuuuauuuuauuuucagaagaguauaggauaaucuugacacuggaguucugguguuuagccagguagauuuaugggacuaccuuggaagaucacuuacccuaagaguuuauuuugucucuuuguuuguacauucagccaaaagcagcagcagccuagcaacuccucaguaaaauaucuagaaaucucuuacaaauggggcagaacucugagacggccaugugguccauccugcagggcuauggaggagcccaucugccaaagaagcagugaagaaggaacgaagaguccaacgugaagauccacaugaaaugaccaugcagaacccucagagagacagaaaugucugcagccaaucugcccuggguguggcuuuacagcagggucacuuuagcuacagaaugagcucauccgagaggggugugucugcucugcaagccugggaggugggagagggugggaaggcccgaagggcacccccuuccugcugggucugagccucccugaccuaggggcuugccgccugucaccuguccuggugugggugugucccaacagaggccauucaguaugggaaucagagugaggcuaaguucccuuauucugaucccagaccacaaagcacacuugugcuuaucauuggauuuuccgucuacucuagagaaaaugcugauuagaggacuccuguuuggggauauuucagcagcaugcuccugagaaaccuauggacagagugguuaggagccugggagcaggacuggguggccuggggugaacgcagccuugaagguuuaccagcugugugccccugugcaaacugcuagccucauaauuaugccccuucucacucugcagccaucaguggacuugcuaguguuauccaccuguuuccaccaccucucccuagagaugcagcugcucucaugccccugaauuagacucugagccuacagagugcagagccagcccaggacaggggacaauuacacaggcgaaggaggauggagcagguuguccauggccucccaucugcuccauccuccuucgccucauucaggcgaugguccuaagaaccgaaccuuccaaucccaaaacucuagacagguauccaauaccuacuguguuuuuguagaagaaguacagcaccauguuggcaagucgggaguagcaccaaugcccgugaagaaucaagagccucuccagguaucggaauuucggcacugcaaagucgcuggccaucacugccuucaaagggagagggauuccuguuacuggugaugccgaccuggcgucagauuugucuucucuucucaaaaugcaagguacacaacagggaaggaaaauccccauucugaacacagugcgagcguggccggccagggucuccaucgcugucgucucccucagcaucuccuuccguuacaaaagaggcaaucucacccaacacgcuaguucagggaugucaccuuauaagauucauuuacgcuuucaaauaugugucacuaaugggguuuaaaagguuuucuuuuuuccugcuguuuucucaacaaaugaaaacacacagagauacaugguguuuaucugccuuucuuugccccggaugucauuuuccucuaaaucgguccauggucacaacccaaggaugacccaaagcugcuccugccguauguaucagagacagacauuccccuguccugggaggugcauuuugggcuguuccccccagaagccuuggugaugggcaaagccaggcccacagcuccacuggccucccacauacucccaacccaggacgccgggugcgggcaguggccgugugcaggagggaguggagaagacguuuccuccauggacaggcaggagccugccauggaagcuuccccugcauaucaucaagcaaggugcuuacgcagugaagccaacuaggcuggaaaacaccaucaaaaugauaccuuuuguccccagaauaauuugaaacccacuguacaauaaaugucuuuggaaaaaaaaaucaaacaaaguggcaggaaaagcuagauuucugcuuaucaacagaagguuauucuaaacagaaugccaaccugccuuuaacaucuaacugguuucccuauauucaaauaauauguagaaagcaguaaguuaugccucaagugguacgcuugaaauggaauagugucaugauacacaaaaccuuagaacaucaauuuucugaaccaaaaguuaaggauuucaaagcaaaugucccucuaccucuugcugucaacacauaggggcuuaaaagguuuuucguguucuguaaugcuuuacccauuaaccccaugauucauucucucaaaaaucauuuauuaagacuccacuauugccagccacagacuuggagaaacagauaccauuagacacaguccccguccuccacagaaucagucugaaaagcucagucaaaagggaccaguguuaaaaagaggcugauggccuacaaggccaaacucuaggcugccuuugaagaagaaacccccgcccuugagaaccacagucaaaccccucugaggacgccuggcuugccagccuucugcagcuccuuccuccccuaaauccaggccucaaauacaaugcuuguccuuccgucaaaguggccuuuccaaagccucccagcuuuucugggaauucuaggagagcaggaucagagauguuggggucaccuuguaucccuggcucccagucagccuuggcucuagagggugcaggacaaauagggugaaccagaugagccagagcucacgaagacagaacuucccaggagcugugggaucuccuuuguuccucuugcccccugccuggggcagucuccccaccuuggcugagcuggggagugccugcuccuccugccugauccuccacggcucagcucugacaucucuggcaucccucucccucagcaacccacagcucaucucucaaagggcucagcagggacugacuaaaaugcaagcaacagggucccagugcuggaaaacccaagugcauaggaugguaaggaaagguaucaagccucguccccaucucaccuaacacauccccagggaggaugcacagcuuuacauaugugcagaagugcccagcaaccuccuccccagcagcuacgccuguucaaagcugcaucucugggcaccugcccuauggcucagcuguucccaucaccuugcauguagagccccagggcuugggcuggugcucccaccuugaggaggagagcaggcauggcagcuccggccccuccccagccacaugcucaacauucaaguguuugauccaaaagauguuuacuagacgaguuuccaagcauaugaggucaauaggcacugcccccaucagauuuucaguagaggaaacagugaaaacagaagcaaugccaacaaagucagaaugaaugaacuauaguugacccuugaacaacacuggaguuagggguucccccgaacagucgaaaauccacauacaauuucugacucccucaaaacuuaacuacuaauagccuacgguugaugggaagccuuacugaucacacaaacaguugauaaacacgcacaauggaaucuacauguauuucacauauucaugacacaccuacguuuuccuuaauuuuuuuuccuuuuuuuuaaaaaaaaaaaaaaaaaaagagagacugggucucauuguauugcccaagcuugagugcaguggugcaaucauaguucacuucaggcucaaccucccaggcucaagugaucuuccugccucagcccccuaaguagcugggacuacaggcaugggccaccacgcugggguuuuugcauuuuuaguagagaugggguuucaccacauugccccgcuggucucaaacuccuggccucuggugauccuccugucuuguccuuccaaaguacugaaauuacaggugugaaccaccaugccuggcccgcuuuaauuuuuucgauauuucuaggcuaugugguucaucugcaaguuuuuucaaauugucacaaaucuccaaaaaauuuuccaaauauuuauugaaaaauguccccauauaaguggacucaaacaguucagacccguguuguucaaggguccacuguauuuuguacauuuacuuagcaaauguuucuugagcuuccccuugugcaaggugccacacugggcacugugaagacacaaaggugagucaaacaugaacaccauuuucaauuuucuggaggaagaaaaaaugugcgaguaacguaacacggagauuccagucagaugacggcggggggaguaaggcaagugucaaggaccagccgugacggaacuacugugcaucuagcuugggacccuccaucugaggguggaacaucagcuaaaacuauuaaugagcucugcacaggccugacauguagcacaugcccaacagaucauuacugaucgaaccacugagucagcaaaugaaucaaccagcgaguaagugguaucaacauccugguuuuuagaacuucggauaaauuguucccuaaaaucuccaccaacccaaaaauguugugauucauacuuaaucaaauguuggaaacuguuguaauacuaaauccaaaagcagcacauuuuuaguuaagucauuuguucaaugucugacucccagaccgagagugaacacaguggcagaggaaagaugcagaggugaacuuccaugugagugaggauggcuacauuccaccuguacagugacgccaggcuccaccuacaucaaaggcauuuuuucaaaugguauugcuccguguucacggacaguaaaaagugccugcugggaccgagccaucgaaagccagacagaaggcgaugacucaccuugccucucucugaaccacuuauuucacaaaaauagacuugugacaugggaagacaugcuuauugcacacugcuucauaaacaggaagaauggcauuccuccuuaccuuccacuaguggcuuagcagcuguauugagcaucagcuauauuaagggcaaacccuuuagccucguucaguagagcccagaggaagucggggacagcccacagggugacaggacaagaggucaguagggccaauuggucacacagaauagccugauuggucuuuaccugcauacccuccuggccggagauucccacacccacaucugccaccuggaucaugcugacaucauuggcuccaucaccuagaaacagcacaggcaagaagaauuguuugauucuagaaacagcacagaaucaaaucaaugugcuagauuuucuugggaguccccgcugaacucaguccugugaaagcguccuggggaagaugggggaaaaaggaguagagcauccacccugggagaauagaguuaagcauucagaauaagcuagcgacaccaggagauguuucggaaagcgggcuggagcugagccaccugguacauggcgccugcucugcagugccgcucuuacaccaguaaaacccucauccugcugucuggcacaaggaaagaugcuaucaucaucuucaucaucauuaguuacugagccacuccagccaagcagccaaggcuacucccagccacacuucccgggcaguuucuaaacuaagggaaggagguuaaauucagcccagcacguuguggagcucuuuuuuuugcauauggauugccacaguauuagccauugugcucacuuuggggcccucuaggggugcaauaaaggagaacuucucuucauucugucaauuuguugauagaaaauguuuaggaacacagagcauggucagauaucuggacaccuucggggaaaggacagcagagucauaaaguuguuaucacuccgugacggucaccauucuuggaacugggcagcagaagagcccaaaucagggcauacaucccaaguugcacaaaugagaaaaggugcagauacacaaaguuagaaugacuuguagugugacuacaggaugucucuucccugugauuuuccuguucuuuauaauguugagaccaauauuaacugaucaguuaauauauaucaaauuggaauucucugaagcaauaaaaaucuguacagcuuuccccagaaugucccauuuaaaaugagauacgguaaaacaugagauaugguaugcaacgaugcucucuacauuauaaaccacugggcacuaggaguaggucacauugaugcuuuaacgcauucuuucuuucuuucuuuuucuuuugagacagggucucacucugucacccaggcuaggugggagugcaguggcaugaucauggcucacugcagccucaaccuccugggcucaagugauccucccacuucagccuccugaguagguaggacuacagguacaugccaccacacccagccagguuuugcauuuuuaguacagaugggguuucgcccaccauguugccccagcaguuuuuuuuuucuuuuuuugagacagggucucucacucuauugccuaggcuggaguguaguggugugaucacgguucacugcagccuugaccuccugggcucaggugagccucccaccucagccucucaaguagcugagacugcaggugugugccaccacacacagcuaauuuuuuuuauuuuuuguagagauggggacucacuauguugcccaggcuggucucaaacucccgggcucaagugaucuuccugccuuggccucccaaacuguugagaugacuggugugaaccacgugcccagccaugugcugauguucuuaugggucauuacuuucccguuuucuuuugagauuccauucuguguuuccuuuucuuuuuaaucugccaaggauuuccuuccacuucuucaggaauaccagacaccaguggcuacgcggcugaggcaggcacuggccaggccagggaaacaucauucacgucuuacuguguacuguggccuuucagggcugacguuguccucgugcucccagggaaggacgcugacgcucagaggaggaggcugggacagggguggugcaggucagccugaagaccguuuccagcuccucagggaaaccugagggccaccccaggcacaugaaggcaaagauggccucaggacaggccauggcuguuagguuccccgggccuccugaacacgugcccugugcccacucuccuuagcgguuacuggccucaggguguguagggcaggguccccaugacgaccguguucaggccagugcucgcucuccucacugccacuguaacccaggcucaacagcggucuccucuggccaggugaggugcccacugugaacaggcagcaaucuccaugucaacaagcaggggcugucacagaccuuuugcagaaaauacugccaacacuggcugauugauuggcgaggguacuugauuucugauccaguucucaccuaggaguagauucuauuuacagggaggcccaauuguuggcaugugggggucacggccacugcuuccuuccuggcccucaccaggagguggugcugcugagccccugaaccugugcuagagacucugccugcacuagaagugggcagagaggauguccuggaaggaggcgaguggccaccauccccucccuggagaggagcagacagggcucuccaggccaacagugucugccaggaaaaaccaccaugagaaacacaguccuuaaauaacugguguaaaacugagcagugaugcguaucugaugauggacuuauuuacucagaagccugucccagaaccaucagcacagcugacaggaggcagugggaauucuggucaccaagccucugggcccuuagggcguuacaaagccuuggacacccggaggcucauggugaccagaagcagcugcaaaggaccuucuaaguuggccugggcuaaggcugaguguguagugcccucugcuguggccaggacagacugggacaggcaggucucuugugugcugucuccugagaaacaggguaagcuccaucuuguugccguaaagcagcaccggauuacugaccuugcagcaugaaccuguaacucugcuacucucuuuuguggcuuuccaauguaaacuuuaccuucggaacauguugccugcucuaucacacugggugugauuuuacacacagaaagaaaggugaggaaguguuuucccaucucgugguguagcauggaaggguagaggaaguuuggguccagcugggaggaggccgucuggccagcugggauacuugccuauggccagggucauggccuugagcuugcuccgcaccagcuucaccaccaugcucuucugcagaggcgucgaccgacagcagaggacggagcggcacugcuuggcaaggaagaggaauuuguccuccagguuuuucucgagagcguaggccaggcuucucccaucgaucacgaggcugggucugcggccagaggcaguggacguggagggugggcagagagaggagaaccucaugcucacuuugcccuuggucuucucaggggcucucuggaggccucuggacugcacguagcauaggcacuggucuagcagggcugcacacgccuccugaaagggacaugagaggacagcgcaguucccucagagucaugccacaaacauccccgcccuggcucaacaccucuggagcugacauccuuccgggcuccaggcugcaguacccgccugcccagaggccacccuccagaaacugugaaguucagccggagaggaugacuuuccccagagaagagacugaauugguggccaggcaccguggguggcucacuccuguaaucccagcacuuugggaggccgaggcggguggaucacgaggucaggagaucaagaccauccuggcuaacacggugaaaccccgucucuacuaaaaauacaaaaaaauuagccaggcgugguggugggugccuguagucccagcuacucgggaggcugaggcaggagaauggcaugaaccugggaggcggagcuugcagugagccaagaucaugccacugcacuccagccuaggcgacagagcgagacucugucucaaaaaaaagagacugaacuggucuagguuucucuaagaucuuacuugaucacccaugauacagugcagagguuggaauggaccaucuucacuuugggaggccauacuguauuauugugaaauugcuggauaguuagacugaaggcccuccauguacuucuugauaguucucagaggcccuuaccuaaccccccaaggacuaacugcaggacacaaagcucugcaaaaggcuuuguuaugauuagccccuaaagaaaugcaauuuucaguauccucccuaaguucuccaauucugccaggaaaagaaaaaaaaaaaagcacaauuacggaggcuuuuaauaggcaaaacuugaucuggauuccagagaaaggaggaaaaccuacggugguagcagcacuagggaucaggggcaggagcuggaggcacaggagggaccaccgucuccaggaacaaacacgcuccggggagccugggcagcuccugauccuccgcagaccgugagucugcugggucagugaccagugcccugcaacacaccacggaaauccagcuguguucaacacacgcuuacugaggauccuuuguauucagaaaaugaagccagacuagagaaaagaagacugaaaagacacaguuacugccguagggggaacagacagcugaugcacacacacucauggcugcagcaaaucaccaaccaggaugugcgaaaguguggagauggauaggagagggagagcuuugcuuccagggcauggggugggauauggcaguaacuggggaaggccuugaggagaaugcaggaugccaucacaggaacuccaugagcucccuggacucccacagcaguggagacuccuccuucaucccguugcucccacugacuucaggcggcacuugggcaggacgcauaggcucauuacugcagagcucugagagggaguagcagccgauggaccgggagaggagacaagugugcuaaggacacugaaugggugguggguaugucacugucacucugguagccccuggcuuagcccaaggcaccagggaaccuggacgugggcuccaaggcaaugacagagagagcuccaggagauaccuucuagcucuggcuugaggagugaaaaggggguucccagugcucugagaagaugaggaagucuccaauuuuauuuauucuuuuucgucuauuauuuugaacucagucccaggcaauucugcuaccguggcuaugcaggaauggcaguggcagaaaugucugcugccgcagacuccaagggagcuagacccuccuuuccaacagagccuguggugcucugucuucuauucugcccccacuuggcgcuggaugcaggagaagggcaggaaauaugggaagaagaaggugacacacuccagcuuuccugccagaagacugaaaaggggauucuuggggaaccagaggcgcuggaaaaauuguaaagagaagcuuggcuaacugaccccauaauguuguuaaugaauuccugggcucacccauaacaaagccuuugagaggcaaacucugcaacagacugccacccaaguuccaaggugaccucuggagggcaaaaaugcaagacuaggucuuauaaacacaucugccuuugaaaccaacacccagagcucacagcccaaaccccacaggguugaucaccugcuuaaaaaaaauccacauucuccauagaaauuaaaaauggccagugucauaacauaauauucgaaaugcccaugauacaauccaaaacuucuuagcauacaaagaaccaggaaaaucuuaacucuguggaaaaagacaauccacagaagccaaugucaagaugacacagauacugacauuaucgacaaagaaagacgaaaacagccauuauccaaaaguuccaagaaguaagauugaacaugcuggaaaugaacagagagacagacagucuuggccaaaaagaaggaagauauuucagagaaccaaauagaaauuugugacagaaauacauuaacugaaauaaaaagcucacuggauucuaaaucaucuauguagauacucugcccucaaggagaaaacuauaacuccacacuccuuaacugugagcugugcacagugacuuccuucggaagaauucaguaugggaagaggcaaagaguacagugacugaaaggucaaccccaacagugacaugguguugacagcauguacccuugauaggauaugaugaaaauggcacuugaccucuguggcuguccucccuaaaacccuuagcuccacuuuagugauaagaaaaacaucagacaaaucccaauauaagggcauucuacaaaauaccuggccagcacucuucaaaauggucaaaaugauuaaaaauaaagaaaguuuaccgaagugucacagccaagaagaguguaaggaggcaugaugacaaaauguaauguaguguucuggaugggaucccagaacaaaaaaaggacacuagguaaaaacuaaggcaauguaugaacuucagaaaguaaugauguaucaacauuggcuccuuaaugugauaaauguacuaggcuaauguaagaucaguaacaauaaauuauguauggcauacaugagaaauaagucuguacuauccucacaguuuuucucuaaauuugaaacaauucuauauauaaaguuuauuuuugaaaacucucuggaugggcccaaugggagaauagacacgaccaaggaaagagucagugaagauccgcuuucacuuaaugaauaguaaauauauuuucucuuccuuaagauuuucuugauaacauuuucuuuucucuagcuuacuuuauuguaagaauacagcauauaauacauacaauauacagaauaggugguaauugacuauuuguuaucaguaaggcuucuggucaacaguaggcuaugaauagucaaguuuuuggagagucaaaaguuauauguggauuuuugacuacauggagggauugguaucccuaaccccuacguguucaagggucaacuguacuauaaacugauggaaaauaaaaauuuaaaaauacuacuuacaaaaccuacaaaaaauguuguacagauggucccugacuuacaaugguucaauuuacaaauuuucaacuuuuggaugggucuuuugggguauuaaauacauuuucaacuuaugauuuuuuugaccuaugauagguuuauugggacauaaccccaucauaaguugaggagcaucagugcuuggguauguaucuaacaaaacauguauaugauguguaugcugaaaacuauaaaaugcugauaaaagaaauaaaagaagaccuaaaaaauguagagauauaccauguuuacagaguggaagaucaacauaauaaaaauaucaaugcuucccaaauugauuuauaaauuuaacaaaauucaaauaaaagcuccagcaggaauuucugaacagaaaaauuaauuuaaaauucauauacgaaggcaacaaauaagaagacuagccaaaacaauuuugaaauagaauaaaguuggaggaauaacacuaccaauuuuuaagacuuauaaaaaacuacaguaaucaaacuacuacaaugaaucaauacacgucguauuggugaagggauagacaaacaaaugaauggaacagaacagaaagucuagaaacagacccacacaaauguaacuaacugauuuuugacaaagacgcuuucaaccaaaagaagacgcuuucaacaaauggcacuggaggaacugggcagccacauguggaaagaugaagucuaaccuaacccucacaccuuucaugaaaugugacccaaaauggacuguaucuauagauaagauguuaacguguaaugcuuuuagaauaaaacacaggagaaaauauucauaauuaggcacaucuuagacaugacaccaaaugcaugauacauaaaauuuaaaaaaaaugaccaaucagaccaggcacaguggcucaagucuauaaucucagcacuuugagaggccgaggcaggacaaucacuugaguucaggauuuugacaccagccugggcaacgcuggggcaucccaucucuuaaaaaaauaaaaaauuagccagguaugcuugugcgcuccuguggucccagguacuagggaugcugaggcaggaggaucccuugagccugggagguugaggcuguaaugaguugcgauggcaccacugcacuccagccuggauaacagagugagaccucaucuccaaaaagauaaaauaauaaaauaaaaauuuaacaagaauaaaaauuuaucaaaacuaaaagcuuuugugaaagacaauauuaaaaaauaaagaagauagggaugaaauauaugcaaaucacauagcccacaaaggacuuacauacagaaaacauaaagaauucucaaaacugaacauuaagaaaacaacucaauuagaaaauggaaaaauacuugacaauucauccaagaggauauuugaauggaaaauaagcacauggaaagauguucaacuucauuagacacuagugaaaugcaaauuaaaaccauaacaagauaccacuacacacccauuagaggggcuagcagaaaaaaaaucaaugacaaugcgaagugcuggaaaagacacugagcaaaguaauacagcacuuugaaaagcaggcuggugucuggcagcuucuuauaaacuuagacacauucacaucuaaccuagguauuuaaagaaaugaaaacauguucacacaaaaaccuguauacacacauuuauagaagugcuguuuaugauugucaacaaccagaaacaacuaaaauguucuucacugauugaauggauaugcaaaaucugguguuaguggauauuacucagcaucaaggagaaauauacuacugguucaugcaacagcucaggugaaucucaaaaguguuaugcugagugacagaagccaggcucugaaaguuacacacuggaguauucuguuuacuugacaucuggaaaagacaaaacuguaguucuggagaacagauugguggcuuccagagguuagaaaaggagggaaguuacaauugcacggggguagcauggcagacuuucuggggaugauggaacucuccuggaccguggauagggugguguauauacauauacagaucuaugcacguguuaaaauucauguaaguguauaaccaaaaaaagagccaauuuuacuauaugcuaauuauagauaaauaaauaaaagcaaugaccaggucaucaggucaaccuuuaguauaaauucgcaaacuuucuuggagaaagaggucacuuaaaaaaaaaaaaggcccuggugaaggcacaggcucugaagcagggugaccuugcauagaugugagaggaagggggugccccggccagcguggcugugaagaaaggacugggaauggugggaaucuggaucauagaauccaauggaacaaggugcgagggucacaauggcgucuguacaauguggacaacggggcuugaaaggcagccuuuccuacgcuuacagauggagugagagguccuagaggccaggagaugagugggggcugcugcaauaacucacagagcaggaaugcucccaccaaggccaucucagaaagggggacucccaagcgacaaagucccaagguccugauagcugauggugcagguguggaccuaagaggggcugggguggggagucugagugugagccccagagaggcugugguggcuuuggccacacuggggaggagcagaucagccacagcaagacaguucccugcuccauucaagaagccugaaagccggcgcaagaaguuuugagugggaacuucugcgaggacucagagcccagaccagggcaguauaugaaguagcuacucgccacagacuuggggauuuaaacagacaaauccaacuggauaaagaaguccucagugccugcaaugauccugagguggucagugcuaaauggaccacugcccuggcuccacuguggaagcacaggggaccucacgagaaaguucuuugaugacuuggacaguaugucaggagaaaccaggcugaacuuuguaucaauaaagcccagacaugcauuccuuugguacuaagaaauuccagcaaacuuuaccucuuccaaggcaauaacaugcacauccuaaacccgaaugcggagggugagguccuucuaacagcagcugccaggaaugugagugucugccaagggggccacgauaaacauggaccaccccaggggaaggaagcggagccacuugaaacccaccuaccugggagguggcauucagggugaugaccuccucgucgugguccagcaguuugcaggcauaugcaauguugacagcuguuucuuguuugucaccagugagaacccaaaucugcaggcccgcuugacgcaauuuagaaauaguuucagggacuccguccugcaggcggucuucaaucccaguggcaccuggucaaaugcacagcagugugagcgaacccgcuucucacgugccccccaauccuucuggggugcaaaugucaugcaccagauacaccgaaggcaggcacugguacagccccuguugccugggccuugccaggggcugggcugccaguugucugccauguagugacaggaaguccccuguggaaccauuucaggacagugguggacgcuuuugacagcucugucgaugugacucagucgagugcguaggaauaacugugagucacugagcauaauuauguguacuuacaccaaaguaccucaacuucuuucuaacuuguaacuuuacagauaaccugaaggcaaagcguaugggaagguguugggaaugacgauauucggagggauaaaaauauagucuuaaaaauugcccaucccauagaaagcuucuggugaaugaaauucagaauguccagucucaacaaugcuuauuacuagucacuauagaaacagacuucacagguaaggccauuauuucuugaaaccaagauuauccuaaauaugcuuuuuccacaaacauaaagaaguugagaggcagguuuugccuuuuuggucucaguauguugggaaaaaucuacuauugacugcggaaaugugcuuaggccugccucagauuuuuuuuuuuuuuuuuaagaucuguuuacaucuuggugagaugguuucugucuuccccacucuggaagugagcugcagcccuggucccuagguucgagcccugacugaggcuccuuuacugcgcuacaccaugcugugcccugugcugggaugcugcuauggacugagcguuugugucccccagauccauaggagggagcacuaauccccagugugguaguauuaggauguggggccugcaggagguaauuaaguucagaugaggucaugaggauggggcucccucgaugggaucaguguccuuauaaaaagaggcacuggggucgggcgcgguggcucacgccuguaaucccagcacuucgggaggccguggcgggcgggucacuugaggucaggaguuccagaccaaccuggucaauguggugaaacccuguuucuacuaaaaauacaaaaauuaccugggcgugguagugggugccuguaaucccagcugcucgggagguugaggcagaauugcuugaacccaggagguggagguugcagugagcugagaucaugccacugcacuccagccugggugacagagcgagacucugucucaagaaauaaauaaauaaauaggcauuggaaaggugauuucucaaucuccccauugugugagaacacugcaaggaggcagccaucugcaaaccaggaggagaucccacaccagacauugugagcuguuagagccuugaucuuggacuuuuagccuucaaaacucuaagaaguaaaugucuguggcuuaaguccccagucugugguauugugugacagcagaacaaacgaacuaagccacccuuaccccuucuucuagaaugaugggauggcaggcauggggaggggaagguagaacugagguacaguaaacacacaaguguacauuucuuaaauauuccuuugauacacuuucacaagucacauaccagugucaccagcccugaacuuagggggcagaacaucaccagcaccccagaagacccccucaggggcaaguggcugaucugcugucuuccagcucagguagccugggccuagcucccaugucggggauguacuggaaggugaugugggaacuuggggagggcccagaaaggaggagggaacauugcacccaugcugcacacugcucugaaccuuauaaccugaguacccugggaagaccacacagcguguggagcuuaagaccugcucaggaagaaagccaggucacgcucugugcuccccgugagcacauccccagccacccgggcaccgggagggcaucugaccuuagcuuugcuccucuacccuggcccuugggcucuaguaggggggcagacuguguguggcccgugucccuggcucauccugagugucacuuguacuaugacagguuccuugaugucuggggaagacagggauggucuugccuuccucuguguguucauaguaauucauucauacuuaaugauaguaauaaugauuauagaguaagacuaauaauggcuaaccuugauggauuacugacaauuugccaggauaacgcuuccacuacagugcuugaaacauaacccaagcaguugcccacucuucucuaaauggcaacuuccugccucaaggaccuugugccucccaccuuuguauccgagcugcugagcuaaagucccucagucaaaugucugccaagaaagaaagcagggaaggccuugccggaaacuccaguacggagggugucugcuguuucacagggaaaaguuaacaccuugaaaacagaaccuccuuaguucaggagcuauuuggucaaacucaugggccucccacugggucaccccaccaacacucaccuuuauaaggugugagccugagucaggugcagaauagcauugaacugaaaaaggaguuaugggagggacccccaccucggcaugaaacauggcagaggaaagaguaccugcaggcagcagccuuucaagaugauuuggggcacagcggcuuucuucagcuuuccaagguacuuguuugugauauaauuuaugugacucugaguaaaugccacugucuuuacgaccugacccucuggaaggccuggcauuucugaguaucauaacucaggaguugguggugugcagagcccagcgucacugugcuuggugccacacagcuuugaaugggaggggaaaggauuucaccaacgaggaaguuuuagacauuuagagaaacuagcaaggacgccggggaaaaugagcaagaguauccuuugaauuuagguuccugcccagagcauuaaggaaaagaaaauuucaagagcauggagagaacggagauccuuucugcugaagauaguuauguaugguucucugaugcuauuuaagauaagcaccugggccuggugcaggggcacacgccuguaaucccagcacuuagacagacugaggcaggaggaucacguuaaaccaggaguuugagacaagccugagugagacccugucucuaccaaaaaaaaguaaaaauuuaucugggccugguggcacacgccuguggucccagcuacucaggaggcugaggcgggaggaucacuagagcccagaaauuugagcucacaaugugcugugaucgcaccauugcacuccagcccaggugacagagugagacucugucucaaagcaaaaaaaaaaaaacaaaaaaaaaaaacaaaaaaaaucaccuucaugaaaagauuuggcuuuggaauaguaaaaauauaaguggcuggcuucacuuuucuuaaugaagcugaggagcuggaacacagugcccgcguuugagccaugugaacgcuaaggugguggguggcucccauacucuccagcucaggccucgucauuugaaacauaaacauaucagguagcaggagaugguaagugguuaacaaccggucugugggaggaaggucgauuuacugcauuugcucauuucugugguauaaauacucccaccuuggcugacuucaaucuacuaacauagcaucaaaaggcgacgugagauuccugaacauuuaugugggcuacugcaaaauucuucaaaauguauccaugagcucugccaggaggcgugagcaggcuccagugcacggcuggcacccaugugggcaacccaggaguuccaucgcugacacaucucagagccauccucacgugcaccuggagggaaggaauccaccugaggaugacagcgggaugugguggaaucaguuuggagaaacgcugaugaccgggaucccgacuccaaucagaggaaguggaacaggggaucgguagacaacucugauuuuagaucuucacacaguugcccaaguaaaaauuauagaauccaagcaaggaaucccugugaaaaaggccuaagaagaugacuggaacucaaguuaaccaugagccucgggugccgcaggggccguuaacaacuuaggauauguuaacagagcugcagcauccgggccaagagaggugaccgaugcacgaucaccagagaaagccugcagaggagaggccagcuggguggaaacgguguggaagcaccaaccaggagacucaccacacaaccgcucagugccaggcccugugccugcgccacgcucagugccccccgucaucccuuccuuucacccucacaagagcccaaaacacugggauuaccacagagcggaacuuggaugcaaaaaggauugagccacuugccccaggcuguccgaucagccugcaugaccagcccgcaugaccagcuugcaguggcagagcagggcuggacaacugagucagggcuccugggcucugagagcagggaagauggagaaggggcagccugggacucacagccauguccccaaauagucaagguuucaucauguggaaaagggaggagauucugucugcauuacuccagggggcggaaccagcaagcacugugaaauggcaccggagggccaauuucacuccauuugagaaguuagugcuguccaggggaaaagcugcucccuggggaaggugccccacagugaaggguuaaaaacaagccuggucaaugaggcugggcgggcacgucugggacaaccagcagaugccuccuaccccacaggccugcacaauacugucuuccggggaagcccaaucaguccagacgacagcagcccugcuuuaguaagccaaaacuucagggccuaaaacaggcacagccauuucucagguguuccauuuaauucacauccagggcugccacucauggugccacugggccccuggaucccggggcuuuccaaguaauguguggccuccuauaagauucugugggcaaacaauauauaaaaugugugcagauauauguuaugccuaguguacauuaugcuauuaaaugcaaaccuuaacuauguauuauacuagaaauguagauguaaauauauagcuaucccaacuccucugcccagaaaaagagggcaagugaacaccgccuuuuuguguuaagugaagaugaccugcccagggcuuugugcucgagaaguaccaccugacucacagcacccgagauggagguggggguggaccauccucaacaccagcucuucaaggacacacagagcauguauacaaugacuuggcuauuuaaugaaugcuuuaauaaauaggaaaauaaauauuuuaaguauuaaaguaagcauuaacauaauaaauaccuucauuuaucacuaauacuaguuagcauuuauuaaguaccaagaugaacacagcuggaaauguggacauauuucaguaaaaaugagcccauuuucuuuucauucaccucgaaucugugaaacauuccuaagaugcaaaaugcagcaguuucugggucccaaaaguuucccuguuucccgaggggaaaauccuuucaacucccaacugucagaaaucucacuccuuggcucuauuuuuggugggaaaccagguuaaggggaagcguggcagcugcugucuuggggugccuggggggcagcacgugcaccucacagaaaugagacuaggagaagauucaggcaagcacccucccgccucggcugugccagcguccugccagguggcucccuaaccaaggccagccugcggagcagccgcugacaagagcacucaccccuccagggccgucccugcaaacuccacacugcccuuaggcaugcgacucucaaguuaauuaccuaacaagugcagguuggucuccaggcgaauggcagacuggaagaggagcuccucgcuguuuuccagggaggauucggcuucuagguggcuuugcaaccagcaggcauacucuucuuuacucagaaccuaugggagauacauuguugagugcugcaccgggcgcugcucacuguggggcggccaccugcacgugcacccucgcggagacacccccacucacucucuuggcgaugcacaaggugcgcaggccuuccgccgcauacacguugagguaauucugaguuuugcuccgaaucuuuuuuugaugccucccucuggcgucaacuagguuggagaauaagcagaaacauggguaagaacuggcgccuguggaauggucuucagacacuccgagauuuaccccacgucuguucguuacuugcgaauagagcacaaauuuucauauagaauucaaagcaaaaaugagcuguuauguuuuaaaaaagagucucaucaauauguuugacuguuuuauuuuauuuuuuuauagagacaggguuuugccacguugcccaggcuggucacgaacuccuggacucaaaucauccacccgccucggccuccgaaaguacugggauuacagaugugagccacugcgcccugcugauguuuggcuguuuuuaacauccuuuguugaaauaagcucaugaaaauaaaaacuacaucaaaagucauuuggcauccuuuugcccagccuauuaaauggaggcucacguucuuccuguuaaugaaaauucuuacuuaaugggaagugcacuuucuauccucagaagaguaggauccuuacaaguagcauugccagauacaacaaacgaugucuaaauauggcauaggacauacuuuuacuuaaaaaaggauuuguuugucugaaauucaaguuuaacuggacauucuauauauacaguuugugaaaucuggcaacacuacugaccagucaugaggcccguggcccaggaaggauuaucuacuaaucuaaguccaccaccugaaagaggacccgguaagagacccuuuuacaugccugaccgugcugcauucuccacaggggugacagagcccucaagggagugaucacugguucuuggagguggaaaaaucuuacucuuuucuaaacaaagucuaaguacacauauagaacauaaacagauacacagcauaucuauguuauuaaaaggccaggaggggacaauugaaaaagaagucagaaaagacucuuuauggaguugauaauggggaagaaaaacaguugcccuagaauccuuugcuuuagguauuuacauuucccgaaaggaugaugcucaaacucaucuuuguauuccugguaucgugguaacacucuuagaagaugcagauaaccuuuucccagaaucagauuguuccucgagcaaagccgugccuaacugagggguuuuggaauugaaauacucuugauaaagcugucccauuguccugagaggugacauguggcgugcacugggacgugcggugguaccgggugugacacugagauuaaccacucuccaaaacaaaaugaaccgagcccagggagggaggaugggccacucgggacccugggugccccagacgaggagacggccccacaggugucugcuucucagguggacaaugggguguuucuuugcagggccaucugcacagagccuagugacagggagcaccuggcccugccaggcagaaguggcugagcccguuguccucuccugcagacauggacacacaccugugccccuucuggcgagaucugccccucguucuugggugacuuuucccuuacauguccugccgcaccuaccacugggcagucacugcggaauaccgaggcugggcuuuggaggguggggcccuuguggaggcuggaaucggucuacacucugaugggggguaggagaggaugggaagaacucaagcuccaaggagaccaucaccgaggagcugggggaaccuccgaaggagaauguacuggggaacagaguguggaucccuagaggcauucagucagcccugcucuucuccacuugcugaagugaugcuggggguggcugauuucgagcugaaggcauggcaauuuucacacugcauuuuaggcaacggucaugcaauauuagccccuucuuucugauguuccacagccacccaaguccugugugucuugucucccuauggugacaggaggaauucugugccuggaacucagcuccucgggugaggagugacaccaccugagggagugggaccagugcugcccggcgcccccugcugggcagggacagucgagagcucugugcugcaggacgcugaggcugcaucugggucggggcaggagcaggaggcuaaggggcacagcuccaggugcagucugcgaagaugacuccagugcccacugaccccagacacagcagggccgagacagcugcaccugacagugggcugcaccugauguucccaccaggagacagcuggcgaguggugcuugcagacccacagagaggcccucagagggaugaggguagccucucuucaugauuuuaccacgugcuuuaaaauugcuccaagugauauuuccauuucuucuaagcuuuacaagcgauauuuccccaauaaggaguuaucuuauuaaaauggcaaacuaacgugcagucccugcuuguacaugcauguacucaucaugcaaaaaacauauacugauuacugcaugguaucaaugugugaggcccacgcuaggcagugggcuacggccaucucucuguccuugcucugggagaaggcagaguggccugagguuuacaccuuaaagaccacuccaaguagcaacgccaccaaagcauaagcaaguggaucuuaacaagaaggagccagagacuugggaaagguaccgaguggacgcuggacaucaauguaacagcaggcacugagcuaggggcucauguggggacuucccgugagaggcaggcacugugauuuccuuuguagaugggaaacugaggcacagagugagugacucguccagggucaucccagccguaaguguagaccugggauuugaacagagaucugugagaauggguugggguggagucccugcuuguugccugacaccacaccugccagggcaggugagccauggccccauccugcugauaucauacagucacauccacuaucugcucagccaacucgggccucuucuggugaaaguguuucgagcccucugaagagggcaucagauuaagucuggagugggacaccucugugcccuccucaguuugucaccuacacacagguaguaaguugauuuacacaggcagagcgauucccaggcacagugagcccucugcaaugagucugcaccuauccacaccccuccaccgcuccccaaguaaaaggcgaaugaucugugcauaagggcaggcggucacagguggguaacuucgaggggacuccagggcccuccuguagucguucucuugggaaacugcuggggucucugaacuuccugaaccuuaaccugcccaguguugacacguagaucuucccuauccaaagcugacuucaugcacugcuuggaaauucccagaggaaggcggagaucaacacaagcccuugauuaacuuuuccuaucaaugucaugguuuugauaaggugagaguugagacaaugucauuaccuggcccuuccaugaugccauggauuugagguucuuuuucuuaucugcaguuaccugguuaugggaagcucccuuccugagacccagagcaaagccacgcugacgaugccaggucugagaggcuccccggccugggcaggggcuccccuaccccgacugugaguuugauuuugagucggaggagagcauuguggauugucuuguaaccggcaucaggugccuucccaacuugcagacaaacgaggaaaucccuggcucacucaggggccucuggaggccaggccaccacuguuccuuuugccauggcccucggcaccugcuagugaacaggcaggggggcccugccucuugauaaugcucuauccacucugggaagguaccagaaaagcaggaguaggagagugagcaggucgugacgcuaaauucauucaauugaaaggcauccaguuuucuggguuauccuugguaauuuuuugggggggacgggguggagugugaaaugugguccuucuuuuaugaaauaauggcugaugguauuagugagacuuagugacagcaguucuuuuuguguguguucugcuuuugagguuuuuacucauguaaaaaaauauguugccagcaaagacaagcccggcaagugcugcggccuuccuugcacagcucacagggcucccugcucuacaggacuggacaggccucgccugccagcgcugggcagcccccacaugccagggccacuccaugccuuccccuuagacaucacccgucaugcugugaaaucugaagcccaggaccccuuauguugucuugaacccaaggcuguggaauaagagagauuuuuuuuugcuguagaaugaaaucacucagauaauugcccuauuuauguuuuucuuuuguguggauguaaacaagaaucgauuuucagaagaagcuuccuagaacucaaacuguguccaugaauuggauucuuugcugacuccaaggcagagccacugcagugggagaaagggaagaucucgccccgcgguggucaucaucauggaaggucauccaaacuccucucagagacacauuugcagauuuagcucagcugccuuuuggaggucacagcucugugauggggacauggauuuccuguaugaagcucuuccucccauccaauucuccaucaugagugguccugggcuucugugccagggguccucuccugaggcacugagaugcuggcaagaaaggccagugggagguaaaguacucccuagcuccaacucggagcuccagaagggagcaaccggcuuauagcauuucccagcagcugcugcccagagguacuuccaaggugcagcaaauaggaagcccguggcaggcaguagagccucagcagggccccuaggcuccugcagcauccucaccuccacccaguucaguucccuggaggugaggcugcacuccuccguccucugagcacagagggagagguggguggccagguucccuuuaugaggggggcucggcccuuccccucccaagugccagaacagagggcagugggggaggccagcaucccuuacuuccugggcccccacuguggcccaaggcagccccauaaacuguggccuggaucucucugcugcaccagguccacagggcaggaagaacuuucuagagcuacuagucuagauucucaaccuucauuguucaaauuuaaaacgugacacucuucaaguauccucugaccccccaguucuuggaggugggggugugcaggcauggaaguccccugaauacuuccuaguccaaacccuucaaacaggcaaacacugaucugaagaaaccaugcaauucuccaaugggcauuucuguuggaaaaggauuaaugaaaaucacuuuacucaagagaaggaauuggguggggauauuucucaggaccuccucccccgagcuggggugcagcugggcaggggugggaguaccugaagagcagggcugcaggagauccaugaccacugagucggcccccuugguguagacguugaucucaucgguaagcgggugccggaucaccacugacauccucuugcggacggaaucgaaacccagugugugcaggagcucgaaggugagccugcccagguggggcagcuccacugacacuuggucgugcagccgcuccacaagcacgcaguuguaggcucuggccgcauacaccagugcggccucauccgggcucuccgccucguaccgcagcucgcgcucugacuccugcuccugagcaagcuccgaggcccaguuguccgccuggcugcuguagccguugcuggcgauggccgaggugggcuggcccagccucuccuccagccugagaagcaugccgucgcuggacgggguggacgggaagcuggagcccaacuuguggcuggacuuguuggcggccaggcucccgaugcugcugcagccugaggucaggcagcugggugugaaccuccgcaggaagucuucuaucgucuucaccggggacuucagcucaaaccucacccucaccugcaagagaaauggucagaaggcaggugagggaacugcuaugucccccagaggccccacccugguucccacaggaugcuccaggcacuuggaggaacaaugaccucgcuuccccacuggggucucagagcacagauuucccauuucccagauuucaggcaugcauugaaauugcaagcagaauagugucgcaauaaacauguugugcacauguaucauaaaacuucuuaaaguauaauaauaauaauaaaaaaagaaauugcaagcagagacaguacuccuuccuugagaucguccgcuggccucuuccacuucucuuaaacaaagguuaugcaagauucuuucagaacgugauugccgagggcccaucagugaggccuggauguaugcaggggaguugcagcugguggcaucugcaggcuucuuuuggggcugucccugcacuacaguguccccuugcuuugcaaaaaaacagcucaggggagcaggcucaccauugccuggcacaaaacugggcauuuuuuuuccaauuaaaaagucacuuaacaaaccaucaguuuauacuuccuuugaauuaugucuauaaaaauuuaauauacaaaucacauuuccaguccccaaauaauccuucuaagcgcauuaaauacacugacaaauugaggaucccaaacauugaaacaauauuuuaaccaccacaguaagaaacaaaaugaaugacacauauacacacacacacacacacacacacacacacacacacaauuguuaaaguuucaaaaagcucaaugauagggcaacagagccacgcuuuuuucuugcucuuuauugaaagagcaaaugucaaaacaaccaaaauacugaauuagcaauucuuaaaacugcaauuuuaccauugcauccuaaguugugaauuacaguaacagccuccagaaaaaucagguguuugguaaagcaaggugcauagagccagauuuugauacaggugcuuuuccuuuggucuuguuaugacuuuaaauacgcuacauagccagcugggagacauaggcaccugcacagcaaucccugcuggcuccaaauguccucgaagguggcgcucaccaaccaauaugugggaauagaaaugcacccagagacaucuucaccugcagccugagugugggugauugauaggcuguucccuagguggaacucaagccguguaaccuucagcacaagccucaaugacgcugccaucucucacccuucauuuaacaucugucagucagggucuagcccagaaaaggggcacuuccugcagggauauacaccagaaggguuuuuaaugcugggggcagagcccagaggccagaugggagaugcugaggcagccaggagaugaacugcagcuucgggaagcagcuccagcccagggcugccggccuaagccucaagccugcuggucucugaguggcaggccuguccacuugggagucacuggguccagguacugccagacaugcugcugcagcagagaaaauacaggccaccuuguucaccccacaucgccugcggagggaccugcuggaagggcagacccaggaggcugggaagggauccugggagagucgggggcugggaggucuaugacacacaccuaccccauucaacauucaaaacugccugguuccauaugcauaucacgcuuccgugcccccuacacugccuagcccacuguagggcuuucuggggugcacugggugauagaggagcuuucacacgugcaaccuuuccucucucaggagaaaaccuuaaugucagacugaaccaaaaccaauuugagcauugcuauauuuccaguguccuaaguagccucugaucgauucucgaccgcuuuucauugaagaacaaucuucgaugccccauaaauccuccccauggccccacggcccaggcgggcaccccaggcacagggaggaggccaaugugucuccagcugcauggcugguagagucaggguccaugugcaagcuccucgucccagaagcugggcccccggccugucuuguccucucuccuguguggaucugggacccugaggcucggggagguuguccuggguagccucccucuggcccugccccaggccaggcagcgaaggaaggacccaggcaggcagggccuccacacacccaccugccuaccugaggcuggccuaucuggcugcccugugucccuccccucccaggcucagaagucaucucuggugggcugcccccucccacuuggccccaaucauagccccugcccacuauagccuggggccaacgcugcagaaccacaagcacuguuuugcccaguaugaagcaccccaccgcaucccccuuaggucacgaugugccaagagcgcuugcugcaggaaagggaagggcgccugcccucaggaggacugacaaccauggcccgcagcgcagaaggucaaggucaagcucagggacccuccagaacuugccuuuguucguggcugauccggggacgugacgacgacuguguugcagauggugagugcgaugaagaaaucaaagacgucagacagcucaggcgagaggugggccagcaggugcuccugaugccucgccacggcuaggcucuugucacacucacucaccuucuccagcagcuuugggucgggcgugauauccuucuccugggagaaagggaggcuggcagugagucccacccaguagccugccgaggaucuuggggcgugacuauuuaagguacuuugauuuuauuauaagcuguaaacagaacuucaucucucauauacauauaugucauuuuauaauuguaaauuacuuacaauuuuaauugcacaaaauauacagagcuucuauccacuuugugaaaaccaugcuucagcauugcccucuagucuuuucgcucuacauuuaaauuucacauaaucaaaauauuuuauauacauauuggugguuuccauuuucuccaaaacauuauuaauugucugaacuuuuccaggcuuuuaagaauuauuuaaaaacacauuuuaacaacuugaaaauggauaugucaucauuuauuugaccaucccuuuaucacuggauauuuaaauuucuuucaguuuugcugauguaaauuacacauugauaaacuuccauauguagcaauccuuggcugaaucgcuaaauugcuagacgagaaaguuugaauacuuuaaauacucuugacucauacugaaaaaugcugucaggaaaccuuguuccagugcagccucccuccugccaagcgugagagcccccacucccaggggcccuguagaaacccaccaaucagcguccaaaacucgaaaucagcccuauuuagauggcagcuucucuguggguuuagaagcacaugagagaaugaggccaccacagaguaagcaagggggauucauccccucugcugcauugguaaaacauuucagaagugaaaggcucuuucagagguuauugcucacuucucgccucuccgugcuggaugauggugguccauuaaugucugggcggcugacaaggccaggcagaaaguauuuuauggauuugggcucgucuaauuaaaacucccuugggagggguuggcuuugcuuuuuagcgguugucaucuuguccugagguuuuauuugcuucauuuggcagcacgggcuuccucuuugucacccuuucugggugacuugccagcaaucaaccagccuuagaagccaugcaaaggggccaugucagugucuuggaaaagacgacaguggagagaaaguguuggccagaaaagcuucugcugaguagagccaagccgcccagcgacaguguauuuguaggauuaaauauagacaccuuccaugagcgggggauggugaaaauggggaagagacguggcagcacccuagcaggaggcccuguacacucaccauggggcugcugaaggccgugugcuuggacagcaugcuggcccucuuggccucggcccggcugcccgugcgccggugggacuuggugcucuggguucugugcaccacccggacacucugguggcugccgaugcugccgcgcugggacaccgagcccccucugggcaccaccuccuccuccuccgagucugccucuugguaccuggccagacgcugcgcugcggggagagggcgcagggugaggcaucaugggggaaggcugggcggagcagaaagaaaccauucaguguguuuuagguuccgcgaggcuuccggcagggcagccccacaggauucaccacccuugcucucuaauagcaaggcacggagaacauccucagucagcugcaaccuggggagguugauauucucaacucuguuucacagagacugacuuucaucucagagaacguaaggagcuuucuaaggucgcacaacuuaggggaaggggaacggguugacguccagccggucucuucagguagagccuagguguacaugggguaggguggcagguggccgggagagggaggcaggacagaggguggcaggccuuccagucaugcugggaugacggugcucaccuggugcugagcuccuugcccacauggacgguggccaccaucugcuccugucuggaugaaaugcuauggcacaggggggcucacacucccagauugcacagcuuggaccccuacagcuaggguuuggacucagcuuugaaacuccauccaagaugaucuugacugugauguugcccugcugagcaaauuccccaugaccuggugaacgcugggcaaauccccuuuagaggugccugcgcuguggcuucuugcuaacccauggcucugaaccaguuuucuggguuuugcccagggaggacagcuuguuucaccguggaugagcaaaauggagaccauucaugaggauuacuuaucagaacaaccguuuaaucagaacuucaagcacaggcauggugcugagucaaagcagcaggggccugucaagaggccggagaaggagauacuuauggagccggccagccgcguggaccacugcgcaucucuuaauagacccucugugagagaugagaaaaauggggauaaaaaaggggaagucaccugcccaccaucacaaggcugaguacuugccaaugccaggauuccaacucagggagauccuaauuccaggagcagaugccccgcaaaugccuccccagcucucggguggcaucagcccagugcaccggaagcaaggacgcacagaaccuggacacaugacucuguccagcaugaggugaggggcugggcuucagcugccaagaaaguggacuggcccaucccacccucccccagcaguggucccgcacauccggagcuccauggagccauccuucagggcccccuccuucccucagaggcugugggggccacggcugguauguugguguucugaagcaguuucugaucggcaguggccccugggaugccuuccauguccccaggaaagaugaggcccaggagcagguaaugcccccuccugggcaugcacagccagcuagcuccaggucaucuugccaagcugucagagggggcacacccaaggcuuccacagccgguucugguacgugagcagggcuuggggcucagaguccaucugaacuccuuuaugagugacaucuggagaggucagaucauaagauaacuggcugaugacgcuccuugccugggugccugucaauagcuagcugauccaggcacuucucuaaaacacgcugcugagauguaugugguuucauucaucaccaggaagcucccugugucuugaggcaaggaaacccucugguuuuaugguagcauuuggcaacugucagaaucuuucuguaaucuuaguugggauccugccccugggagccuaagcuuccaacuuuauuauuaucuuuuaaauguauuauuauuauuaauggauaaaucaguacuguauacauucauggggugcaaugugauguucugauguauguguacaauguggcaugauuaaaucaugcuaauuaacaaaucugucacuuugcuugccuaucauguuuuuaugaugagacaguuaaaauuuacucucugagucguuuugaaauguguaauacauuuuuauugccucuggucaccuggcugugcaacagaucucaaaaccuauuccucgugucuaucugaaacugggucucggcuuuaagggcugcuguagaaccgacugcccgggucucugauccccucaggacucugcugaguucuguuuuugagaagagcacaaugcacugugcuguaccagguuuagcaacuaugggaggggaaggggaggaaggagggagaggagaggaggguaggagaagggaaaaagagaggagagggaggccgaaggaggcuggugggagggaggaugggugaguggauggaguacugucaugauuaucuauuuuggguggcaaauaaaacuuuaaacaaaguggguaauuuccucugccuucuguuuacuaugacugcuuucauuuuguguugaggaagacuguggcuaucaugauaauccuugguuuuauaaaucucacaaaagugucaaguaaacaacagaugcuucccaccaaauccuucuaaagagcagcuuccuagucaugcccgcuugcguucccucuguccgguuuuaauuugcuguuucuguagcauggacucuguuucugucacaggcaggaaauggaccccaggcugcagugcagggugcccacucccagggcgcugcagccccaggcacagugguggcggggacccugguccaugcccucuccugacugggguggggcgcuggcugcagucacacccugggauucagaagcuggugucuccccagagacaccagguuggaaggaggcagccacagauaaggaagggagaggugggaguggggaccgcuucaauaauugggagugaggcgauucaucuuucuaguucccaggaacacuguuccagggaagagaacgaaacaugaauuagccagugcccuucugaggauuuuaugacuagaaaauggauggaugacaacagagacaucucucugucccuugguguggcagagcaaggggaccggaugccuugggagugagcuccuugcggguggcuugccugauugcuuaggcggaugccuggcaccccagacacugcaggaacagggcgggcggccgugccagugccuguucuauaaauagcaccgggcuucaggcaccugagcugcugugacagccacgucuuuauacucccuugaaaaucaguaaucccugaagcgugugugugugugugugugugugugugugugugugugugugucuccaaacaauucuggauagggcagcuuucugguucagccuggguugggagccccgcacccccagacucaccauuugcaucaugagaauauucuacaccagacacagugcaucuucggaaaaccaucuuauucucugucaaagugccaguuuuaucugagaaaauguacuguaucuguccuaagucuuccgugauguucagagcucggcacugcagcugcgagucuguuucuucgucauacaacugcauguccugguuaaugaaguacacuuggcaugcuuuaacaauuucaauggaaacguauaaggaaauugggaucaaaaccuggaagagacaaggcacacaggaugaaugaccgugaggaccagggagcuggggaauuacucaaaucuauuuaaauaacaaaugacuacaaccgcaagaaaguagggacuauacuguaccuuuaagagagcuuaaauagguugguuuagagucaguauuggaaaaguauuagaguauuggcaaagagaauaaacuaggacagcuuauggagcagcugcagggcggggauccacuauggugucuggaaguaugguacccauggcuuggauagaagcaagcaaguugugcuugagagaagcuaggacaggaaagagagaaaagagaaaaaaaaucauggcacagucaguccucauaagcaaggucaccucacaccacacuccaugguggcauucgacccccaggcuuucccugggcucccauuucccagggauacaaccccaaguucagggggcagugcaaacacaacagacagucuuuuuucagaugcuggccuugugauucugugcucuucuuguacaaugcagaggaaagggaaagaggcuuugagaaaaacauucagugaugccuccauaauuuaagaacaauucuccucgauauuaauguuugcuuacucauuuguuuuuguagaguaacaguauuggacuaauguuuacagacucagaauaucacgcacagacuaacuggguucuccugggaacugaaguacguuaaucaaacaccagcuacaguccuaacucgaggcuagaacaaaauuugcauuuauuuagaaaacuaauuuagacaguuaaauaagacuguuuccuguuguaugaagcacauauacgagacagcaaagguucccuccuaggcaaaggcugagccaauguccucuggucacucaguucccaggaagguugguagugaccccacugcccccucguccucuggacucugggacccuccccacucuuucacagaccuuucugggcauagauagccaggcauugacugggaggugucagggaggcaugcgaauuaauaauaauaguaacaauagcaagugcagauaaaugcaauguggauaaccucaacuaaauccuggaggagaaaaagcacauuuauggaaggacuagugggaucugaaagaaggcuauaguuuuguucaaagcaaaggacuaggccgggugcaguggcucaugccugucauccuagcacuuugggagaccgagguggguggaucacuugaggucaggaguucaagaccagccuggccaacauggugaaaccccaucucuaccaaaaauacaaaaauuagcaagguguguggcaugcaccuguaaucccagcuacucgggaggcugaggcaagauaauugcuugaacccaggaaguggagguugcagugagccaagaucgugucacugcacuccagccuggcgacaaaacaagacucugucuaaaaaaaaaaagaaaaagagaaaaaaaaaacaaagugaaggacuaaaguuggcuucuuaguuuucacaaugucccaugacaauguaauauguucacauuaggggaaagugggugagggaugcauggaaacucucuguaaaauuuauuuagaaaacuaaauuuuauuuuggaguaauuuuaagauuuacagaaaaguugcaaugacuuugcaacuuuucuguaaaccuuaaaauuaucccaaaauaaaaucuauuuuuuuuaaaaguaacugaaaggaaaaacaacaaaaugaaaacagugacccaaaccaaacccucaaagcacaagaaccuuaagaacagaaaaggagaauuuuaacuuaaaaaucacccaaggaaagaucccauuggugauuuaggcugaaaaauaaaaggcagaacuccagguagauauauuugccaucuuccuagaugcagaauuuauaggaaauucugaacagaguaugaugauuuuaaguucucuucauaaaaguaaagcaauuauuguacgauacuuaguauuguuaccugcagaacuauuaucauuguuaaaaaugaguaaacugcagcugugacuggggauaaggagcuuccaucagacuuggggacauaaaauaaugacuucuucucuugauaccgccauauccacaguccauguccuguaguaauguucaaagagaaaugucauucauccaauggaaaaauaagaauauugcuagcguauauuaaagcaaaacuuuaauauuuguuaccugaugcaagcacauuugguuuucuuacucagcuuugccaugucagaaagcgaaaacacaauguucucagcaccuucgauccaacuucaggaaggaggugggaccuggucucuuccuuacacugagaguuucccauuguuggugcuaaguggcaccacuugucccaacacagagcuacccgcguguuggcagcugacagugugaggcgccaagacagaauuucuuaacacgcaucucacgaaauaccugucucaugaaaugcgcagcaaaaaaacagucaguaggcucagacacugccauuauuguccuuuccugagauucacaauucacauaugggaggcucugggaagccaacaguagugcacauugccuaauccacuggacccacaccugucuggucacagaagccuuuuucauguccuguacaucuguaacuuaugccgcugggcugagaccacaucacacccacuugguguagcccuacauggaaccuaacugcuagucccuucuuaggauccaaagccauuuuuuguuucucuuuucaugaaguucccauuaguaacaucugugcuucuccugcuauuagccuuaguuuagcaccagguuacugauacuucuuccccuggaauuaccaccaccgcugugaugaaagcauucuuccacuaagaaaucgucaguucagaaaauaacauuacagucagcucucaguaucuguggguuccauauccguggauucaaccaaccauggaccaaaaauauuaggagaaaaaaauuauaucuguguguauucccuaaacaacacaguauaaccauuauuuacaugacauuuacaucguauuaggcauuauaaguaaccuagaggugauuuaaagcaggggucccuaauccccaggcugcagacugguacugguccauggccuguuaggaacugggcagcacagcuggaggugaguggcaggugagugagcauucccaccugagccccgucucccgucagaucagcggcagcauucaauucucacaggagcacgaacccuauugugaauugugcaugggagggaucuagguugcacgcuccugaugagaaucuaacuggugccugaugaucugaggugaaaguuucaucccuaaaccauauccucugcuaccccuacauccguggaaaaaaugucuucauaaaaccaguccuuggugccaaaaagguuggggacugcugauuuaaaguauagaggaggguauagguagguuauaugccaauacuauuccacuucaugucagggacuugagcaucugaagauuuuguuauagagggggaguccuggaaccaaccccccauggauaccgaaggacagcuauacucugucaugcccauucacccaggcguuuccauguggccugugcugaugcaggcugcccuugaguucaagucagugaaaaacugggguuuuaauuuuugagugcuagguuugcaugucugggggcagcccaccaagcucaccuggagcccacucauuucuuucuuucuuuuuuuuuuuuuggaaacagaaucucacucucucacccaggcuggagugcaguggugcgaucucagcucgcugcaaccucccccucccggguucaagccauucuccugccucagucucccgaguagcugggacuacaggcacauuuuuuuuguauuuuuaguagagaugggauuucaccauguuggccagcuggucaccaacuccugaccucaagugaucugcccgccucggccucccaaagugcuaggauuacgggcacgagccacugcgccuggcccccacucauuuccgauccaucuaggagacuuaccgacugcugaaaacagagacaugcaaacaaggagcaggacacaccagagcacgucgcaguucaucugccucuccagcuugcugcgcuuguagcggggcccacuguuguucagcagagccuugguuucauguccugucggggaggacaaagagacauggcaagucagagacuggagcuaagggaccagcugcauggauggcguggagggaauuccaugcugccauucaguggugcuuaggugagaagcuuggucaaaaaagcaggguuuaaaauuaaucuuacuuccuguugaacaggucugaaaauaaauaaaauaaaaugaaauuaaucuuauacauauauaaugacuguggagaacgaaauggaaagaaauacacuaccgugccaagaaagaaggcuuuggguugagguacuauucaaagaauuuuugcuuuugcuccuuuccauuuuccuaguuuccaaauguucuacaauggggauauguuaugcuuuuuuucuuuuuuuuuuuugagauggagucuuacucuguugcccaggcuggagugcagugguauaaacucggcucacugcaaccuccgucucucagguucaagagauucuccugccucggccucccuaguagcugggacuacaggugugcaccaccacgcccagcuaauuuuuuguguguuuuuaguagagaugggguuucacuacguuggccaagcuggucucaagcuccugaccucaugaucugcccgucucagccucccaaagugcugggauuacaggcgugagucaccacauccagccaugcuacucuuagaaaacggugagggaggccgggcacggugacucaugccuguaaucccagcacuuugggaggccaaggcgggcggaucacgagaucaggagauugagacuauccuggcuaauacggugaaaucccguaucuacuaaaaaaauacaaaaaaaaaaaaaggagccgggcguggcgggcgccuguagucccagcuacucgggaggcugaggcaggagaauggcgugaacccggaaggcggagcuugcagugagccgagaucgcgccacugcacuccagccugggcgacagugcgagacucgucucaaaaaaaaaaaaugaaaaagaaaaaagaaaagaaaacagugaggggaagugcuggagaacacagcgcugucuggcggcagguggugccaggugcccgagccuaccugcguagaugacaaugccgacgacugcguccguguuccuaagggugcagccccucagcagcagguuuucuuuauacagcccggccuuuuucccguugucauguaugcuguagagggacaguuggcacaugucacgugguugcaggccugugccucaugucuggagccgcaaugccuugaggaaggaaggcccugacacaaugaaagcuuggggccgcugggaucuggacugggaaggguacagggggcccccgagaguggguggcucgcccugugggucucugcaagagcugagacagaacugcuguucaccagucacuaggcauccagaagcagcucuagagccugguguuuauuuguuuugcagauagacuuguuuucacuccgggacugaucaccacuaggaagggcaaacucccaaccggccaaggaaggccuugcuacguggucucuguacaucuccugcucaacacaggaaauguuacuccuaaucagucucaaguugucauaaaaauacaaacaucuuucuacaaaaggggacgauauugguuucauuuuuaacauccuuuucucuuacaagaaguuauaaaguuauuagaaguauuaauauauguggucugaaaugugguaaauuccaugaaacaauucuauaaauucuguuuuacugcuauuuagauccagagggauagucuaagcuuaagcuacugguuuucaaacuuguccuccgggcccacugaugacccaggcuggcugggcagucuugggcuaggaccgcccugggacagauauggccccaggggccagagcacaggucacagggggaggccucauaaccggaacuguagcccaggccugcugugguuccagguuuccagaacaacagcaggggcccagccuaacccacgccaggcagggccaccaagggagugccuuccgagaggcuaccuuuucacacccacacccccucuccgcacgcauuccccacacucucaagcccacaugcuuccuguauggcucuuagcgucucaccagggaccccugcagggguuucccuccugccagcuauuggccuucugaccagggaaauaaaccuauguccuagugaagaagagaagcuaaacaguaaaggcaaggcugaaaugcaagcugggaggauauauuuuccacaagucaguuauuuaccaacagcaaggguucuucgccagagcagacacaguggggccacucaagggccguucagccaacgccgugucuacugcucccuuggcaaugccaagacggaguaagguuuuccuuuaaagagagauucgagacggcaaaccacuuugccagccacagcaucaaaagccuggcagguaugagauauccuuagguacaaaacccugcucugcgcuuguggagugaggacacccccuaucacgugucucccguggacuucuccagcgaaagccagacaaagacaccauugcacugggacaguagaaaauaacaaaucgucuccgaguucagguuaugcuuauuaaggacaaacgauaaacuuuauagaaacaagaaaaauguucuacauuaaauguucuucacugugacacugacuuuugagcaacuacugugauuucugaugaguccaagccagacggcaacuuggcaccuuacacaggugcaucgaccuauacagguccaugccagaaggaagagcgaaugcgagggguugggaacguacuccugcgugaacagcccacaacacaaaggggaggcuggagaacgacaucaccaucaggugccugguaccugggcuagaggcugccuugggcuucugagagagagaggcccggccgagggcgacacaggcccagaagcacacagguacgaggcucaacuccacaaagacacacacaagaacgugagccgucagcuccguugucaugggcugaaccguguccccucagaauucagcuggugaagcccuaacucccaggacugcagaauauggcuguauuuggagacagagucuuuaaagagauccuuaaguuaaaaugagguccuuuggacaggcgugguggcucacgccuguaaucccagcacuuugggaggccaaggcaggcggaucacuugaggucaggaguucgagaccagccugaucaauauggugaaaccccgucaccagguguccuugacuccucccccauuuuuacauccauucaaccucaucucccuggcugugucuuuaauccaugcccucuucuguauaucuccaugcagcacugcucugauucaggcgucugcauuucucugcuggagccggcaacacacgcuugcuggccucagcuccacuggccuggguuccucauguggguuccucacacaggcaccggagcaaucuucgagugugcgccugugaguguccccugcaggacuccucauugcuccagcuugacgugggaaccagccgacccugcagccccugcuuggcccacagaagggguggcuucugugguuuucugccccagccacccccacacagcauguucuguccacucugugcuagccucugccugagguagcccggccuuccggccugggcucagcuucugccgccuucagggcaguccuccaugccacacucccaggccccccacccaggccagccggcaguauuccaucugcuuccaugucucugcuuccaaacaggagcugcucauguccuauccauugcacaccccagugccuaccucagagccuggcaaacguugaaggcugcccggcccuuggcuuugagcugggucccuccagugggggaugacaggaaggacacuggaggaguggcugagagcaagaaaagacagggaguaggcugggcgcgguggcucacaccuguaaucccagcacuuugggaggccgaggcgggaggauugcuugaggccagaaguuagagaccagccuggcuaacauggcgaaaccccgucucuacuaaaaauacaaaaaaaaaaaaaaaauagccaggcauggugguacacaccuguaaucccagcuacucagggaggcugaggcaggagaaucacuugaacccaggagguggagguugcagugagccaagaucgcgccacugcacuacagccugggcaacagagugagacucugucucaaaaaaaaaaaaaaaaaaaaaaaaaaagaagaaagaaagaaaggaaggaaggaaggaaggacagggaguuuauucccugcucccuccuagagaggcagcacuggcuggcaguguccccugaccagggcuaugagucuccccaggcaucucccuggucaugagucccccagggccacucuuccccauggggccucauggcagugacugcucagcggccacuaaucuagcaucugcucuguccccgaugcguccccuacacccacccacuccugcagaaacaccuuagcaaagaugcacccuuaccaaguauccuuccucaucuauaugaaucaggguguucagucggcuuccuaaguggguccugacugacauaaguugggaggaaggaaugacagauaauuccuuccauuggcaaauccugggcagaauuugcuuuaaaauaaucagauguucauauuuuuguauaaauaauaaauaaaaauaaauaaauauuucuguauaaaaucaucagauguucauaucuaacaaaaguaaguguggaaauuaccagacuguuuugugcugauguucaauauuuuuaagauauaaauaugucaacuaaagguggcaaggcgaaauuaaaacauuccaguuuuaaugagucuaguugaugcaguuuauuuaaugcuuggucacuggcaguaaagacauuuuggauacagcccacacaaggcuccaaccagacaccaggcaggagggggcagggacccugacagcucuguuguuagugacagcccugcugucuuuacuaaccaccgucucugaagggugucacccaccagggcgaagagccuacuccaaaaugcagcuggugcucgugccggcccuaugcgguuguaggaggcucuccaggucagaagccugcucugugggguaagaauggucaccaaaggagaacaggguuggcuauacuuguauccgacaaaauagacuaagucaaaaacuauccuacaagacaaagaagggucaauuaugcaggaagacauaacaauuauaaauauguaugcauccaauaucaaagcacccaaguauauaaagcaaacauugacagaucggaaaagagaacuagggaaccugcuuuacaaugugaaauggaauuuuacauuggaugaccaacuaaccagccaaccucuuugcuuuauucuuuaggggaaagugcaaauguuugauugauuuguggcuucagaggugaccacaugccauaaaguuggcugagcacaaucagcagggucaggcugagccaggccuccauucccaggaggccucucugggagaugacaucucaggguuggggcuaaggagugagugcugggaacagcuggagaagguggggaacgauguuacuuccagauccuaacucugaagauuucgcuagggcuuaacuauaugaggauccuuccaaagaaugcagccuuaaagggcacuugaauaaugaggcuccuagcacuauuuuucugccagcuggagauauauuucacauacuauaauguucacucauuuaaaguucauagaguucuguauuuuguuuuguuucagauagggucucgcucuguuguccaggcuggagugcaguggugugaucauagcucacugcagccuggaccuccugagcucaagccauccucccaccucaaccuccugaguuucugugacuacaggugugcaccaccacacccacaccaggcuaauuuuugugugugugugugauuuuuguagagacaaggucucacuacauuguccaggcugcucuuaaacuccuaaccucaagugaaccucccaucuaggccucccaaaggauuacaggcaugagccacugcacaggcuaauuuuuuuucuguuuguauuuguaucaucagaguuguaaaacuaccaccaccagcuaauaugagaacauuuucuucuuucuuuuuuuugagacugggucuugcucugucucccaggauggaguacaauggcacaaucacgguucacugcaaucucugccucccccgcucaagugauccucccacaucagccucccagguagcugguacuauaggagugcaccuccacacccagcuaacgagaacauuuucaucacccuaaaaauaaacccuagacccacgggcagucacuucccauuccuaucucauuccacacccccaaacccuggcaacugccaauccacuuucugugucuaagauuuuccuacugugagcauuucacaugcgacaccuucuuuuuuuuuuuuuuugagauggagucucgcucugucacccaggcuggagugcaguggugugauucuggcucacugcaagcuccgccucccggguucacgccauucuccugccucagccacccgaguagcugggacuacaggcgcccuccaugacaccuggcuaguuuuuuguauguuuaguagagacgggguuucaccguguuagccaggauggucuugaucuccugaccucaugaucugcccgccccggccucccaaagugcugggauuacaggugugagccaccgcgcccggccacgacaccuucuaauucauguuguacuucacuuucauuccuucacuggacucucaugucagccugugagguugacaggcagucgaugauaccuccaggauuaggagaaggccggggcucagaaaggcagaauaacuuuccuaaggccaccucccagggaagagaaagagccuguauucagacuugggucuucuugcuacaaacccaaacucaguucuguucuccaagugcaaacaguuaauguuucaaguuuggaauggcagguccuaaaagaagcaaaucugccggcauuccugggcucuguggugugaaggagguuacggggcagcagcugccucauggaggcugcaaggaggccagugggaggaagcaaaccagggagguggcucugcagcugagccacuuccugagccuagacagcagaucuaccucccaacuuagcucccugcccugggcaucaggacugguaugggguuaagaccuccuuucucuuugcuugggacggauagcguuaccaggcccuacaggagggaggauuccugcccgagggagcacuccagccccagggagcacuccuaccccgggaguauuccucacugcgaggcugccccaguccccuucaggcugaugguccggggcagggcugcuccccuuggucgugccccacagucacgggggcaaguauuaacacacugcugcuccacccccagaggccccuccugaccugucuggcugggagaggggccauccaggcccugacagcccuguggcaagcccagaacaccccggcugguggagauggcgaauuaucguuaaagagcgucagguguggagaggccugaauuggcugggcgcacacuggcccagauggugccugugcccaggccacaagggggcuaccaggguuggacgauggguggaguacacgaggagacaacacgacaugacugagggcaaagcaggaaaggauuucaugcugggagagcugcucuucucaugucccuuucucgggcaacaugccggugaggacaccacaggaggaacgccugcuggcggcacaggcuggagaagccccggugggccuggcuggcuggcugcaggcagaugacacccacucaagaggcaucuuccccggcacccggggggagugcagccaggccuggggguacacagccaggcaagggccucaugugggaggcagugaggugcuggggcugagcgcagggcggagacaccacccagacuccuguccucaccacacugcuagagacaguggcugagcaauacaaugcuccucccgucuccugcaccggaccccgccccucucguccaccccagcagagggccgucaccuuuccuaggcucuguggauccagcaggcugcaggccuucguaucugucccugcugugccuccacugccaggcaccgcccugucacaccaaggacaaugagcuaggagugcagucuucagaagagaaagucggccccuuauuuauuuauguuuuuugguggaguuggcaccguaaaauuauuccagggauaccacugaacauucuccagagauugcccucgccccacccuucacaaucauuguuucaggucaagaugucuagcaacccagcaccugcucucuguagccaacucgugccuggggauucccagcagugcugaggauggugcccugcacacaaacucuuggggcaagggaucaaggaggccuggggaagauggcccaggagucaagaaagaccagaaaagccacagcacacggguugugcugaguauuuccuccccaaaucguagagguuauaugcuuacauuuuguuguugaguuuuacccugcuuuaauuggcuuauuuaaggggugauuuaaugcuaucggugucugauucucagauaauaagggcaauuccagugggugacggggccaucacuuggcugcagacacauuucagcuuuugcugugcagaguucacuuccguugggucauccccagcccuaccgccugccacugugugcugggcacaggcaguaaugcuggaggugcuggcaaaacagaagacucaaccuacaccgaaagcucuuagaaauggggccacuuccagaagcagaucgcucccacgccuccguaugucugcguggugggagcggggggggggugggggggugggggaaguggguggggcaggcgagcccacugccugggccauucagcggcugcaggcgucaaaaguccaucccugccuccaagcaggacagugccaggagguggccccuugugcugcaggcgagagggcugagcccacgggagguggcugaggcaugauagcuggaacagagcuugagggcagaggaaggucaugugcgucaugccccugucacagccuuguucuccagaagaccauccccaagggcccuggcaggccacucagcaacuccguucugacacugccuauucucuuccauguuuuugcccacagcacugaccacacacacacacacacuccgauuauuauggaaauuuucaaacagacaugaaggugguuucuacuacuccccaucacguggcuucagcaagugccaacacagggccaggccugugcccugauccaccugucuuucuguuuuggagcaggaaggggcuggccuacuagacacacucuagguuaugcuuauuuguuuuaauugucuuucuuucccccaaacuagaaugaaauaaacacaaaggcaggaacuucuguuuauucaguuuaccacauuacauccagugccuugaaugcacccagcauguaacagguaucaauaaauacguguucagugacugaguggaagcauauauccaugaaacuccacccggccuacuccugcuuccacguuaacggggccauguguggucagcuacacaucucuugucacacccaucaccuacccggggccugcuagcgggaggaaaagcgguaccuccuccucacagaugguaguggcaagcuucuacugacaacaggcucuuacccacuacugacaacaggcucuuacuuccaaaagcagccaagaaggcucaggugcugggccacauucccaaacagcuacaccauguggcaaagaguauuaaaugcauacuuuauaacugagaauguguaaacaccugccuauguaguuaucaaacagaaggaugcgcgcaggcagacacacgauacucacaugcagccgcgaaaccuacucaggucguuguuuggcuucucgcauucgaucacgcuggugaacgucaaaggauugaauucggagaccuaaaauaacagcacguagacauuagagaaauccgggcucaggcugcgccguucuaaaaggcacucgcuuuucugucucgcauccgcggcaggcacauuucacgggggaagaacucugccuaugaaucucucuggaaagccaaagcaacgccuucuccacuguauaauaaauaacaguuaaucauuuuauaacgagugacaauugggggaccgguacugguuacugguuaguaagugagcagaaaugacugcagcucuauugcaaaaugagagaacaggcgauaaagcaaaggaggccaucaaugaagcaaagggaugaaugaguuuuuuaagacacacggcacuugcccauuucuacagacuuagggaagcaaauuccaccuggaaaacaggagcuuauaauaaauucuauuuuuucaacguacacuacaugaucuucauggaucuuugaugaaaaagauuuacauagccaaugagugagccaacaacuucuuuaguauucugcucaauuaaaaaaaaacccugacaacucaccacaaaaaugucuuuagaauuuuuccauugauagauaaaacagagccuggcucauaagaaaggcuuaggaguggggggaaggaggaagaagggagagaaauggagggaauaagccuucaguauaaacgagcacaauuaguggauuucuuuuuuaucagcucucuggucaggccuggcauucuacuuaaucuagcaagugucauaacaugguaaaaaacugaacugucuuuaaugacacauacaaaaagugaaggugguuaaaaauuauagaaauggcauaaacacuguugacaccaccccagguuaacuauggcucugccgcaaccacacauuucccugcauagaauacagccauaaagguaauuacucaaaacucaguuccuacuguuucccaguguaaagcguacauuaaaaggggcgugugcuagauaaucguagcucgauucaauaacugaaauugaaaugcuauuuuaaaaggcucuucuuggaguguaauuagccaucagucucucuucuccuuggacugaaauggccucucgcucuauuuccagagcagggcucuguuucaaggagucuuguguuuauuuaaagccuguggauuaucuugaaaccaguggauggcuuuuuccagggcagacauuugcagauacaaaguacaggauggccaugaaggcagugaguuccagagaacaccaggauuauucuuggcagacgaggaggguaggacuuaaaauauuuugucucuguuuauuauucuuucucucuaagaaaaaugucauggacauggcucagaaacaguaggacauucugucucugggacuucagagcuguguuuguaauguucuaccaacaaucccaugcccuggggagugugcgcaggggaggucccaggcacgggacggcuggcuuccucugcauccuucuggaacuggggaggauuuggaggauuuuuagaacuggagggaucucuagagacuggcaugggcugaacuggagccccucauccgccgcuagaacucauauauugaaguccuaaccccacguagcucagaacguacccuuauuuagagaggaagucuuuaaagagguaacuaaauuaaacugaggucaucaggguggacccuaaucccacaugacuggcggccuuauacaaagggaaaaucaggacgcaaagacacacagaggggagaucaugcaaggacacagggagaagccaaaaaaagaggccucaaaagaaaccauccugcugaccccuuacucccgaauguccagcuuccagaccugugagaaaauaaacuuccguugcuuaagcagcccagucugcgguguuucaucaaugaggccccaguaaacgaauacagagaccaucuuugaguuucucauuuaaaaagcauuucauauccagagcacaccuucuggaugaggaaaauccuguuuacauugcuuauuucuaacaacaggcaacacacaacacuccccauuuaggaaauacauugauuuaucccuccauccacucaugucuaccccugacucauuccaaaccagcuuugaggucaugcccaaguuauccaucagucagacuugucaaccugcccccuggagcauggacaaaaguagaggcccccgauccacccuucugcucugggcacacuaacuccauucuucuuaaaaagcagauauccagcuagggaagaggaagcaguucuacagauggaugguggugaugguugcgcaacaaugcgaaugaacuuaaugccacugaacuguacacucacaaaugauuacaauaguaaacucuguguuaugcauauuuugccaugauaaaaaauuucauuuacugccaugccacccugaaugcauccaaucuugacugaucuuggaagcuaagcagggucaguacuuggaugggagacacaauuuaaacauuuuuaaguggauauaaaccaacucugagaauugacugagaagaaaugaaauaaucaucaaguugaacauagaccagaaaucuggcaccuuucaguacaaguacauaaagucucccucgccaguaauucgugagggcacugccauucugaucgucaucaccaucaacauaauuacaaguuuggggaggcuugccaaaugccaggcauugugcuaagugcccuacaauuaucaggcaacccugcuagaaagucaguuuuugcaccaccuucaacuuaggaucuuuaaguaucgugcccaaggucacaguggucuuggagugacagacuggagcuuucuuggccucugagcuaucagcucaaccaucaauaccugcagagacaaucuggcauuaacagaaaaagauuguacaaguaagccagaaaauguguaacagauucuauagaaacgucccccaaaauuuaaauugcuuuuuauuuuuuauuuuugagacagaguucugcuccugucauccaggcuggagugcaguggcgggauuuuggcucacugcaaccuccaccuucuggguucaagcgauucuccugccucaaccucccaaguagcugggauuacaggcgugagccacugcacucggccuuaauugcuuuuuaaaguucuaaguuuccaaaauuuaaguuuuaguauuuugaaaacaugcuucagcucaacauaccuuaaucugaucauagauacccucuuuccaucuucagcaaugccuguggaugugggcuuaccagagcccacucaaaaacagaguaaaaaaucaggagcgagcccggggacuuagugcuaguucuucugauuaauaaauaugagacuuuuggcaagugaagagagggcauuuggacucggaucuccggggucucuguugcccuauaaguccacaauccuguaggaugcagagaugguuccaaugaaucccugugcuugggaugacagacucacuauugcagaaacagcaucaccugcaaaagugcugcccacacaugccagccucaagcugaagcacugcccucugcaucucugcugcagcaccccagcaucucagacaaaaggaagcagacaccgugaaggguucgcccacugcagagcaacauguucaaauaaauaucucaccggcaagaaagaaagugcucacaguuucuguuguugucuuacagauauuucugaaacuucuuugggcaaagugauuugaccugacuagguggaaagaaagaggcaggacaguggugcaacagagagcccuccagcccugccccugaacuugcguuucugcuagagaccgcagcagcaggugcuccagggaugcccagagcccugcggcaugcuucuguuuccuccugaugccugggaccuccuccugguagaacagcuguguccccucuucaaccacaugggggaggcgugugucuaauucagcagugcccagauugcuacuugaaugaaugguuugauucacaggggagauucuguuaccaaccuuguauuucacauuuguauuaagugaauugcuacuaaguacucaacaaaagcaaauacagauguccuccaucuugaaacagcagugauguuggaaagggcauuuacaguccauuaaagaggauacuguuauuuuuuuucuaucauaaaaaaacuaaaguaaagagguucauauugcuucagccauugggugagcacacagcacaggugcacacuugggucaucugcaggucugcugccagcagggacccugccuaacgcuccagguggaaaucugugagugaggccaccugucugggucucuggaugaugugggcagagagaacccuggugagagaaugcacagagagcaggggccagcaccugccagccaggcagggccaccgccugcaccagcaagaagacguggaaaacacacacacucccgucuucugcaucuggaucccguucugaaaacgcccuuugcauuucccuucaugauacucccaggucacaaggagggugaggucccccugguucacuuccagccuugacaucacgccuggacaugguccucgaaggcucucagugacaaacacaacaccucugucuaccuggcuuuggucucgccaccugcuaugggccuguuugucccuggacugaaugauccccgucugaucacagaaguuuuccaccuuaacaaagccuuggagacagcugcugcccuacagaaugcaauccucaucccgugcaacagcaaagcucugcucagggucacugcgcugaccuccucggcuaccaucccucccagcacccauuccugccacgcagggaacccugaggaagcccaaaccuuucugcauggcuuccucugucuugccauccuacagcaucaggcgaagugcccuucauuuagcauuucaggauguugucuuuucuggagaagccuuccugacggcccccugguaggguaggcaggugccacagcuccgaacuugcuuaguccccaugcagacaucaaaccccgugcuuccuggguguggcuggagcuggcucccauuccuccuucacuagaccacagguucccugagcacagguacucugugcccuugagaccaucacagugccuggcacacacauggucagagggugacgaaugcuuauuucagaaggaucucaggugccacaagcuucuggaucaccccagaacuccgugcugggcucuuggggaccuagagccccugccugccgcaccaucucccaagagggccugcugaggcgucucugugguuccagaaugcauaguuccucuuuuuaaagugcgggcucuuuuccccuggcagcaauacaaaaugauuucuacauagccucuaauccggcuccuuagcuccuuacuuauugaucauggguaaagaaugccuucauuaaauuaagucaagcauuuuaacccaaauuaauggaauaauuaccccaacucuuuuguuuuguacuuucuuuauuauuacuauuauuauuauuuuguauuucaaucuaauuuguauuuaccacuugauggucagugcuguggaaauucaaaggagggcagauggcccgaucccaauacugaacgaaugagugaauuuacuuuuucacugccaagacuguauugucaggugaacauuuucaauuugcuaaacugaaacagcaaaguagucuguuuuuguccaccacgugucuccugacacauaguggguacucaaucaguuauuuauugaaaaaauaaauaauaaauaaauacccaagugaaagcgucugguggcaagaaacaccgaacguacaaggaaacuuaacucaaagugauaauuucuccaaguuccacagauucaguguuacucuagggguuaaugccccgugacaaauacugaauagaaaugagcaugaaacccauuuagacagcaauguaaucuauaauagcggcugugauuguauuauuuaagguaucccaaauauggaagugauaaguagguuggcccagccgcucauggcgggacacuccacugcacgucacacagcaugugacggagagugcugcgucccugccugacgugguucucgucuccacggugacaagcugacagggacaaugagaacuggcauccaggccuccgcaguccucuuucagagucagcuucacacagguccacagguggcuucugggaggcucacgccucagagaaacugaucaaggggugucuggguucugccuucuuuuucuaacuggagauuuucuugccgcaagcaccaguguuagagaucaagugguccucccuuaguuucugagcagaaaggcagcuuuucccuuguuaaauucuaguuuagaacgcaggcgccagccuccccuugccuuuucugccuuucaucuuuuguccccuugccuccugacugucgcacagucaaaaagccucgguagaugguggcaaaauucaaaggcucacagugcgggguuagaguuugaagucucaaaaucaaaacccuuucuuucccuccuggccccaaacgcuccaugcuguuucagugggcuguggcugucagcaaagccuugcuuucuccuccgucaaaugcaccuaagagucccuaagaacuggcugugcauucaggcaguagguaacgagaguuguuucacagaacaccaaauucaaaccuagaugagggcugcucguuaaaauugcccucuugaacguauuuguacuuaauccaacagggugucccugcaugaaacccgccugcagccccucugcugagcuauuagcacagugagauccacaucagucugucugcuuccacagccacaggccacuuagugccucuuccaucacuacaggugggggugauggugugagcagaggcacggcuuuugggugugaacgugucaugcuuuagcgcucacucaguagacagccuugcuggagaaaaggugcucucucugugcacagcguaagaggggucuggagccucaguguauuuguaauaaaagggacccuaaaggcagaguuccauggaccacagggccauugguagccacauagaggaagaccauacuacuauuuuagaggccaacugggauggagaauacaaaaagaggucagcuaagaaaaaaccucuugcgcuaaucuggggaaugauuccaagacugaaauggcaacagaaaugugaaauucuaaagcacaaccagaucugcucagucaucagauucaaaagaaaaguuauccagcaccagacgacugggcaauuuggaccaaaccucuaguuacuggcaaacagagaugcuggacagaaaacugaagacagcugccuggagguaugaaggauuuaacaagaaagugaagaauaagcaagccaagaaauaaaaagacaaaaauccagaguugaggcugggcuuugagguuucuuuucccugaggagggucuacagcuucugcaagauguaguuaagagguugaguggagcucaugagacacauguuggugcucggggccuauauuaguugccuguagcugcuguaacaaaugaacacaaaugugguugcuuaaaacaacagucauuuguugucucgcaguccuggaagucgaaaguuggaaacaggucucacugagcuacagucaaggaguuggcagggcuguguuccuuuuggaggcucuagaagagaaugcaucucuuugcuuguuccagcuucuuaagucacauucccugacuuauggcuuccuuccauuuuuaaagucaucagugugcggggauugagucugucucacgcuguaucacuuugauagugaggucugauuaacagccuuaauuccacuuacaaccuccauuucugcuugcuauguagcauaacauauccacagguuuaggugaguaagaugugggcaucuuucgggggaccacuauucugucuacuauaaaaccuaccaagagaggggccugauaaacaccuaugcuuucuaacgcaaccaggaagaacggcaucacagaggugaacugcgggaaagagcuucaacauggaacuuaauacaacacggugccacugcaucaaacacauccagaacacugcugagcuccuuuugugcagcugcuacccagcuuagagucaacugaguggcccagaaaaaucucaaugugaaaaauggaguauaauaauuccaaauugcuagaaccccuagauacuaaacaaaaccagcaaaagucuucuuuauauaugugugucugugugugcacauguaugugugugugcauguaugugugugaguguguguauauauauaugaaauacaaggccucaaauuauuuguaaaaaaucaauuuccagguacaaugucagacacagacucagggauaaccaggcauaacaggauguaaagcaucauggaagaaccaacaaaacaagaauaggaacagauccacaggaaguuuaaaaucaugcuugcugugaucauaaagcuaaagaugcaccugaaauuuuacaacagcuagaaauuauaaaaugugaccuuagagauuucgaaaauauagagcccacaugaaauuuucaauuaaaagcugacugccuggcuuauuagcagauuuggcaaacacaaagagaaaacuagcaaacuacaagaaacaugagaaaaaugguuuugaauuaagcaugggaagaugaaaggaugagaaguacagaagacagggaagaaaccauaaaggauagagggaagucuaacguguguaaucagggccccagaagaaaaagagagagagaaugaugcaggagcaauuauugaauacauaauagcugagaauguaguaaaucugacuaaaaagcaacaaaccgcagaugcaagaacuuuuaaauagggucugugaagggagauuauaccuaggcacaugacacuaaaaugaugaaaaccaaagaaaauaaacucuuaaagggaaauuggggccgggcgcgguggcucacgccuguaaucccagcacuuugggaggcugaggcaggcagaucacgacgucauggucuugaaagaccagccuggccaacauggugaaaucucaacucuacuaaaaauacaaaaauuagcugggugugaugucacgugucuguaaucccagcuacuugggaggcugaggcaggagaaucacuugaacccaggaggcggagguugcagcuugaacccaggaggcggaggcugcaguaagcagaaauugcaccacugcauuccagccugggcaacagagcaagaauccgucucaaaaaaaaaaaagggaaauugauaaaacuuguuacuggcacacaaaaacuaaagaaaauacuaaacaguaguguuaaaagagaaggaggccaagcacaguggcucaugccuguaauccaagcacuucgggaggccaaagcaggaggauugcuugaggccagcaguuugagaugagccugggcaacagagcaagaccccaucucugcuauaagaaagagagagagagaaggaaauuggccugaugaaaggacuaagaugcaggaagaaaugaaaagcaacaaaaacgguaaauaagaaaguaaauauaaaagcauguugacuguauuaaauaauaaugucuuuggcaauucauaaacugauacaauuacaaaacacaagaguauguaaguuggaagagaauaaaaagauguuuuuugcuuaaaaagggcccuugaauuauucagaaagagaauacaaaucaauuaauguuuaauacugauagucaaagaugcauguuguaaucucucauguaaccaccauauuauaguaagaagcauauaauuuccgaaccaaccaaagaaagcaugguaaacucaaugaaucagaaagaaggcaaaaauggagagaaaaaagaauacaucaggcaggacaaauaaaaauaauaaauggaugcuucacacucaaauauaccaguaguaacuuuaaaaguggaucaagaaaaauauuuuaaugaaaacccaaaaacuaugucagacugaauuuaaaaacucaagacuauauugacgagaagaaagaccuaaagcaugcagauacuagaaaagugugaaaagcugaaaaagauauaaauggcaaagaguaacaaaaagaaagcuagcgugccuguauuaauauuagauaauauaguauuaaaucaaaaagcaugucucuauauaaaaagcauuaauuugaauuaaaaaguucaacucauuugaaaaauaaaaaugucuaaauuuauauaauccuaauagcauaaacucaaauuauauauuacaaaaauugacagaaacaaaggagacauaaaacaaauccacaaacuugguaacauuccuuucucaguauuugauaaaacagucaaaaaaccaggaaguuauauauuugagcaucacuauuaauaaacuaaccuaauggacacguauaaaacacugcacacaagagcuguagaacacaguuuuucaaguacucacacaacacugacaaguacugaccauauucugugccauaagcaaguaucaaucaauuucaaaaaacuaaauucauauaggauuaacuuaaaucagaauucaccauaaaaagaaaauuacuaaaagucccauuugcuuugaaauuauguaauacaauucuaaaugaccaauuagucaaagaaaagaagucacgagagaaauuaagaaaaauauuuuuguaaaugauauuaaacauauagguugaguaucccuacucggaaacuccaaaauccaaaaugcuucaagaucuaaaacuuuuuguguguuggcauaugacacccaaaggaaaugcucgcuggagauuuucggauuaggaauguucagcugguaaguguaaugcaaauaauaucccaaaaauaaaaaaaaaucagaaaucugaaaaacuucuugucuuaaguauuucagauaaagaauauucaacuuggcuggcucacgccuguaaucccuacacuuugggaggccaaggcggguggaucaagugaggucaggaguucgaggccagccuggccaauaugaugaaaccccaucucuacuauaacuacaaaacauuagcugggcaugguugugggcuccuguaaucccagcuacucaaggaggcugagucaagagaaacacuugaacacgggaggcggagguuacagugagccaagaucgcaccaacacuccagccugggcaacaagagcaaaacuccaucucaaaaaaaaaaaaaaaaaaagaaaaagaauauucaacuuguacuacguaucaaagauugugggauauugcuugcuuucggggaaauuaauagucuacuugacuauauuaaggaauacuaaaaggagaaauuaaugagcuaggcacaacuuguaaaaaagaagacuauacuaaacacaauagcagaaaaaauaaauaaaaauaacuaauuaaaagacaaaucuaggaaaaaaguauaaauuauauaauaacagaaauaaaaaagggaacaucaguacaaauccuacauacaucaacagguuaaaaguguuaugugaacaacugaaugcuaauaaauuugaaaauuuaaguaaaaaggacagauuaauagaaaaauacaaguuucuaaaauuuagaguagaaaaaaacccagcauauucucaauaguucuuuaacauuaagcaaauugaaagguaguuugaaucuuucugcaaaaaacacuucagauucagauggcuucaccaguaaauuugccaaaaaugugaggaagaaauaacauucacuuacauaaacucuuccaguagugagaacaaauacuucuuaauuuauuuuaugaagcuggcaugggcuuuauacuaaaacacaauaaacauauuaaaaaacacaaaaguacaagucuaucuuauuuaggcaaaaauucuuuuuuuuuuuucuuuuuugagacggagucucgcucugucgccgaggcuggaguacaguggcgaucuuggcucacugcaagcucugccucccggguucaugccauucuccugccucagccucccgaguagcugggacuacaggcacccgccaccacacccggcuaauuuuuuguauuuuuaguagagacaggguuucacuguguuagccaggauggucuugaucuccugaccucgugaucugccagccuuggccucccaaagugcugggauuacaggugugagcggccaaaaauucuuaauaaaacauuaguuuacuaaucccagaaauauauaaaagauaauacauuaggaagauggauauagcucaagaauucaagauugguauggcauuagaaaaaucaaugucauuagauacauuaacacaaaaagagaaaaaucauaugaucaacucaacugaagcagaauaugcauuugauucaacauuuauucauaauacuuucucuuagcaggcuacgaauaaaagaaucauuaguuuguaagggcuauucaccaauauccuaauaaaauaucacauauaaugguacaauguucaaauuuuucccuuuacacauuguaucagggaaagaauguaugauaucaccacuuccauuuagaacuguacuggaguccuugccacugcaauuagguaagaaaaaaaaaaguauaaugacuaaaaagguagaaauaaugcuaucauaauucaaaaauaaaaugacuguguagaagaucuaaaauaaucuuagaaacuuauuagaauuaauacaugagugaccaggcacaguggcucaugccuguaaucccagcacuuugggacgccaagauaggcagauuaucugaggucaggaguucaagaacagccuggccaacauggugacaccccauagcuacuaaaaauacaaaaaaaaaaaaauuauccgggcgugguggugugugccuguaaucccagcuacucaggaggcugaggugggagaauugcuugaaacugagaggcagagguugcaaugagccaagauagcaccacuguacuucagccugggcaacagagugagacucugucaaaaaaaaaaaaaaaaaaaaaaagaauuaauacaugaguuuagcaaaguuucuggauacaagaucaccuacuaugucucuauagacuguaugaacauacauacauaugcauguauacuauauuuacuacauguaaacacacacacauugaauucauaagcacacuauuuguaauaagcuaacaaaaucacuuugcuaggaauacaucuaaaaaauguauaagaucucaacacugaaaacuauaaaguauuauuaagagauuaaagauggugcaaauaagagagaaauagagggaacuguguucuguguuacauagaucuggggucagugccugcuuccaccagccacacuggaaaaacuaaucauucaucagcacugcuagggaacuuaggaaagucuugccucaggaguggagaacaauuaacucuagaugagcacuucuuuagauccuccuaacaaaucaaauuguuuugaguaaauucacugcaguccugggcacaacucaagaauauuuauagucaaauccaauaucuggcauccuauuaaagauuaucaggcaugcaaagaagaaagaaaacuaggcccauaauaaagagaauaaguaagucagcuuaaucuaacauagaagagacacagauguuagaauuuguagaaaaugacauuaaagcaguaauuaugcuggcuuuccaaugaucaaaaacuuaaguagggacauggaagguaaaaaagagaccaaaauugaacuucuagagaugaaagcuacaauaucugagacaaaaaauaaacugaaagagaucaacagcugcuuagaacuuacaaaagaaaaauauagugaacuugaaaaauaguaaccaaaacuauccaaacggaaauacuaagagaaaaaagaaucaaaagagaggauugguaaguuguaaaacaauuucaagaagccaauauucuauuacuuagaauccccaaagauggggaaggguaugaagaaauauuugauuaaauaauaacugaaaaguuuccaaacuuaaugaaaacuauaaaccuacagauccaagaaucucaaacccccaaauuaugaagaaaauuacaaagcauaucaugaucaauuugcuuaaaacuaguaauuaaaaaaaaaacuugcaagcagcuguguuauguacaaaggaacacaaauaaggauaagagcagauauuucauuacaaacaaugcaagcaagaugacacuggagcaacaucuuuaaagcaccaaaguguaaaauacugucaaccuagaauucuauacccaguaaagauauuuuucaaaauaaaaaaggaggguguaaaauaaagauguuugcacauauacaaaagcugaaaaaaaauuccucacccacagauccauaccagaaaaaaaugauaaaggaagccauucaggcaaaaggaaauuaucaauuggaaauuuggaucuacacaaaagaaugaagagcacaggaaaaggcaacuguuuguuuguuuguuuuguuauuugacagccaguucauccuuaagcucuaggugauuuuagugcucuuuuuaugagcauggguaaguaagacuuuuucuuauuacauaaaucucuguaauauauaagcaaaauguaucauaaaaauaacauucguuuacaacauauauauaugaugaugaugaugaugaugaugaugaugaugaugacaguacaaagucuggaaggagagaaauggaaggauaccauugcaaaguuccuuuacuauaugugaacugaaauaauaucacugaaaggauagaucaggaugaauuaaagauguauccaacaaaccuugaaguaaccucuaaugaaaagguauagcuaaugggagaaaaaagaagcagaaaaagaagaaaagggucacaaagagaagaugggaaaacaacuagcaagaugauaggcuuaaaucuaaccaugucauuaaucacauuaaaugcaaagcuuuacacauuucaauuaaaaggcagacucguuuuuaaaaaaauuagcaaaagacucaauuucuugcugucuaaaaaaaugcacuuuaaauacaagaugcaaauauguuauauaagguuaugcuguaacuagucaaaagaaagcuaaaauggcuauauugcuaucagacaaaguaaguuucaaagcagagaauauugccagggauuuauaaaagggccaaaaugccccugacaacaaagcuucaaaguaaaugaagcaaaacugauagaucugcaaagagaaauacacauaucugcauuauguucagagguucaguagcccuuuacaauaauuccuagaaaaaauggcauaaaauuagcaagaacacagaagacuugaauaacaucaucaaccaguguuaccuguuugacaucuauaaaauacuccaccuaaaaacagcagaaugcacguuauucucaaaagcacauagagcauuuagcaagauagaccauauuuuagguccuaaaagaagugucaacaaguuuaccauaacucacauuauaaaaaauauuucccauuugucuggguaauaauuuuuuugauuugaccccgaaaggacaggcaacaaaaacaaaaauacacaaguuugguaauaucaaacuuaaaagcuccugcacagcaaaagaacaauuaacagugugcagagacaaccugcgaauugggagaaaauaucugcaagccauauauccauuauugcaagcuauuauugauuaauaauggauuaauauccaaaguauacaaggagcucaaaaacccaauaacaagaaaacaaaaaaucaaauuaaagaauaggcaagggaucugaauaaacauugcuuagaagaagacauacaaauggccaaaagacauaugaaaaaaugcucaacaucacuagucauuaggaaaaugcaaauuagaaccacaaugagauuugcuauccuaccugucagaauaguuauuaccaaaaagauaaaagauaucaaauguugaugaggaugugaacaaagggaacacucauaugcuguugauggaaauauaaauuagggcagcuguuauggaaaacuguauggagguucccccaaaacuaaaaauagaauuaccauaugaaccaacaucucacuucuggguauuuaugcaaaagauuugaaaucaguuugccaaagagaugucugcacucccauguucauugaagcauuauuuacaauaauggaaucaacccaaguguccaucaacagaugaaugaagaaaaugugguauagauacacaaugaaauacuauucagcuuuaaaaagaaggaaauucugucauuugcaacaacauggauggaacuagacaacauuuugcuaaguaaaauaagccaggcacagagacaaauauuucauauacucacuuauauguggaaucuaaagcaaccaaacucagaagcagagaguggaauugugguuacagaggcugggaguugggagagauggggagaugauggucaaaggguacaacaucucagguagaccacacuguuuugauuccuguagucuuguaguacauuuuggagucaagauaugugaaucuuccaacuucauucuucucuuucaagauuguuuuggcuauauggggagccuuguaacucuacauaaauuugaggauugccuuuuuuauuucugcaaaaauucauuaggguuuugacagauagcgcauuguaucaguagacugcuuugaguaguauggcauccuaacacuaugaaauuugccuauccaugaacauaggaugucuuuucauuuauuuaaguccuuuaaaauuuuuuucagcaacguuuuauaguuuucaguauaugugucuuucaccuccuugcuuaaauuucuuccagguauuuuauuauucuacaugcuguuuucucuaauuguuuauuuuauuuugcgauuuuuguuguaaacuaaucauuuauaauuguauaaauuuaugggguauaaaguaaugguauaauuugugaauacaauauagaauaacuaaauuaagcuaguuaacauaucuaucacuccaaguaccugacgauuuugugguaagaacguuugaaauuuacccucuagguaauuuugaaauguauaauauuccauuacuaacuauauucagcacacuguacaacagaacucaaaaaauauguauuuauuccuccugucugagauuuugcucccuuugaccaucaucuaucuuccuaucucccccaucccccagccucuguaaccacaguucacucucagcuucugaguaugauugcuuugcauuccacauauaagugaguacaugagauacuugucuuucugugccuggcuuauuuuacuuaacauaauguugucuaacuccauccauguuguugcaaaugacagaauuuccuucuuuuuaaagcugaauaguauuucauuguguguguauaccacguuuucuuuauucauucaucuguugauggacacuuagguugauucccugagacccccugaggaacacaggaaaaggcaccccuaacugcacccccccacaagucacucuuaagggcuguaauuuuugcuccauuuuucaagacuucuugugcuuaguuccauaaaacauuugagucaagcucccaagaauauggcuggacagaaguguacauugucccccaccuguggcuagcauaaauaaagggcugcaguuucuaucuauauaaucacauauauguuauauauaucauauauaguuauauauaugauauauguuauauauauauauuuuaaagacagggucucugucacccaggcuggagugcacugccgugaucagagcuuacuauaaccuugaccuccugggcucaagggauucucccacccuagccucccaaauagcuaugacuacaaaugcacaccaccacacuuagcuaauuuuuuguucuuguagagacaagauaaaaaauugcuguagagaugggagucuugccacguugccuaggcuggucucaaacuguuggccucaagcaauccuccugcaucggccucccaaagugaugagaugacaggugugaaccacugugcauucaugugcugcgguuuuuuauuuuguuuguuuguuuuugguuguuuguuuguuuuuugagauggagucucgcucugucaccuggcuggaaugcaguggcgugaucucggcuugcugcaaccucugccuccuggguucaagagauucuccugccucagccucccgaguagcugggacaacaggcgcgugccaccaugcccagcuaauuuguuuguauuuuuaguagagaugagguuucacuguguuggccaggauggucucgauuucuugaccucgugaucugccugcuuuggccucaaaaguucugggauuacaggcgagagccacugggcugcaguuuuaaagggaacugacagcaguugccauaagugguuauuacugcaggagggcgugaacuccagcuuuuggaauucacagauuuggauuuguguucuuuuuucuuacacacacacguaagagaagccuugggugccugggucagacagaaaauggaaaaucauuggcugaguuggucaaggcaaucucagagguaaagucaucccggcccugagaaacccaauauccgacauaaaaauuggaucccuaauuucucaagcucuaaauacuugccuucuagcagaccugccuuuuucauguauauuuggcccuguaaccugcaaauauuuacagaaguggaaaaaucuuacuaaagauaauccggaauuacagcagccauuauguaaaacguuccagaugaacaaaacuguuuauugaagaagugcacuugaguccugggcuccacaaauuaggcagagggaaugggauucuuauuggcauucaggauccucaaagagacaacaggauucccaaauagccuuuuauaaagauucauuauaaaaagcuaaugaaaaucuaaaaaugcaagauauuccccauacccuaucccacuuugucugaauauucaugaucuacuccagaauauucauaggcuaacacucugucugaacugccuuuuucccuugaaauagcaguuaaacaguuuccuuauaagaacuacccacaaauucaggagauaauccccaagugacugauacucccuagacagaaauagagcucagggccauaguucgaaaauuuccuaaaccuaggaaagaccuucgaaaguuuucuaaagaauucaaggucuuaauuguaacauaugaccucuggauaccugacugccaccaacuaauacacagguuggugggaccuggggaggcccaaaaaugaaugaaaggggcacacugcuauuuuuugagaaugauaggaaccugacuagucucaguggacuacuuaugggccaggcaaugcugaaacagcacaaaugagcuuuugaaagccauucccaaaguguuucagcuccauggcaaccaacaacccagaacaguuuugggacugcccuggagcacuuucuaauaggugacuccgaaaacaacaguuuccaaaaaaucguugccacuugugcaaacaaccaggacacuagaaaaggggcugucucaaagauuuccaagaaaucccuuaaaaacagucugcccaaccucugaaaauggucuccauguuaaccaccaggacagaugggccucugagggaagcuucaggagacuucuaccuaauaugcuuugcccauucauuaguagccucuacccccuaagucaauaaucuaaugaagaaacaaagcugaaaaguccaacucuggaacuaaaccugucuuuaaaauacaauuuucugaaauuuaguuagcuaauuuugaaacucuuuguaaaagaaauuuacaucuauaaaggaaaucuccauuuguaagcgugucuccuucucuguacuuaaaccacuagaaacuuuugcuuugggaaaaacaucgguucaaccuucacauaacaaaccuuaccuuucuuuaauguacuuuuccuggccaucuugccuuaacugggccuuuaccccuucuuuguuuuggcaaauaauaguaucuagaucuaaguucuguucauuguuuaccuuguuucauuugggagccaucccuuugagacugcaaauuuaggguuccuagcuagcaauuguuuaggacaauggaacagguaagcagaagauugacaaaggaaggagagaacacuggcaaaugaagaaucuugucagaucugcuccuauuugugugucuguuugucuauaugucuguauguguucuguguaugugauauuucucugccaaaauauaugagagcucggauuaauuggcuuaaagaaaagugagugcuggccaggcgcgguggcucacgccuauaaucccagcacuuugggaggccgaggcgagcggaucaccaggucaggagauugagaucaucccggcuaacacggugaaaccccgucucugcuaaaaauacaaaaaauuagcugggugugguggcgggcaccuguagucccagcuacucgggagacugaggcaggagaauggcgugaacccaggaggcggagcuugcagucagccgagauccuaccacugcacuccagccugggccacagagcaagacuccaucucaaauaaaaaaaaagaaagaaagaaagaaagaaaagugagugcuuaaaucaaacauucuaucugaaagaaacagaacaacucaaaugacuuuugauccacauuaccuggguaaaucuuugguaaacaaaacugguuuaauguugcugguuuaaugaaaacaguugggucuucucaucagcaaaauaccuguguauuuaacuuuaggguuuuugcuuaggugcugacuaacauuugcauguuguaaaaaugguucacagggaaaacuugagaugauggcuaguuuagcucaaugucaaauaaaauguucauaaacagcucaaauauaacuguuaaaaugaguaaauuagguacauucaaacggccauaaacauuuauaaaugaauucuucauaguucaaaaaaucuuuuugguaacuuaaaaccuucaagugaaauuaaguaauagauacucauuaaauguuuaggucauuucuugauaaguuaaaauacuaagcauucaucauuaacaauaaguaaaaaguuuauauacuuugacaucuuguuuuuauaugguagagaguagcuaaauauauuugggucuguuaguaaacauaaaacaauuguucugugaggaaguuacauguuucuaguaauuauaaaauuuaaauccauaaaauauugguaagugacaaauaaaaauugcauauuuccuagcuuuucacaaaaaauaaagguuaaaauucuaauuaauauagcuaauuagaacuacuagagaaaaggaaaacaauuuuguaugcaaaauguacaaagaaaguaagauguguuuuuggugagaaaaaucuugagaagauagaaggauauauuuuauguuaaaaaagagcaauucuaucuaauucaaagguuauuuagagguuuucuucaaaauauagauuuaaggaggaaauagaaaaaaggcagaaaggagcaguaaauaggagagaugagaaaaaagguguaaguaugaggauuuguuuuugguaaaaaauuaaaaaguugaaaaagaguaauuucuuucuuuugcaugagagauaacuuuguguggucaaaauuguuagauaugaguucuaaauuucuuuucaaagaauuaaugucaguauguucaauucuuugccuucuacuucuaaacuuaacuuccucguaaagcaaccuuuuuugaucaccugcuccacccuaacucauuccgaccaccugcuccacccuaacucauuccgaccaccugcuccacccuaacucauuccuaucaccugcuccacccuaacucauuccgaccaccugcuccacccuaacucauuccgaccaccugcuccacccuaacucauuccgaucaccugcuccacccuaacucauuccuaucaccugcuccacccuaacucauuccgaucaccugcuccacccuaacucauuccgaccaccugcuccacccuaacucauuccgaccaccugcuccacccuaacucauuccgaccaccugcuccacccuaacucauuccuaucaccugcuccacccuaacucauuccgaccaccugcuccacccuaacucauuccgaccaccugcuccacccuaacucauuccgaccaccugcuccacccuaacucauuccgaccaccugcuccacccuaacucauuccgaccaccugcuccacccuaacucauuccgaccaccugcuccacccuaacucauuccgaccaccugauccacccuaacucauuccaaucaccugcuccacccuaacucauuccgaccaccugcuccacccuaacucauuccgaucaccugcuccacccuaacucauuccuaucaccugcuccacccuaacucauuccgaccaccugcuccacccuaacucauuccuaucaccugcuccacccuaacucauuccgaccaccugcuccacccuaacucauuccgaccaccugcuccacccuaacucauuccgaucaccugcuccacccuaacucauuccgaccaccugcuccacccuaacucauuccgaccaccugcuccacccuaacucauuccgaccaccugcuccacccuaacucauuccgaucaccugcuccacccucauuccgaccaccugcuccacccuaacucauuccgaucaccugcuccacccuaacucauuccgaccaccugcuccacccuaacucauuccgaccaccugcuccacccuaacucauuccgaucaccugcuccacccucauuccgaccaccugcuccacccuuacucauucugaucaccugcuccacccuaacucauucugaucaccugcuaucugcucuccccugacucccgccaaagcacuuacccugucagucucuuuaaauuagcccauuggaaguaguuuagccugugcgaucuaacccuagccaaugggggaccgacacagcaccaggggccacgugcgucagggauaagaaccccuuccccuccuuuguccaaaugugcacucgccauuguuccaucuguaagggcgcacccuucuauauagaaguaacuugccuugcugagaauuaaaaggaacauuuuauauucgagugcuauuucuuuuguggcaccaaaacuuuauauauaacaauauauauaacaaaaugauaaagggaaaaggcaaguaaauuuuuauccucagguagaaggcauaggacaaaauggaagguuuaagcaagauguagguuugugcaagauuaaucucaugaaaauaauuuuaugugugaucagauugacuaaaauuagaaaauuuaaguuuuuaaaaaacugagcauuaguaugaaaaguacacugaugggagggaggaguuugagccucuguguuagaacaagguuuucuuggagcauugcucugcccuuaauagaaaacugugggccaggugugguggcucaggccuguaaucccagcacuucuggaggccaaggugggcggauugcuugagaccaagaguucgagaucagccugggcaauauggugaguuccuaugucuacacaaaguuuuuaagaaaauuagucgagcaugguggcacaugccuguagucccaccuauucaggaggcuaagguggagaaucgcuugagccugggagguggagguggcagugagcugagaucacacuacuguacuccagccuggguggagacccugucucaaaaaaaaaaaaaaauagugaaaaguuuuucuuuaccuuuuagguagcuggccuaggaaacugauucuauguuuaaucaagauaauuucuugugcuuuguaucuuugaaaucuucugucacuuugguuuuauuucacagugaucuguguuccuaucugaucauguaauuuuuuuuuuuuucuuugagaugaagucucacuccgucgccaggcuggagugcaguggcgcgaucucggcucacugcaaccuccaacuccuggguucaagcaauucuccugccucagccucccugaguagcuauguaauuuaaaccuuggauauuugacaaacuuuucaaaaaacuuuugaccgaaauuaacuuuaggacauuccagaaagcccuggaacuucuaaaaggaacuguaaaacaaagagauuaagccaacaugggcuuaucgaauauuuuaaauuauaugggaagcacugucaaaacauggaaugauguuuagccuucgagugacaguuauauggauguguuauuaauagauguuccaaaauuguauaaaguuccuagaaaccuaugucuucauauaaaugcuaucagucauaauuaugguucacgaauaaccaaauuuccuugucaacugcauugccauagccauuuuaagccuugguguucauagcaauugcuuuauuccaaugccuuucugaaaguuacuugcaagcacuuacaaucuucaaguguuaugucuucagggcaguucauggaaagaauggaaagaaugaaaaaaacucugacaaguauauaguuucuaauaauuuugaguucauagcauuggacugaauuuccaaaacuauaauagcacaaaacugaugggcuugugcuaagcaaguucacagcaggaauuaauuacauggagcugggcacgguggcucaugaauguaaugucagcacuuugggagacugaggcaggaggauggcuugaacacaggagcuugaggcugcagugagcuaugaucgugccacugcacuccggccuggugacugaaacauacauacauacauacaagcauacauauauaaaacaugugccuaccauauguuucagccauuccaccucuggauuuaucuaagagaugugucuaagagaaugaaagacuaagucuuugcaaagacuuuuauaugaauuuuuauagcacauuuauguaucacaaccaaaaauuguaaacaacccaaaugucuaucaacagaugaaugaauccaaaagauacauaguugagcuauacuauauaucucaaccaaauacuacucucaauaaaaagaaauaaacuaugaauaccuacaacuuggauaaaucucaaaauauuuauacugagagaaaaaagucagacgaaaaaaggacacacuguauuauuccauuucuaucucuuaaaaauucaaaauaaucugcagugacugaaagaagaucagugguuguccggggccacucucaguaccaauuuacuguaugagucuguucucacacugcuaauaaagacauacccgagacuggguaauuuauaaaggaaagagaguuaauugacucacacuuaccacagaguccccacaggggcagcaccuaguggagcugugagaagagggccaccguccuccagaccccagaauggucgauccacggacagcuugcacuaagugccuggaaaagccacagacacucaacgccagcugugaaagcagccaggaguggggcuguacccagcaaagccacaaggguggagcuauccaaggccauggcagcccaccucuggcaucagugugaccuagaugugagacauggagucaaaggagaucauuuuggagcuuuaagauuuaaugacugcccuauggauuuuggacuugcauggggccuguagccccuuuguuuuagccaaccucucccauuuggaauggcuauauuuacccagugccuguucccccauuguaucuaggagguaacuaauuugcuuuugauuuuauagucucauaggcagaagggacuugcuuugucucaaaugagacuucggacuuggacuuuuggguuaaugcuggaaugaauuaagacuuugggggacuguuggaaaggcauggcuguguuuugaaaugugaggacgugagauuuggguaggguggaaugauaugguuuggcugugucucuaccaaaaucucaucuugaauuguggcucccguaguccccacauguugugggagggauccggugggagguaaaugacucaggggucgguuccccccaugcuguucucgugacagugaguucucaugagaucugauggucuuauaagggccuuuucccccuuuugcucggcacuucuccuuccugucaaccauauaaagaaugacauguuuacuuccccuucagccaugauuauaaguuucaagaggccuccccggccaugccaaacugugagucaguuaaaccucuuuccuuuauaaauuacccagucuuggguauguuuuuauuagcagucugagaguagacuaauacaggaacgcaguggcacaaucauggcucacugcagccuugaucuucuggccucaagaaaucuuucugccucagccucccgaguaggugggacuacaggaaugcaccaccacgcccggcaaauucgaaagaaaaauguuuguagagacugugucucacuguguugcuaaggcuggucucaaacuccugggcucacgugauccucccgucuuggccucccaaagugcuagaauuacaggcaugagucacugugcccaagccuauuuauuuauuauuuuagagacagggucucacucuauugccugggcuaguguguagcagcacaaucauagcucacugcaaacuagaacucuugggcuccagggauccuccagccucagccuccuaaccagcuaggaauuggcguguggcaccaugcccagcuaaguuguaaauuuucuguagagacaagguuuugcuacguugcccaggcuggucuccaacuccuggccucaagugauccucccaccucggccucccaaaacuuugggauuacaggcaugagccuggccaaauuauacauuuuaaauaugugugguuuauuuuaugucagucagaccucaauaaggcuguuuaaaaaacgaaagggcagcuaaaguuuucaaccgauaauuaacaauguguuuuuuucaagugacacacauuuucccaaacuuuugguuuuuugaaagacucuuacugagcagcuaaaaacaaccaguuaaugaacugccugucuuuaagaaacuacugucaucugacuuauccaaggcuauuuucaacuuagggaaagggaagcuuauuuuuguaagaaaauaauugcuccuccaccugcacucaauucauucucgagcaaaauuaaccugcugagaauaaggguguuauuuuacgugccuaaauugcuugcccauggaauucuugaaauaaauuauuuucacugggacugggcauccuuuuaauucuagaucacuaauuuaacauccgcucaucuguuggucuugaauaucagcaaccagugaguccgacucaucccaaacgacagcagauggccaggcuccucccccugcauccagacucacuuccuccuggugaaguuggcucuccagcaucccuuccaguacugggcucccagaaggaugccucugagaggcuuccacgcacaugaguguuaauuucaugugucaacuugagugggccacagggugcccggauuaaagauuguuucugugaaugucuguccucugucauuauuuggaaaagcuggaggaacacaggcugcagauuaaugaagaccaggacacagcaagacacugauucugcagcaccugcuguaaaaugauucacuccaggaagcacaggaucagugcaaauaagugcuguuaauaauuaacuacuuugcagaugagagcuggccaguuauaagcuccuccccuguggaucaaucaauaagcaauggaaauaaagcaucccuaaaauuauaucuauaggagaacaccguuucauuuuauuuuauuuagagcuuuucaaaaguacauuuuuuuguaaaagauaaccucucugugucuucuuuuaagugcuugauuagugaaguaugaaaauaucaacuaugucaggaaagcaagaucacagaagcggauuaucccacuugcaugcaaaaccaaggacaacaauuagagaagaauaugccucauuauguccaggugacacccaugcaaugcagggcuucucagucuccaaugggcacaugaaucccccaggaucuugucaaaaugcagauccuugccucaguggaucugggcagggccugggacucugcauuucuucaaggcaccgagugaggcugaugcuguuauuccacugacccgacaaagacuuacgaaaaugaggaauccugggcaaagagcuuuccaaccuaaggugcaccgugcagcgcgggcuuccaggacucaggauguucccugcuacagauggcagguuugagucccccaaaauguauauguuaaaacuuagcccuuagaauguauguguuugagucccccauguauauguuaaaaccuaguccuuaauuugaugguauuugaagguggguccuugggaggugauuagggcaugaggguggagccucacgagugggauuagugcccuucuaagaagagacacucacucgaaguucugccucucucucucucuccaccaugugaggacacagagugaagguggcugucugcaggccgggaagagggcccuugccagacgccagaucuacuggcgccucaaucuuguauucccagcuuccagaacugucagaaauaaaugucuauuauuuauacgugacccagucuguggucauuucauuacaguauuaggaacagaccaagauauucccuuuccaacaaucugagcuauccuucacuucuucccaucaccugaaauacaaaggguuaucacucagccuaugaugcuagaaaccgcagacgcucuaccuucggguuuaggagugccaugagcuaaaagcuccggccugcuaauggcagaggguaauuguggcuuccaugacuggguucaggaaaugagugccacuggggaccugugacugcagggaaagguaaggaaaugcacuucauucuauuaaaccucccggcugaagcguuugucuguggaaugcuagugaggaugcaggacacacauuaaacagcaucaagacuugcuucuagacgauuuucuccuugaagccuagacuuuaaacagcccugauguuucaggugaaggaucucuggggagcaccagcagcccuguggagcccucaugaugaagucagcacaacacaggggggcggggcggggguguugugucugccuggcacagccugguggcuucguggagagacaauguuuaacagccaguagcauaguaauccaauauucuccacuccucuauagaauaccugccaauaaugacaacaugugaacaaagaauuccccuucagcaucagaacuuuccauuagaaacacgucuaccugcuccugucuuugauaucucagaagcccuccagaacauucagcguguccaacuugcucugguuuucuggcaccaagaaagcucagguuaaagucagagacuuagcguucccacccacauuccagaauucugcccguguagagccucuaaugauaucacaucccucaccgcggcacuacagcuguccugcucucaugugcagguaagcggucacuccugaaguccugggcaaggaaaagaucauugagacgcagcuuccuccuucccagagcucgggcuggaagcucccagcccuggacagccaauucucaucuaauacccaaacucuccagccucaccuuaauucuuccagcucuguggauuagacagagguauuguauucaugaucaaguucuucucacagagacgcaaacccuuuucucuauaacuucacuccuggugccggucucaccuuuccuccaguagccugccuuucaaugacagcagcagcagggcagugcugagggcggccacccuucugagcacucaccaccugccaggugcagugcaaaggacaggccagaaggaccucugacaucauucccauuuugcagauguaucaguccguuuucacauugcuaauaaagacauacccaaaacugggaacaaaaagagauuuaauuggacuuacaguuccacauagcuggggaggcuucagagucauggugcaaggugaaaggcacuucuuacaugguggcggcaagacaaaaauuaggaagaaacaaaaguggaaaccccucauaaacccaucaggucuagugagacuuauucacugucacgagaauagcacaagaaagaccagacuccaugauucaguuaccucccccugguucccacaacaugugggaauuccgggagauacaauucaaguugagauuuggguggggacaaaccauaucagcagauacugaaacugaggcccagagaggucaaaugauguucuuggauuacaagcuagcaaauguaggaggcagaccccaaagcucacucuccaugccaugcuguagccugccuguauaaucaagugucucacugugcuguggucaggcccucagacccaacauccucaagcccccaaaugcuccaccagcaucucccuccccaggcccagcccagcagcccacaccccuccugaaauagggcuucccucugagccagcagaagaagugaggagggcaggaagcuccaccagccucuauuguaauuggaucuuccugcuggcaguucucggugacaagaaagggccagguggugcuuacaugcacugaggaaccacacgcucaaacacugccuccaggccccaacccagccgcuuccaucccagcacccugagcucagugucugugccgccugcaagcgcuccucgggccucagcaaaacauccuagaacacagcuaggugccacggggacuagagcugcagcuugagaaggcaccagucccaaaaaacucccgaaaaauacucuaaucgggguuuuguccauacuuuaaacuaguggaacuguuucuaaaaaaaaaaaaaaaaaaacuuuaaugggccccauauaacuuaauacauggacauucacaggcagacauauacacauacacacacuuugcccugccugguuucuuggcaucagcaauuucuuugaagagggcugcuccgcuacguagcacauuacagucagaugugugggcagcaaucaaauucccuucugccuguucuggucuagagagccauucccuaacuuuaccaugguauucacaggugacacucaccgcugcaggccuuucagccugagagugccaagguuagaacugcaauuuuggugcaucauucuggcaggugcugcagcagaacguagggcuuccugcagagaggagauggguggacacgcuguggcaccccugagacggugaagggggugccaugcaaggcugcugucaccaggaagcagaggauggauggaggcugcgccacaucccggacagcgagucugcugggagaccuggaugaaccagggcucaggcagagaggcaugggguuggggagugcuguaagaacaggaucuggagcccaauguuggguuugcagcacagccccuccucugacuggcugcauaguagggugagcccauugaccuguccagaccuggaucccuuuauuuguaaaauagggaagcaacuguacuuaucucagcguggugguucuuagugcagaagagccuggagcaccccagugccuggcccaccccacaugaggggagucagaaugcaggggugagcccaggccuuugggacuucuaaagcuccucaggggaaucccaccucggccaaugagacacuaagaggcuaaaaacuaaugcgugcuagcugccugugcuaagugcuggcagauguucucugcagccacugcagugagcaaggacccagccgcugucaccucgcugaaguacugugcuguagacagagguaggugugcucacuggaguaugggacccuugcgggcccucugucugagacgcaucuaacaugccaaccuggaugggugcaugggcaggcacugggcaucccugaccugggagacacuggggugaacauggggccaaggggguccaacgggcgcaccagggcuggcucccaaaguccccucaccccugugaggcugguuccuggacuugcacgugcagaaucuacaggacuuggcagcugguucucugcacuggaugagggacagccaggucagagggaaccccaagugcugggccggcaugacgaggaaaccgcuggacccuucacaggacacagcacgcgagcagcugcgauggagggagggucaguggcuugggccuccagagcugugggcuggugagcggcaggggcuccugggccacugcuccugucacuguggcucacagucauuacuguggacuuucugugaaagauguaaucugagaaaaaauggcauugucuguuuaaaagaaaagcagugcuuccugauuccuucuacuugcaaguguggacugagaggcaaagcuccuggcugggcaccuggacucccauccuguccaccccaagugcuucaaccccagacccagguccagguccaggucccgccuuguguuuccaauuucuaauugacucucagcagagcucucucucucuuuuuuuuuuuuuuuucuuuugagacaggguaucacucugucauucaggcuggggugcaauggcacaaucuaggcuuacugcaaccuuaacuucccaggcucaagcaauccucccaccucaccugcccaaguagcugggcuaauuuuuuuuuuuuuuuuuuuuuuuuugguagcaauagggucucaauuuguugcucagguuggucucaaacuccuggguuuauguggcccucccaccuuggccucccaaagugcugggauuccagguguaaaccaccaugccugguagagcccucuuuucacuacugguguaaaacaagucuggauuacuuuuauaauguuaaacaagcagggaacaggaaaaacacuacguauugcuuccguagaaauuaugucuuccuugaaggaaaugcuaagaacuuuuaaaggagaguuuaguuaaggguugaaagguuuucccucacuauuucuaagggaaauguuuaauagaauuucuguccugacauugcuuauuagugccuugacucucacacacacaugcaugcacacgcgcuccaauacugaaacacacucuaaucagauuuucgaagucugccccauaguaaaauccuaauuccuuuugauccacuguuauccacagagcuuuuacuuuuacaugcauauaggcugggcaugguggcuuacaccuguaaucccagcacuuugggaggcugaggcggauggaucaugaggucaggaguucaagaccacccuggccaacauggugaaacccugucucuacuaaaaauacaaaaaaauuagccgggggugguggcgggcgucuguaaucccagcuacucgggaggcugaggcagagaauugcuugaaccugggggggcggagguuacagugagccgagauggcaccacugcacuccagccugggugacagagggagacucugucucaaaaaaaaaaaaaaaaaaaaaaaaaaagacaugcauauacuaaccauaaccaucagcuuccuagaacacugcagccagccggggaaguggccauccuacccgggugccucagccuucagcuaacuuucuggaacugcaguuucuagcuguagguucaucaugagaaagcauuuccucuuccugacaguggagagaauugggaugcagugaaauggauugaucugaggugaucagcauggugaugccaccauccaggaauggcgguuacuuucacuccgaaccugcacugugagggguugaauucuaccuuccccagauucaugcguucaaauccuaacccuggauaccucagacugugcccuuauuugaagacaguuuuuaaagagguaauaaggguuaaaugaggugacugagauggacccugauccaacaggacugguguccuuaaagaagagaucagaacacagacauacacagagggacgaccaccugcaagcccaggagagaggccucaaguaaaccaacucugucggcaccuugaucucagacuuccagacuccggaacugugagaaaauaaauuucugcaguuuaagccgcccaauucauggcaccuuguuauggcagcccaagccaacuacgaggugagcauuuaaaacacgacccgggcgagguggggaggggccccacccauguuuucagccaucacaacacgacccgggcgagguggggaggggccccacccauguuuucagccauuccagacuugaccacaguuggggaucggcccagcccagcccaaucagccugagcagcgacagcaauggugacgcugcucugcagagauggcccugaggggcuucacggccaggcccugcgccccaacuguuggcccagaaccuggcccaccacucacuuggaccccagcaggccaaggggcugacucccucugagucucaguggcuccuuugcuaaaugggaguaauaacagcaccuucucagagcugccaagagaacuaaaugaaugagggccucacacaggcaagugcccagugucagauggcacuguuacccagccaggagaagggaguaguggggguagucacucucaccagaggguugcaaaggaaaauaauaaaucucaggacccccaaacuuaggcccagagguggagccaggcaacacccuguuccagaugaaccgcucucacuggcauuacucaucauccaacgccccagggacaggcaagaggccuacagcaucucugcagggcugcccugcagggcaaaugcaccugacagcaauaccucaagccugcccugaggaugacucugcauggcagaugugccugaguaugugugcugagcuaggacaucugggcguggccaacccagagauuuguucuuugucuaugauaaacaucugagcucccaccuguccuguggaacucgggucgcacaggggauugaggcccugaauuuuggguuaaaugaaggcuuccagguagaggucguucaggggaggguguuaagugaaaaugcuguagaaagugcaugcuguuuauaagcgguagugguuuuccuuuucagcccgccaccaccagacucucuccccucuguguaagccccuaaucaaaccccguguugcaagugcuggcucugggucucuucuucggccucuuggacuugugccuuccccacugagguuaacaggggugcagcacaacaugccccccgggaucacucaugaggacauuguuugcuggccacccauaaacaaggacaugccaaucauaacacaaagagcccggcacggcagcucacgccuauaaucucagcacuuugagaggcuaauguaggaggacugcuugagcccaggaguucaagagaaaccugagcaacauagugagaccuuccuaucucuauaaaaaauaaaaagaaaaacauuaggucugcgaucuaagucuagcuucuaaaacuaaagucuguuggauuccacauuaauaauguccacuagaggcuuaucuucccagcuacagaacaaagacaagacuccucccuccacccacccagagaugucugcauaauugacucugugcuuuuucucuucacacauugacuuugucugauguaaaaauguggauuuacuggacaccaacugaagucucacaggaaagugaccauucccuggcugccuaccugccccucuuccugugugccuccuccuccuuuaaggaaauguaugaauacuacaccuccugaaagccaccuuuuuuuuuuuuuugagacagagucuuacucuguuacccaggcuggagugcaguggcaugaucucggcucacugcaaccaccucugccuccuggauucaagcuauucuccugccucagccucccaaggagcuggaauuacaggcgcccaccaccacgccuggauaauuuuuguauuuuaguagagacgggguuucaccaugugggccaggcuggucuugaacuccugaucucaggugauccaccugccucagccucccaaagugcugggaugacaggugugagccaucgcgcccggccugaaaaccucuucagaaaucagucugugauuccuauuuuaccgggacacauccuaaagcuggcuuaacaaaccucaauugauugauacuucugccucagucacucauuucagucaucaaggguuacuagcuuucugaacacugacucagagccaccccaauuccagguucugggcuguggcugaaucucugguccauaggagauuugcagaaaagguagggcucucuccuccgaacgucccccacccacccaccaggcccugacgucucugaugcuugcggcagucugaucucagcuucagaacccgacuuugcacccaaaaccuuucccugcccacuuuuagcuuuaaaacaacacucaaaauccccgagagggguuuccguggcccacgcaggcucacugggccgagauggagaugucaaccucagagucuguccucgcagaauuuccugucugguggucaagaauccagaaugcuugauaaaggccggaugagcaaaccagcuauuugaaguuuuguccaaaacaaaccuacauccauaaugcuuugaaguuggccuucuuuaccacacaaaugaaagggcuuguuucucgccaagggcuggugccagugcggcaaaggucaguugugacaggugaguggaacgacccugaagaucuggcacaauuccuaaccuaugaacaccccggcaugcacccaaucccccacucuccggaaccccagggaagacagcguggccagcaaugacacucacauuucuuguccuuuuacaguuuugggaggcggggaacauaaggccuucugacagacacacuacugaaaagggcuuugugaaaacugacaaauugaagaaguuugcaggccugaucucagcuugguuaaaagucucacugggguucacgaagucauuuccuuggcacacggauuauucauuagcaauggugaaaaagcccugaauuaauuucgacacuaaacccaacugagaugucaggaagcccaguuucauccacaucccaguaggcaauaguguuuccugaagucgaguucuugcuuuccuuaaaggucgauuccuuuauaaggucugguuuaugugacuauaugaaacugcaaauguguucauggaucucugcugcuguagacgggcgaaacucuaaggaagcccuaauaccacagugagaaccaaaauacagccuuccacuugaggagcacucgcaaaccgaaagcauugcauagguugaacgagggaagcuggcucuuaccaauucacaaaauuaagauaacuccaaugucugcggaggugcucugacaggucuugcauugugcucuguggacacaaggaaguucccucuuguugaaagcugugcucacaaaacaagcagaagggaaaugacacacagcacagggccuccaccaagggacaaagguuccagaguccaaucagcagaaguggauugcgugggcaccccucacguaaugcaugggcucacagcagguccucaauagugagauuggaaacuccagauuccccuagggagcacucucuugcagagcaauccacuucugcaacacuauaucuuagcccaggagggaacauuuauccucuccuaaauuuagagauaauagaaagugacaaccuaauaaagcaauaucacuucauuuugcuuucuucuuuggaacauacacuuacuugcacacucacuugcaaaaauguuugcacucacaccugucugcauacacacucacacaaacauacacaccuaaacauccacacacacacacacacacacacacacacacacauauucacucacucaugaggagaugccuaguguuaacugcgucgaucucacauugucaccucuuccuacugguaaggaaaucccugcuccagaaacacacauacacacagaggaaguuucaaacccuuugcaacugcugaugcaauuaaacuacauuuaggaaaauuggaaauuuuauuaaauucccguuuuuuuuuuuaaacagugaaaauauaguuaaagagaaaaaaagcauuucacauuguacgcuaccuugaacagaauuaaaacaucuuacugcuuuggcugucuuuuuacuucuggaauaagaaaugaucauuuccaaccacacaaaaaauuuuaaguuuccacacaauauaagaagaucuuuuuggauaaauauuucagacuagccaaauuauuaucaacuucauggcauuaauuuauucauuuagaucagagguucgggugcgguagcucacacugguaaugccagcacuuugggaggccaagaugaguggaucaccugagguccagaguucaagaccagccugaccaagacggagaaaccccgucucuacuaaaaauacaaaauuagccgggagugguggcacaugccuguaaucccagcuacuugggaggcugaggcaggagaaucacuugaacccgggaggcagagagguugcagugagccgagauagugccauugcacuccagccugggcaacaagagcaaaacuccgucucaaaaagaaaaaaaaaaaaaaaagaucagagugcuggugcugcacucucuguacauggugauuuaauagacuauaaauuaaaggcaaagaauccauuaugaagucaccagaauuuaaaaaaaaaaucuucuucgggccaaacuuauauugccaugaaauaaacacaguuaauaugaaaaaacaugguaugucucaaauaaucauauuaccuacagaacugaauuucuaugaauauccacacuuguuagaauuaaaaauuuaaucuaaauaaaguuauuguauugucaaagucauuuauuucugucuuuccuguuacagauuuaauguccuucaagaaaauuaugagauuguuaaauuuaaaaacaaaaaugucucaguauaaauuaugagcuuguugacuauccuugaauguauaagagaaaaacauggaagccucuuuguaaaggcuuaaaacugaccgaucuaauuaccauacccaggcagcugucuuuauuuuccacuuagaugauagauuaugcugccuccuucaauuccacggccaauguagcuaaauuucauuaaagacuaacaacuugaaaagcuuagggaaaaagagacuuggguacaaaaacuaccuugcaaauuauacuuuuucacuucuaguuuuccugugauagagacaauuuuggaagcauguguagguagcaguuuuuuaaaaaaaauauuuugucuucuacauauuuggacuuuugaagucacuuucuaagcuucugaauucugucaaguaacuuggggugggacugacucuccuuuguaaagaaaaccgugcugagucagagccugaauacaccaggccccccagggacuggucacaguguauucacaaaacagaggggaaacccugucuccgccuuggcaucacugcugaccugacugugaagguacguguuuaagagcaguguuuguccagccuaggaaguuuccauacuccuuuuaucuuucuuccuuauuuggaacacgcaccacugugcacacacacacgugcacacaugugcacacgccugggaagagucagcagcagaucuuccugcaagccugacaaugacuacuccccacagcgcugcacagaggacguggguguggcugggauugugggcacucauccaaacagguccacccaagagacaaacuguuggaaacuauuuucucaguaaauuaacccacacagaagucaccucugggacggcucuucccgacacugacguguccucugggucuggacucuccagcuguucucaagcaggacagcccuguccccgccucaccccggcugaaauuccaacacucaucugacauuucauaucccuguuucugcuuucucgucuacaguuagcaccgaagacuucaaccgucuauccaacuuuucacauagaucauguaagcacuauggcaggaaagauguuccccaguuuugaucaaugcaccuccuagaauggcguuagaaacauaauaaaugcucaguacguaucugcugaaugaauuaaaacuuacaaaaaugagucuuugaaaacacugaguuuuauauaaaauuaucagucuagggaucuccuaguucugcagaaaugacaaauguuacaaaugaacuagaaacugcuacccacagaacaucugaacguaugcaccuucguggcagggcugcacgaaugugcaggugagagacagcagacaccccacgcaaaguggaggaacccgcuccgaauccacacugacggauggggugggggaggggaggcaccuugggagaaucuccugacuucacuuuuucuguuucucaucuauaaauuggugugauaaucauuaucucacaagauuuauacuuaaaauucugugaaauuguguuuaaaaauguuugcucuacuacaguugugggagauacaguaggccuggcgugcaggaggcugaacaaaugugagacauugccugacagugugaugcuccacacgggggccucucucaauucuuggauaacauccauucaacuccaacucuuacaucaaaucuuuacgucucaagaucucuguuucuuuugccagaagugaaauagcugggugauuuaaggucccggagccaucagcccggugucuaggccucgccuucagauucuggggucugggugggccaugcccaccgccuuccgguuuuuguuguagccccucaacacugcgcacuuuuucaaaugcucuucauuaaauacaacccuauuccgccucuggggcaccaucugacggacgucauucccuguagugccuggcaccugagaccucuccauccuggccuucagagucaguuucaagcuccucuuucuggaaccucccuugaccucucauggccccaaaccccuaacaaaagcccccuggacucaucucacugcuccauacugggcaucacuggugaauaggccugaguccuccacguauuggucccauggcuggucuuuagguggggugugugugugugugcaugcgugugugugcauacgugcguguguguguguguguguguguacccguuccgcacugcccacucccuccagguuucuccagggcuuggccugcuccacacuuuccccaucucucaguccgggguacccuggacauauuccugcaggcaacaugggcccucucaagcccaggcugcugcuccaugcacccucucaaagguggggcuccacggcgcugcugucuagagagcugucaccagucuucauccacugcagcgagggccuggcuccagcagcguccagcaacugcuccuggcaucuagcaaguucuuaugcuuggcaccucccuggcaauagccuccccgguccccaagggaaggcuucuagcaaguuccaccaguacagccccuaaguaccuuuccugccauccccaaauuuaaggcugugcccccugccaugguucagggguugggaggguacucuucccugagugggagaacucugucucagagccaggggcaguggcugucccuucaucagcuauucccauauauauauauuggagacagagauagggucucugucccccaggcuggagugcaguggcaugaucacagcucaccacaaccucaaacuucugguucaaaccauccuucccauucaaucccuugagcagcuaggaccacagcugcacaccacgauaucuggcaauuuuuuuucuuucuuucuuuuuuuuuuuuugagaugggguuucucuguguugcccaggcuggucuggaauuccuggccucaaacaauccuccugucucagccucccaaagugcugggauuaugggcgugagccacuguuccuggcuccuauauucuucaggguccucuuuauuucuuuuuuauuuauuuuuuuaaagauaacagcuuuauugagauauaauucacauaucauuacuucuuauaacccaauccccaacuaagaauucuucacaucagacuuucucugauugaaucaugugugguuucugucuccugacuggaccccgcuggauacccuaaguuccugcauuaaugacacagcccgcucuucuccuuaaccuaagcguugcaaaucacuucuaauuuaagugauuugcaaaggggcucccacuuccaacugaucauucauuaaacugguaaaauauuauauuguauuucacauaagucaguguacagauuauuaccaguucuuaaccugucugagacaagcuaacucaguauuacaaaaaaacuaauugaaacacagaguacuuaaauguucuuggcauuugugguuuuucaauugcugggguuuaaaagucaagagacuugcuuccuuuacuuucaguggggugguucauagauuucagaauauaaugcauaaaugggaauuuggauaccaaaaaaaugucuuuggaccuuuagggaaagagaaaaaaaaaaacccagaaagucgggggaaaaagguaauugggaccagaaugugcaugcagguaaagaauuuuggugcuaauaaaacaauuuuuuaaaaacccucagaauuguuuaggcuguuaguuuggccauuuugaccagaucauggcucaaagcuacuuccucagcauuccuggggcccugagaagggugacguagauguguuggucugcagccguccucgaguuucaaacaucuaacuuguaagcagcucauuuauauaaagcaccaccgagcuaugaagugcugcaguuauuguuuggguaaaaagugggcgggagaggacuguagauacgacuggguucagaaguugaagaucagaagauaggaaauggggaaguucuucuuuauuuuuuuugagauggagucucgcucugucacccaggcuggagugcaguggugugaucucggcucacuacaaccucugccucccggguucaagcgauucuccugccucagccucccgaguagcugagacuacaggcaugcgccaccacgcccagcuaauuuuuguauuuuuaguagagaugggguuucaccauguuggccaggauggucucgaauuacugaccucaagugauccacccgccucggccucccaaagugcugggauuacaggcaugcgccaccaugcccaguagaggaaguuauucuugagaguugaucaaggagaucuaucugcggcguuccccuaccugccaugccaagugugcaugcuccacccuccagugcuuaaauucugcuguauuuuccaccuugucugagguuucaccaguagauacucaucugcauuuguuuaaguggcacucacccucugugugcacaggcugcuccucucagaggugacauucgagcuaucagcccucugccugccccuaacucuagcugagaccccgggaacugagaggggaugcugucccuggcugaugucaguguuaguucacaucccugcagaggagacggggccaggccuaggggagaagcugagagugagacgggcucacgccccugacuuccugaagagagccggggguggggggugggcacgagggccuggggcgaggggguggcaucggauggggcccacaccuaucaccaaacccuggagcacagucauggagaagcugggcgccgccaggcugugccucgaggggccccuaacucuuucaccagcucuccugaucuaaaugagagcacuccauuaacaacaacaaaaaauacuauuuuuaauuuuuaugucugcuuugccuuauuccaaaaagauuugaggcagcucacaaaaauacacuuggcauaaaagaagguuaaaacacacacacacacacacacacacacacacacacacacagaguaaaugaggaaaucauggcggaaaucagcccgguuggaacagucaggcagacgccugccgcaggcaggccgggcgggcgaggugcggaguaccuggccugcugcaagugugucaggcaucucccccugugacggugaccgggggcaucuagagcggagacagggaugcuagagccccccacaacccugcccagccaaucgcucaccgccccacucccuacagugcccucgcugagguccacagacagcagagcccacugccccagggaagcccgaugggcuggugccgaggccgaugggggagggcacugucugauagaggaggaaaagcccaguggcauccucccugugaaccagaggccggcuuccccacccuucagggcaggccgacucagacuugcugucuaggccagagcagggcugggagaaggaggcuugggaggagaaggcucgggccaggcccauuuccuuguagggucuuccugaucucugagggcuccugccccugucaguucaccuggcauuagcaccucacacucccggcacagaccuggcggguggggcccuuucucccuggagcagggacagauguugggcagcccaauggagucggugugugcagcugucacacgugcuucccuccagccucucaccccucacccugcugcacgguggccagggcacaccagaggcaggauucagcuacgaagaccucgcgcugaacccaaacacccuugaggagaaaauguuccugagcauccuggugggaacaggccaugacuccugcugcguugccauuuaguaaaccagugaaacagcuagguacguguugaccaucagcugcucauaaauguuccuuguaacuuuacaggaacaaauaacauucugcgaaacuuagacaugcacaaaagaaaucagagucagagaaacugaauccugcuucccacagucacaggcgggucaugggcucagguaggucagggguccucucagacccucagacucgucuacuaggaaaaacagccuggucugacagacaggaaaaugcaggugcucugagccccagaaggcugucauggggacacuguguggcuguaaugccugcaaggcccuggaaacgugggucacuuacaagcuccgagaagccgcggaccaccugccgccgcuucagguuggucucuccauccagguuggcggucucgauguggcauagcccgucggggucacuggaggagagcagcagaauguccgcagggaagauuucguugcagcgaagacgcacaaagucucccacguggauuucuuuccagaaucgguucacguauuucuuuucuucccuagaaaacagauuuugauuaacaaaacucacgagacauuggucguggcuggaucugggugaugggcacguggggcucauauggcaauucuuucuacauuugcauaggcugaaaauuuugauaauaaacagguguuuuaaaaagaauauuuggccgggugugguggcucacgccuguaaucccagcacuuugagagaccgaggcgggcagauuaugaggucaggaguuugagaccagccugaccaacacggugaaacucugucucuacuaaaaauacaaaaauuagccgggugcgguggugcgugccuguagucccagcuacuugggaggcugaggcaggagaaucacuugaaccugggaggcagagguuguagugagcugaaaucacacuacugcacuccagccugggcuauagagugauauuccgucucaaaaaaaaagaaggaaaaaaaaaagaauauucauaccacugaagcucacucaaaguaaaagaagaaaagaguauucauaaaggccacauauuguaugacuccauugaacaagcaaaugcauagagacagaaaguggauuuguggcugccaagggcugggggaaaagggaguaccagucacagcuuaacggcaagaggcuucuuucuaggaagauaugaauauucuggaauuagugacaguugcacaacacugaaugcacuugaauuuuucacuccaaaaugguuaaaaugaccauuccuaggucuacacucagaagagcugaaagcagugacuggaacagguauagcaagccaauguucacagcagcaucacucagaauugcuaggagguaggauaauccauguauccaugaacaggugaauaauaaacaaaauggaguauuauccagucaugaagagaagugcuauaauacugaagacauugugccaaguaaaaugagccauucacaaaaggacaacucuugccgguuccacuuaauauaaggugcccagugggggaaaauucagagacagaaaguggauuaggcaccaucaguggcugagagaggcagaauggagaguuaccauuuuauagacacagagcugcuguuuggggugauggaaaaguuuuggaaauacguaguagugaugauuguaccacaccguaaguaucacuaaugucacugaaugguacacuuaaaaauaguugaaauggcagauuuuaugugcauuuuauaauuuaaaaaauguaaaaugguuaaaauauuaaauauuauauuuugcauguuucaucguaauaaaaaauaauuaaaacacguuaagccacguuaagccaaaugggacuuaaagugcagcagguaagggagauacuuggcaguuggaaggcccccuuaccucccagggacacauuccaagccaccugcuuagaacaacacccaauacagucagccugcagaaccuacgagucacuaucaacagauauuuagauuaaaacauaauuuuuagauuucuucuuuaauucuuuuuccuggaauaacaggcuaacuaaugucacaaaggucauuuguaagaguuccuugaaggcgguuuuggccauuuuuaaauaaguggaggaacauaaauuuaucugaacaagguauguuacaccuuggaaacauaccuuggagaggaaaucucauugagaaauccucuggguugccgggugccauggcucacaccuguaaucccagcacuuugggaagcugaggcagcaggauugcuugaggcugggaguuucagaccagccuagacaacauagugagacccccaucucuaaaaaaaaauuaaaaaaaaaauuaguugggcaugguggcacgagccuguagucccagcuacuugacaggcugaggcaagagccucacuuaagcccaggagaucaaggcugcagugagccgugauggcaccacugcacuccagccugggugacagaggcccuaucucaaaaacaaagaaacaaaaaaucuguccucugggugauacuguaaaagaguaaaaagcacuaaaacacauuucauguuuaccauaaccaucuuacuaauccucccauccuacaccccccauaaaacucuacucucacccgaguuccaagagagcaaggaguuugguuuguaucuggagguggacugugugggccacaucuaucagcucccugagcauuggaugagaaguauggagaguuugcagagcuaggaagccacacgccaauuuucucucuucuauuuaauuccccuguguggauuugagggaccccccccuggcaaaguuccagaggcuccuaggaaaccaucggcugcccuagaugcugaagagaggaguguccccugccauuuuaagccucuacuuuuuuuaaauccucuaauucaagauccaccaaaccaguuauguacaaagcauagcucuggggcacuacguugggaacaaagauacauuagaugaugcgguucugaccucgaaaacaaaugcaaggcaagcuaucaccgcuagagagcgcccuuuggggacuguggagucaagccccugaaaguguucccaaaguuguucuuccugagcuuacccaagcauuccucagagcugcuucuccugcugugacaagcucggucaccugcaggccauguggucccagcauggucaguccagggaaccaugggguccucuggccaugcagaggcucguuccucaggccccagcccgaggucugagaggaggcauggcaguggcccccauccccaggccguccagcuuacgaaggccagucggaccccuucugagcacagacaggaagcuaugaugacugagacacugacauaucuagccaugugccuacuuccuuuuccaaaggucaagccuugacuucaugucauuacaagcuuuuuuguccuucuuccuucucaugagcgucugcugggcuccugcagaggacacgaagccauuugaaagggccugucccuuuggaagaaaguuucccaaugcucagucacaguuugcucucagaggaaggcagccuaugcccaagcaucggcggggcaggcuuuguugcgaugggguccccaggagaccgggcaguccugggccucacccugggcggaggaggagagacaccgcaaggcacugucucuguucaguuuauguuaacuacauuccauguauaacucucauccaaaauaaagucaguuuccaucugcuuuguaaucauaaaacaauagcuugccugccccauccaggaggcuuuuaaaauagaaacuucaggggaggcaucugggcucugaaggagauuccccccugaggacccuccacacauggagagaugggggugccacgugcagaccucaggucacuguccugguuugugggagugggggaagggguuccucaugggcugcagaaaggacgcuggcuucuaagaaaaggcccuggccaggugcaguggcucacgccuguaaucccagcacuuugggaggccaagacgggcggaucacaaggucaggaguuugagaccagccugaccaacaugaagaaaccccaucucacuaaaaauacaaaaauuagccaggugugguggcacgugccuguaaucccagcuauucaggaggcugaggcaggagaaucgcuugaacccgggagguggaggcugcagugagccgagaucgcgccacugcacuccagccugggugacggagcgagaccccgugucaaaaaaaaaaaaaagaaaaagaaaaggcccugcaguccaugggaaucccuaccagggacagacccuggaagacucagauucaggagccccuuaugaaggaacagcgggacaggccccuccuuacugcagcagaccaaaaaggcaagagaugccucagggguccaaauccugcaaccacuccagcuggagcacccggcaaggagccugggcccacaucaacccugccaugucaccacuggcugcauuucccuaacagccuuuccuaauguccccugaacugugucccccgagagacuauuuggagagagaggcucuaaagaggauuaaaguuagaaugaggccauaaggcuaggcccaaaugcaauguggcugggguccuuauaagagaaaggcagcagaggcgugcgcacacagcuguaaggacagggagaacauggcgaggggaggggccucaggaggacccauccugcccacaccucggugucugacuuccaggcuccagaacugcgaggugauacauuccugcuguugaagucaccccaucugugguccacugccacggcagccugagcugacgaauacacuuaauaacguccauucucgugacucuggcuggaaggagcagcucacaggcuguagugacagaaacugaagggcaggcagaagcagugaguggcaggagaggcaucucacccugcaauuuauccccaugcacagguucuacauacccccaagacagaaaucgagcccacuggcacaacacucuuaauaccagccacucaaccacgcccuucuugaggcuuuuaucagcacggaccucuagagacaggaagaacggcuggcuggggaagucuggcugugcugcugaagaggacaucguugaaugggcauccaguucucuggcccugguggcuggaaugggggcaccacccaccucgcccaggggcagggucugcuuggagaagggacagaguccaacagugaccaacuuugaguucaagaagcugguggggcugugcgggguccggucuccggaggugucuccagcuuugaagacaggcagauggagacagaaauauuugggggucuuaagcacagaggugacagcagcccccacuguggaugucaucacugagagcaccagggagaaguguggggagaaggagagcugagggcugagcacaggccaugcaggcaaggucgugcccaggcggggaagcuggcguuguggcugggggcagagaggugccacgccagcacacggcaucagggugggccagggcugaccacacagggcccggaggacacaggguuccugggugccugccaccccagccagcagccacaggucugccuccacaccucggccuucaccucccacggccgagugaacacggcuggaaggacaucucgaaugugugcccgucaccaccgcaguuuuacuccauuuuuggagacaguaacuuccaguggcacauccaugaaggcagacaguccucuugcgcaucacucaagcacauuucaugcccagcuguagcaagaccauguagucuuuugaacgacagaacuguucuucagaaguggaccuccccuacaaaggccauggacgacuaagagcuugggacaggucuuuaggccacaccagcaggagcucuagacgcuaaauuccucucagcauugagacaucauuaucaucuuuuuuuuuuuuuuuuuuuuuuuuuugaggcggagucucgcuccaucccucaggcuggagugcaguggcgugaucucggcucacugcaagcuccgccuccuggguucacuccauucuccugccucagccuuccgaguagcugggacuacaggcgcccaccaccaugcccagcuaguuuuuuuuuuuuuuuuguauuuuuaguagagacgggguuucaccguguuagccaggauggucucaaucuccugaccucaugaucugcccgucucggccucccaaagugcugggauuacaggugugagccaccgugccuggcccauuaucaucuuaauuguaauaacaacauuaaaaaaucagcaaagcugugcuggauauccuauuaugacccaggccugcacagaacauuucacagucucucucagugaacccucccacgauccugacaguauguucccacuuacagacauggaaaccaaacgcgcagagacugaccucccaaaagucacacaaaccugggugacuccagggucugggaagccuuagagagauuugguuuugaaagcacaucugaucugguagccuaaaggaggaauaucucaugaagacuauaaagugcuaagcaaaaaaguucuuccauuuuucccuuuaaaauuaugcagugcagagacuaauguggucugagauaaaauaucacuaagcuugagaaacgguggaggccaggcauggugacucacaucuguaaucccagcacuuugggaggcugaaguaggaggaucauuugaacccaggaguucaagaccagccugggcaacauagugagaccccaucucuccaaaaaauacaagaaugagccaggugugcuggcacaccuugguccgagcuacucagaaagcugaggugggagaaugacuugagccugggaaaguugagguggcaguaagcccugauugcgccacugcaguccagccuggaugacagggcaggacuccuucuuaaaaaaaaaaaaaaaaaaagaagaaagaaaaagaaaaagaaaagaaaaaggugggaggaaaggcagacaguuccagauuugugccaguguuugacacagacauggaguaacacaguucaguccauuugccaaaaccacuuccaaugugcaaacaacuggagggggcuuguccaagaucaggagucaccaaacuguguuuuuuuugcuacaaacugggaagugcccccuacaucggccugcauagaugagggaugaacuccucccucacugguaccaccugcaguugggaccaucugagguguggccauagaaggacacugcccucccccaggaucaccuuggggacuucccucugggcuaaacaagccacugagagaguucccgcuagggcaggguagcuguuuauuccccuggcuuuaaucaggcugauuugguggcuuugagaggugcucccaacgugggcagggcacaccugacacuugaggggccccagccuggccaccugacaaguuccuucugcacaaagccgccacacccuuccucacaaaaucccuccugcaggaaacauguaggagcagcacuaaacagcuggcuuuggaaugaucaauaauuaacgagggugcuucacaucuggccacuacuuucauuuagggucacaaagccacggugcacacacagucucaagugcauugaugacucauccccaguaagacagggcgccagcccagaagccuggacucugagugcccgaguuccugaucugcagaacgggggucuguaggaucgcuacagucucccccagcagacacugacccauuuccccguagcccucugcucccgucccacccgcuucacgcucuucuggcugucaccagacugucaacagugacuguucaauuaagugagaggccguggccacuauuuugacuucacaucuccuguuuucuuuuugagcaugguuuuuccucacuauuauuguugaagugagugucugauuuugacuaacacaaucagaaauaguacaaaugagcagcguguuauaucuugucuuugauuugugguuuggaauuaaaacaagagcuguuacuuugauuuuuuuauuagaaagaugguaagauugcuuacaggauuuccaugaaauggagaacacagacaguacugcuugaggugcggugguauauaaaauaugauuauguguuuaguaucauucuguauuauuucauuggaagagaacaauuaaucccuacaaagagaaagcuccaauuaaaucuguguuacauucgacuaaaccuagaaaaauccggaugcuuugugccuuauagaugaaacagguaauguguuauuuugcggggauguuuguuuuugagacagggucuugaucugucauucaggcugcaguacagggcugugaugauagcucacugcagccuccaacucccagggcugaagggauccucccuccucagccuaccaaguagcugggacgacaggugugcaccaccacacccagcuaauuuguuuuuuauuuuuuguagagaugggguuucaccauguugcccagacuggucucgaacuccugggcucaaauauccaccugacucagccucccaaagugcugggauuacaagagugagcccccaugccuggccagaauacauuuuuuaagaaaaaagaagacauguuaaugaaccuaacaugcagaccaacuagauugaggccucccaagugaggucagccugggggacuccuuuggccaacuaacaggagaaguguguaacacuuuaaacaaacagcaaaugugaaaccaggacacagugaggcgagcccuaaaugggaggaucaccacaagagauccaagaaucuuguggaauaaucauuagugccaaggccgaugccuugggaauaagaaaacccuucuuggaauuuauuuuucauaugguggaccaauaaagaagugugugugugugugugugugugugugacagagacagagagaaaauaauuuuacaucacuuaaaaaagaccaaacaagacucuaaaauuaucgcagauuucauauacacucauuauacaucaggcagagaaguagaaagcccagaaugccagcaacaauagcuuucaaagguuucuccgccaucagcgcuguugagauuuggggcuggauauccuugaugguggacagcucugggcucugcacuuugcugagcaccauccccagccuccuccuauagaugccaguagggcucccucccuacaaguuguuacaaccuaaaacagcuccaaacauugucaaaugccuccugggggugcaaaaucgcucccgguugagaaaugcugcuuuaaaacacccaggacaaagauucuggaaaauggauuauuaaguaaauguuuacagaaccaauguauuuuuaaaaucaugaaggugagaacucagcacugaaacagcaauggcaaaauccgcagugggaacgugagccaaguauguugcauaacgcccagaaugugucuuccuuccaccauaaacugaaacaucugcuccuucagugagacaugcuaauggauucugaaucuaauacuaaaagugagaggcagugagaaaugauaguuggagugcuuuuucuggagugaaucuucugauaccaaaauugccaaaaauacaguaguguagacuagaugcacaaaauguauuuucugaacuacuuucuauucuguaugucuccucgaggugaugugagcucuaagaaaugucccagauguguggaagcacaugugugcauggagcagacugcucaaaugagucaagcugaauggaaaauacuggucgcucugugguaagucagaaagggcugaauguugucccagcggaacucacccccagagggcagggccucuggccucuuuuuagaaugaagaaaggaugcagagucucucagcccagagaaagugacacaccaugcuaugcucacaucacauaauuacucacuacaaugcaacacugaacacccagauuaaaucuauuuuccccaggaaacacuaguuugcgaaagcaaaacgaugccuaaacacaguaucacuuacaaaccucuuaguaaguuuuaacaugaaacuuuuuuucugacaaaucauuucuacuguggccuuuucugcauauaaugguacauucucaaaguaucuuaguagaccucaagacaucucaauaauacugcccacuaguaauggauguaaaacacuccggggcacuucuagaguuuucaagguaauuucuuaugcauuaauucauucauugguaugacaaucccaggaaaugggccggaguugugcgcuccuuauuccuacggagaaguuuugcauuguaaauauuuuuuccuaagaggcuguaacaauucacacuccuccgucaguaucuaagagucuccaggcccuuuuuucugcaaaaccagcugcuucgucuuuuuaaaaccucccugcaaguguuuuuuuuuuuuuuuuucaagacccuugcucugucgcccaggcuggagugcaguggcacgaucucgacucacugcaaccuccggcuucuggguucagcaauucuccugccucagccuccccaguagcugggauuacaggcgugccccaccacacuuggcuagggcaggacaucuacuuuucuuuuaaugugcaucucccugccacccagaccacuuggcaggcuccucugugaauuaacucugcauguuuccccuucaaucuuucuuuuuuucuucuucuucugauuuauuuaguuagagucaggguuucacucugcugcccgugcuggagugcaguggcacaaucuagcuuacugcaguggcacaaucacagcucacugcagccucgaccuccugggcucaagcaaucuucccaccuuggccucuggaguagcugggaguagcuaacaugcaccaccugcccaacaguuuuuuaacuugguuguagagacggagucuugcuauguugcccaggguggucucaaacuccugggcuccagcaauucucccgccucagucucccaaagcacugugauuacaggugugagccaccgugccuggccucccucacuuuuucuauuguauucuuuccucucuucuugaccacgaaaccugugagagcauucauauugaaaauauuaaccccuuuucugucuuuugcuuuggaaauauuuuucucuaagagccaugguuugucgguuuuaacauuucuaguuguagcauaauuuuguuauauaauccuuucagauguuuauauagguaaauauaucugacuucuccaggccuggcuaagacagucaccuaugucccuguauuauacauguuguuuccaaguauugcuuguuuguuuuuugugggaggagugcagaguauuuuuuuuuuaaaacaaacauuuaaauggucaaaccaacugauguucauuuuccucuguuacgaccugagcauccaaugcugcuucuuccagacagccaauugugucaauauugcuaacuaguucuuuucccacugaaccuacauacccacucuguuacagauaauaucauuugauuugggcuuauuagguuccauuaaucuacuuguccuuucucaugucaaccccacauggcaugguaguacaguauguuggaucagugccaccauuagcuucagcgcugagaggagucuucaugcaaagguaccugcucaggguggagcccagagacagggcccugggccagcacacuggggagguccugcucugcucucugcaaagacaguggccaccagcccucccccugccccagccagucugaggucccauagccaccaggagggcuuaggcgggaugccccaaagccucaacaaacacccaugcaggucauuugucauagaaaagggggccaaccccagacccacgugggugacagauguugcauguauuuaaaugacccugcaaaugcucccggggguuagauggccuacugcagccucuauguggauguccaaccccaaccccccaagcacuggccuggugagggugaggcccgcguuuagaauucagaucuuagagcacgaagcacgcacugcaccaggcaccuccagaguguuaauucaccuccaggagacuuguuuggaaugucaauuuuguugcuuugaguuccaucuccccugccagggcagggcucucaucgcugagaccaucuuuaccugcacaacuucaccugcagccccaguuccaauaucuguuacaaaaaguugcuccuuuucaaucuuuuuuuuuuuuuugagauggaguuuugcucucguuccccaggcuggagugcaguggugcgauccugacucaccgcaaccuccaccucccagguucaagcaauucuccugccucagccucccgaguagcugggacuacaggcaugcgccaccaugcccagcuaauuuuuguauuuuuaguagagacaggguuucuccauguuggucaggcuggucucgaacucccgaccucaggugauccacccaccucggccucccaaagugcugggauuacaggcaugagccacugcaccuggccucaaucuuauuuuuaagacugucuuggcucauuuggaggcaucauaaauguuaaggccauuuuauucaauuccaagagaagccuccagauagaaaugcaugcagcucuugggagaaugagcacugcaaucauaccugcucuucccaucccacccagggcccugggagaugcugcagugccucaugcacacuuacacccuuuaaaaagauaucgccacuuucuucauaaagcuccuaagccucuuguuaaguuucugaguacugugcaguuuuuguuccuauuuuuguagaccaccuuccccacuuccccuucuaagugcucauugugcucccugagugauuauaaguaguucucuguaaguggccacaggucuuccccagcagcuccacuucgcugggugugaguucuguuuguccaaacccucuuccgcucccuggcagccaggacccugcggaugagugguuacuauuuugguuagcauagcaugcuugggucagcuuucuaaagugauggcagaucccuuucuuagaaaaggugaaguggccucccaagaguugugggcacauaacuucccccaauccucccucagaagcaagggaaaaucagccuggggaaccagggcauccagucgccuuugcaugcacaguugaccucuuuuccacuggaggcccccagaccucugcaagcccaaguuuccuccaagaugcucugcucugugggacucaccccaggguucuccgaugccccaccagugcugucuagggacccagggaacccaaguccugccccagaugcccagggauacagcagcuaccucauucaggauguguaugggagggagagaaggguuuuguccaggacaccauuuccccagaguccccugauuccucuaaaucagaauucugaagaugaaaaggcuucacugauuauaaggucccucucucucauuuuucauuaugaggggauuaaaagccagacaggcagauugauuuucucacucaugugaagguggcagccugggucaaagcccucagaugugccuuucccugaggcuucucuugcaacaacuuacugaaagcacucacccuccgaucagucccuuacuaacaucacccugcccagaggcuggcuucuccuaccacgcagaauuaaaaaucacaaagcaaccucuuuaauaaauaaauaaauauaagaagcaaaaaaaaaaucucuggaaauaucuccaaaaaauaucacaauauuucuccauaacauauuuacugcaaauaucccuaaauuguaaugggcuacagaguaugaucaguaaaguaccuuaagcaaacaaacacugccccgucuuggaagauccagcccugggaauagaggggacuuuaacacauggaucaaaauauaccauggagacaugauuucccugggcacagugugcagugaccuaagacaccuuugugaaucccggcuuggaagccgacgucaauuuucccagucaagcaucaacagcagcagugcccucgcgaaacugacuuuacccgguaauauuccgagaauggauaacaaggcugaaacgcagaacuaacuacaaacugaguuuuccuccuuggguaaaauacagugagaagggccaugcagauggucaucuucucuggaggccacacacguggauuccacaaaggccauugcagggucauugucaccagucagucuuggcagugucccuggaaggugugccauucccauuaucaggaugaagaggggguugagucaacguccaaagacucacagcuggaggucggaacagcagcucuaaggaaggcccaaaacucaacuggcucauaccucccaauuuuagaguauuugggagauaggaagugcugagaaaugggcauugcuaaaucacagugguucucuccuaucuuuauuuaggaaaaacaauuguuuuuucuuugggaaaauuguguagguuacaacuggcuauaucccagguaucuuaugugaccgcgcaagcauacaacaaugagcagcgcccccuucugagggacugaaucagccagggcauccccaccuucucagccacacagcccacagccacacagcccagcccacaggacaccaccguccacgugacuaagacacaggcccacggagggagggccugcgccaacuuggcaccuccaguccgauguuuaacaucuaaugaauggcgaccuugggcuuucccugccaccugcugagaagagagagugacagccucuucccuacacucugcccaaugauuugagauugaauaccuuuccuauuguaaauaggaacaagaacuguuuuaacauuuuuggauuucugaugaagggaauaacaaccuaaugccacagaaugagcucugauuuugguuuuagucauauguuaugacacuuaugcuuacuaguagggguacuugcuuucccaaagugugccagacagguacuagcacuaagacaucugucuggaaguauuucuuuagauaucauuuuauuccuucacucugcaguccuguguaauaauacacacugggaaaauuuugacaugugcuauaguguggauguuuguccccuccagaccucugcugaagaccgauccccagcguuagagguggggccucaugggaggugucugggucguggggguggaucccacauggauagaugauugcccuggggguguaggggaugugcgagaguucuggcucuauuaguuccugugagagcugguuguuaaaaagagccuggcaccccccuccucaccccugugauucugcucgccucucccuuccccuaugagaggaagcagcugaggcucucaccagaugcagaugcuggugccaugcuuccuguacagccugcagaaccgugagccaaauaaaucucuuuucuuuguaaauuauccagccucaaauauuccuuuauagcaacacaaaacgaacagggacaacaugugaaaauaguuuguuucagggcuaggcguggugguucacaucuguaaucccagcacuuugggaggccacggugggaggaguucgagacuagccugagcucuauaaaaaacagaaacaaaauuagccagguguggugguguaccccuguggucccagcuacuugggaggcugaggcaggaggauugcuucagcccaggagguugaggcugcagugagccacaauagcaccacuacacuucagccugaacaaaagagcgagacccugucucaaaaaaaaaguaguuuguuucagagcuuauaaauaugaguguggcacuggccucuuuaaugcacacugccauggucuaauuauggccugugugcaugcaugcagcaaugcccgagcagcuggaguuggaaaagaagccuccguucaugcacaaacgugguacucaugagucaucggggagcugcuagcccaccucacaacguggcuucuucccacccacacugggggaccuucucccauagucauggacccuccacaggugaggcagacaucgucagagccacauguguccugggcaggugcuaccugccuggaaccugccggauaucccucugggaugggucaacuaggccacaggacaaugugacacuugacagaagguggugacagccguaauuugagcuggccuuguagaggccuuccuccuuccguagcuuuggagauguuuaaaaaauuuaaauuuuaauugccaaauaauaauuguauauaguaugaggcacaaugucauguuuugauacauguauacacugugguaugguuaaaucaaaccauuaacaucucacauaccgaucuuuuuuucugaugagaacauuuaaaaucuacuuguuagcaauuuugaaauacacauugcuauuaacuauggucacugugcuguacaacagauccuaaaacgacuccuccugucuaagggaaacuuuguauccuuugaccaaaauccccccaagucccuuccaaccucugguaacccccauucuacucugcuucuaugaauucaacauuuuuagguuccacgcguacgggagaucaugcaguguuugucucuguguggcuggcuuauuucacugaacauaauguucuccagguucaucugugcuguugcaaguucuaguaaguuggaaauguaauuuuuucagaaaagaauucacaaaguacaugucuuugugaauaaggacuccucaguggcuugaggacaggcuagcccccucagagagaguccccugaggccagugccaugguggcugcccuggccccuggccccugcccccaccccacccuuucagagguucugugcucccuugaacucaauucuuccugacuuucugccacacuuuuccauuuugugcuagguuuucucuuagaaauuacagacucucuacauacggagacaugacacgcucugggcuccaggugccagugcugcaggucuggagggggcucaguggauccuugggccccuccucgggggacagccauccaagaagggcagcccagcuccacagcacgcagauccuucucugucaccaaggucagagcugggacuccucuggcugccacucuuuuggggcaggcacaucaccaggagacugccgcccuggggggugaggguggggagagagaccuucagcucugccuuuacccuccacgugccagcacagccaugcuacccgaucucacccugggcuggcuccucgucuaugucauauccuccagggacaucuacagggauuaaacugaaaguguguuacccagagagcacaauaagaaguuguccaaggagagaguuaaauguaagacuucuguguuguuauagacuucauuuuaagcuucuuaaaaauauaacccuugcaaaauucgucagggucacaaaucuggaauccggccuaguuaacuggaagagggagggaggcccuggguugcauucagccagcuacucccaucacuggaguuaaggagcuccucagcuucacugacauaggcagucucagcaaugagagcccugcccuggcaggugagauggaccccaaagcaacaauaucaaaacuccaaacaagucuccuggaggcgaaucaacacucuggaggcaccuggugcagugugcgcuucaugcuauaaggucugaauucuacauacaggccgcaccuuccccaagccagugcugggaggcgugggggaaaccagugccuguccagcccucccccugccccaggcagucugaagucccauagccaccaggagggcucaggcgggaauccuaaagccucagcagacacccacgcaaguccauuugucauagauaagggggccgaagcccagauucaucugggugacagauguuguguguaauuaaaugacccugcaauagcuccugggggcuuagacagccuacugcagccucuacguggauguccaaccaaauggccagggcggcacaaggcagcaaagauucaaguccacagagaaggcacgcucuuuuccugcgggcacugugccggacucccaucuggugaaacagcgcccaggucuccacggcugagugaacugggcaauccucagacacugagagggagaacaaacugcagaccguggggcaaaaccgauucugugauucuguuggagcugccugacagcugugcccgugucccuucacuccuccucgggagggcaccgugcgccucccgcauccaccagcccgguacagggaucccacucggaggcccccgacuggcuugagugguuuacucuguguccccuauagaagaaacaaacucccccguccucauguaacggaggcuaugugacuuuaaaaaacaaaccauaaggugccuguuuggccccucccuuucucugugccuuuccuuccucuucccaugccugcuugcccgcaguuauuuugguacaggggcaucacuagucaucgaugacuucacauccuaacucgggggccauccgaaugguuacggaacuuguuuuucuuucaaaaaacaaugauccuucggucacacagacuucccugauggugucugguuugacuggcccagaaaggugagcagcuuucauccugggcucuccccucucacaucccugccuuccucauaaaaacccccguuauguccaaacgcaggucggauuugggagcucgucucucccggccucacauuucuugcuccugagcgcugauguguugggugcucaaauguagcuucugggaauuuacagccucuaaaggcuggcacuacaaacucaggggugggcagcccggcccaagcacccuaaacucagagaugaaccaaaaugguguucagcaaaauuccucacuaagaauaaaaacaaaacaaacagacaaaaaaacaaaguuaaacuaaauaacauucauuggcauguuccacaaagaaauaaaauucaagacaggcauggaagugcacgccuguggucccagcuacucgggaggcugagguggaggaucgcuugagcccaggaggucgcggcugcagugagcugugaucacgucacugcaccccagccuaagugacagagcaggacccugucucaaaauaaauaaauagaaguaaaauucaacaaacccaaaguacauauagcuucagggcaucacugugagggaauccaguccaaacacaucaauuuauaaugaaguauuuaucaacugguacauuuauaaauuagguaaaaguucuggaauacaauguaucucuuccuggccaacaacaacaacaaacccagaaaacccaacagaguggaaacaauucuucacuaauaggaauuauugauggauaccuccaacuccuucucagucucaggaauucuaaagaaggaggaaaagcgacaaagaaccuugucauuagacaccaaacucgccugggggccagggugaggcaggagaggagcucacaucaagugcaaaacgcaagggugcacgcaacagcucagggaucaggaugaacgcuauuuuaaugcaauaucuuuuacaaaacaaaaggagugaacaaauaucccugaggaagaaacauugacauuuaaaauaaagacagaaucggcauugcugaguuuucuuuggcugcagguucccguagggcuucagugaguuuucuauguccuggacaagauaagccgcuucccuugcucuccuuggcccaccccacaccaacugaacaccccaagaaccauuuccuuccuucucugauauccgccuguccccugcuccugccuccccaggggacacagcacagauuucugccucccaagugccucuccucuccugccugaguucucaccugcccuccccuugugacccagcgguugcagcugggagcugaccacgcuccuucacuccacgcgugccugcugggcgcugcugcucccuggcacuguuccaccgugcaccuucccggaagaagcuacauucugacacggcaauuucaaauggggcaaagugaguuuacggagguacaagcaccaggaggaaacacgaacacuugaagauguucaugcaaacucagcuuagcuuuguguggaaaggucuguucagcccccacucugggggccccugaggcuucccaccuacccuaauuucaaaagcuggugcucacaguaacuauuuuaaccaugucuuucugacuucauuucaucuauuauuuuuugguuuaacuuuauuaccaauauuacaacgacaucaggaaccgaguucccauagaagucaagccugucucugucacaucuuccugguguuugaugaacccgcuguacuagaugcugacgcugcuccuggcucacugucaugggguuugguaagucugcuccagaugaagggaaaauauguuuuccuuuuacaaaacuaaaagagaaagaccuuuggggugacagccucuccucugcagaggagagcaguuaggugcacaagggguaucccaaggcugguuguggggucuaugcccccauguguauuaacccacaggcuguccugugcaugcuggaauuugaggacaugugcuccaaaugcccaaggccacucagccagcaucaccucgaggcccagggagagcugaugcagguguccaggggcccuuccacugcacuuggguucggggcaugagguggaccagcagagaagaggagcgaggggugggagccagacccccaggguuacacugcaccagcacuuaagaguucacagccaaucacggcucugagccucagcauccccaucugcaauguggggauaacacuggcaaugccuguguggcaggugguagucagggggacuauguuaaggugcaugcagcgcuuagcauccugcgucaggcagagcacugagaaugagggcggacgagaguccugggggcaggugcgaugcucacuccuggucaacucuugggcagccaauggccacuacgcugagacuucaauuugcuaagcauguuacagugguuuaauccggugugggacagcuucgcuucaggaaaaacacacuuuccagcuuucucaagccccgugacgcugaugugucucugacuugccuggccugcucuggcuuugcucagcacugcugggcaggaauggcaucacagcccaccugcuggaaggcccccgugccagucucugaaccccaauggauguaucugacagcauacaaaagccccaugucccuaaaccuccccaguugcugacucguuacauggauaacagauccaggcggugaacagcuggccaccugcacccuacagaaggcuccacaccucccuguguuccagagccgaggaucucaucaacuccuuuauguuaacgcggagaacacgagaucugcaggacaagggcauguggccuacuuggguuucagcaccaaauacaaagccaucuuuguucucccaagagccuuuuaaaauaauuuuccuguguugacucgguaaaauguugcuuuugggccaaaacucuauuugggaacucuccgucuggacgcuuuucuucuuagaacagaacagaaauugggcagagugcaccguggaaacacgugcgugugccugcgccgcagcacagaccgagcuguucucaacgucggaaucucagcccgaggcuguggcacccagcuucaguccuugcaaaccuugaggaccauguuccucagcaccucccacugcaggcuuuuuguugauaaacguccagcagguucucucaggcccgugagccucccuguuguaggcuggggcuacccagaccuugcguguuguguuccgaccacuaggcccaugaacucgcuuccuggggcugcaguaacaggucaccacaaaccuaguggcugaaaaccacacacguuuaugauguuaucguucuguaggucagaauuccaacacagggcccacucagcuaaggugucggcagggccacgcuccuuccuggagucucagcggagaguaugcuucccugccucuccugguuucugcaggcuaccugcaugccucagcucacggccggccgccuucucugucuugaaagccagcaaugguggcaagucuugcgcacugggccaccggcacucugguucccucaucugacacuuucuuccaccuuaaggaccuugugauuacacugggcccacccagaugauccaggagaaucuaucucgaggucacugagaagcuccugacuuccccuuugcccuacaaccuaaaacauccaucaguuccgaggauucggauguacacaucugugggggucauuaaucugccuaaaacaaaucaugaacagaauuuaggugaaacugcauuuuacauaugaggguguggccaacaccaguagggcugcuguuuuagggguuuugccuagaaccuaguuuccuccaggugcucuuauggccaagggcugagucuuugugaggugagauaauuccuggcaaauccgggucacgaggacacagccacaucucaccccgggauguagcaaucucggcaccugcgaggagggagacggguaauaagcagacagcuggccagugacacuggucugugcuggugccuccuucccugucucgggcacuuccgccacaccguccccuccaauaccugaaugaugcuucgcccacugggcuccuccauucaugcauucaugcguucauucaggaaacaucuguugguucugcugagcacacaccaggugcuaaggauacaguggggcacagggugggcacugcccaugucacauguccccugggugcugggacauuuucucuccugcuucucagguacaaggacugaauggcuaggacaacucgcccucuaccaagagcuuugcaaagugacagaacugaaaugaggagcccaaguugcucugucugugugaauccguaugaaccaggggcagcuucauccccagaugcagccucaagugggccaguccuguccuacucccaaguauccaucacuaacacuuguucuacacacguauacauuccccaggauccaaggccuguggucauccugcuugcacuuccgggacagcccacagugggcacuccggcagggccuguggaacugaacaguggauucagaaaaucugagaaugacacccagucuuuaccaugauggacaacucgcaaaccuccgugggccucggcuucucugaguguaaccgggagccgcugcugcccucccaggcacagacucccaucaccucuccuggcacgcacgugcugcugcuggucugccuguguauugcuucaccccaagacacaugugugugagguauucacaugaguguguguguguaauugugcuuagugugugaugugagguguuugugaugugaggcuguguuugucaguaugcagcauggugugugugugcaucuguguguguguccauauguguggugugucuacgugcaugguguguguguguguguguguguggugcaugccugugagugugcggugugugugugagguguaauugugcuuagugugugaugugagguguuugugaugugaggcuguguuuguauguagcuugguaugugugugcaucugugugugugucuauaugugugaugugugugucuaugugcauggugugugugugguuauggaugugaguguguggugugugaguguucgugugugucuaauugugcuuagugugugauaugagguguuuaugaugugacgcuguguuugugaguacauagcauggugugugugagugcauaugcggguaggggugugugugcaucugcguguguauguguggugugugugucugugugcauggugugugugugguguauguauguguguggugugugucugugugugugugacguguguguacaugcaugaaugagcacauauggcuaaacacggaaaggacaaaugacaggcaguggaguagaguggaaagagcugaggccuuaaacagguggccagguccagguccagguccacccggccacccacuccacacaggugccuggaaaagcaucucacuccugugagcugaacccaaggcgucucaucugugaaaugcgguaacgacaguaggccagucaccucucagcacagucuuuaagaaucgaaugagaauucuuccagcacaaaguaggccuuugcugaauauuuaacauauuucaaauaaguguuuguugaauaguugaaaaaauugauaugaaaguucuuuuagaaguaaaaaauaaaauaugauagaaaugugagaaauuuuaaacauuggcauuuuagauuuacuuaaauuauaauaaagccuggguagguggaggcucuucguuuggaaaacagaaaggcggguguggaggaaaaggaaaaauucuuuugaaauaaaaggcgcauugccagaaugggaccuguggcagccauggugagcggacgggccaucacacgggcauucuuccaggagaagccaguccagcauccacacacggggccccggcagccuaugggaccccugucugccacguguagagaagcugcacccagugauccuucucaaguuuguuuuugaaugacuggcuggauccgggugacucacugugugccaggagcccacgcuggucuguggcagccggucccuccaagggacuggagccacgccaccagccacacaauuccaaguuccuucacugugccuacgggucucgauccaggaaaagagaugcugccuucauuguugaaaaaagguccuuugccacaaugaauuuuuucaauggcagcacuuagcaauguauguacccacucacugcagcacacuuuacacgcguccuuauuuuugugcuaucucugagugagaacagaaaugaauuggcuacuuauauauuuugauggggaacugaaugcacuaaaaucuaaguaggucucagauaaaagucacagucuucagccaaacaaacgcaggucucauuccucucuggcacuuccugggcccucagauuggaggggugugucugucuuacaugggaagaacaugaagaaaugcugaauccauaugugaaacacaaaggcugugcuauuuuuuucccccaaaauuaagucuagggaaugccaaacacuuuauaauuggcuuugugaaaacaaggucuugccuuuacuuuaaaaaaagaaaagaaaaaguaaaccuguaauucccacaauucccaaacagagacuaaaggaaaauguauuuugaaaucaaagauggcaggcacaucugccauuuauuuggaauaguuuucccaagccauuuaccuuaaugauuauaagcagccccuuacaaccuugagaagaaacagaaaacugccaaauuuuuagcacuuuuuauuuucuaaugcagaaaauuaaauauccuuuuggucaugcaucaaacaagugauuuuuucauucauuccacguacuacaugaaacagccacaauuacacagguccauauacaugugguuuuuuucuaacaaaaguuacaccaagugugccuggcucuccugccuccccuuccaccuccuccaccucucugccacccugaggcagcaagaugcccuccacuuccuccucagcacgcucaacaucaagaugacgagaaugaagaucuguaugaugauccacuuccacuuaaugcauaguaaauguauuuccucugccuuaagauuuucuuuucuuuucuuugagauggagucuugcucugucgcccaggcuggagugcaguggcacgaucucugcucacugcaagcucugccucccagguucacgccauucuccugccucagccucccgaauaccugggacuauaggcgccugccaccacgcccagcuaauuuuuuguauuuuuaguagagacgggguuucacgguguuagccaggauggucucgaucuccugaccucgugauccgcccgccucagccucccaaagugcugggauuacaggugugagccaccgcacccagccaagauuuucuuaauaacauguucuuuucucuagcuuacuuuacuguaauaacacaguauauaaugcaucuaacguacaaaauaugaguuaaucgacuguuuaugugauugguaaugcuuccggucaacaguaagcuaucagcaguuaaguuucagggacucaaaagucaaacacagguuuucggcugugcagggaguuaaagguuaacacccuuaagcauuuucaaaagucagcuguacauuuacuucucuuccucuccaccauaaauguugacuuacuucaaacuauaacuccuucccuuucuccagaaacugaagggaauguauuuuucucuaguauguggagaucacaccauugugaccucagcuuacgcuuccacucacacguguguuuccaucaaacggaggggcauccaccgggcuggaaagagcagcuuuggaggagcaauaacagagcacaagcgcaaggagugagaaguucauggcuuuuaaggaauggcugugauggcugugagaugaggaaaacauccuucacucuuuucuccccugguggcauccuuacguuuuucaagcaucugcuccaaugucauccacucuccuaccuggagcaccacuggcugcucgacccuguccugagcaccccaccccaggcagguggggcagccagcaggguggccccccaccagcccaggggccuuccugcccacccuucugcggcuaggggcuggcuucaggccaucugccucuguguccagccacaggggccucaagauauauuaaagugagcuucgcuagcucaaugaaugaaggcuuugaaaguucuugugacgacagcugaacacucccugugaaauaacaauuuuaaaugaaguugucauucaccaaauauuuuuaaaagaaaaacacauggggcugggugugguggcucacaccuguaaucccagcacuuugggaggccaaggcgggcagaucaccugaggucaagaguucgagaccagccuggccaacauggugaaaccccgccucuaugaaaaauacaaaauuagcugggcaugguggugcacaccuguaaucccagcuacucgggagucugaggcaggagaauugcuugaaucugggaggcagagguugcagugagcugagauggcaccaccgcacuccagccugggugacaagagugaaacuccauccccccggccaaaaaaaagaaaaagaaaaaaaaaacccaacauguauuggugacaaccggggcucugaaauaacuuccuuaugaauucugcagcuguuuuguaguggaggugaaggucaauugaacgauuucuuugaggaagaccacaguagaacauaccaguaggaaaaaaaaaacaauaagcaaucaugaaagaauauuuaaaguuaaaucugucauauuuacuuuucaaaagugacacacguaucacuggcugauagaacacaccucgagauuuaacucuuuguuuucaugcuggacguaauaaacguccuuaauuuugcaauaugaaaacagcauugccaugaaucuucccuguuccucaagguuauuuucugggucuaaggcuuguucucauuguugcauuugucuuuugucaaggucucaucauggguuuacuauccugcagggaauuuuagauuaagcagcuggccauaaauuaauggucacaugaggaagagcaaggaaggauuaccucaacacaagucacaacagcucucauagaaacaugcuccaguuuaccucauuuugcaggugugagaacaguuuuguuuuguuuuuugagauaagaguuuugcucuuguuucccagacuggagugcaauggcacaaucucggcucacugcaaucuccgccuccuggguucaagcuauucugcuuccucagccuccggagcagcugggauuacaggcaugcgccaccacgccuggcuaauuuuguauuuuuccuagagaugggguuucuccauguuggucaggauggucucgaacucccaaccucaggugauccacccgccucggacuccccaaguucugggauuacaagcgugagccacagugccuggcugagaacaguuuuauaaguaacuacugauucccaacucagguauuuuuaccccacucuuuucccccauuggguggcugaccuggaucuauauuaucuuugugccaguauaccaacuuuaugccaaaugccauacauucuuugagggaaccuggagcagcuccuugagugaggugggauuugaguuuaggauuagaggguggggaagguggacaggcauuaacacuagagcaagguuccccaggcuuugagggaagacuggacguaguugggagggugugaugcucucacugcguggccacgagaugaagguggggcauguggagaagccagguacaggcaguaagggucuaauggaagaggggccacaggguugggagaggggacaugaugcuuaagugagaaugucccucuugugucccugaaaccugagcccugcagaugcuuccugaaggauggaagagucuacacugugggucagggcuccccaguggccgcagaugggaugaagccaccaccagaaagagcccaacugagugugggguggggugggcccugcaggaugucacaugaagagcccaugagaugggagagaggagcauacgucgggcggggugagacaugacccaggcaugcacuccccaaaccuucagacacggcuuacugcaugguggaggaauggagaacaugcauuuuacucugauuuucucuaaggaauaaauuuuauuuuaaaaucacagagaaggaaaaaaucaaauggaguaucaaaccuuaauuuaagaaauccaucugcuucaucaaaaauuugcugugagcuuuuaagaauaaacagggcaaauuuacuuuauucaagaaugauauucuuuuuguaaagccuaucuucaaaguaauacauuauucaauuucugcuuuaaacccuucguuuuuauucauuuuccuuuucuucuugagaaaaucucaaacucacucaugguuccauauauguacuacgugccugagaacagugcuguuccccacagacgggcugggaaggcaggaagacaaccccacuccugcauuuaaucucucgucuccagcaacauacuguaacuuaagcacgggaagauccuaaaacacaugacaggugaggaagggacuggagacaccuaguccuguuucccacaaccuucauuuucaguuccaccuuggaccgcugcugccugggucacccaugaagaaguggccugcccugguagucacagguuccaagucgcccaagcuggagagcuacaagcacuuccagaaaaucugggacaugcauggugaaccauccaaacgggaagaaggucauuacaaaaaaaaaaaaaaugacggaacguccauaguggaaccuagucuuacacauuaggcucaucaccuagcaacuagaacccuugcugaggguuuccacaucacuuccugaucacucccagugacccacaguggggacguguuggggagaugauggaugcggggcuagagcaggaaaaccauucucaugcuccucauuuccccccagaccuucuaauaagaucugcugucagaaagcccaagggccuggcuuaagauccccuaacguucccugucccuggucacccgagagggcagagcccacagggaggacagcucugugagucaccuaccgggaccaagcccuagguaccugcaccgcucagcugucaccacugcuuaucagcaguuccagcccagcccgagguucuuaugguuccuuuaaaucugaggauguccuaggaaugggcaucauguguuuaguugcuuauuuuccaaguguagcagugccacugggacucugggcacggggacuguuuugcaaaaguugaaaacacacacggguaaaagccggucaaagaaagcaguagccaaacuaaagucagguuauauauccaccagggcuuuaccucauaccugccuacaaaaggcacaagaucaacaaggccuguuuguaccacggucugaaaaacgagccagcaccgcccugggcaggacgaggagcccagggcugcccagguucuaaaaguaaaagccucccacggaaaauagcacgccagggauuccaacacgaggaaucgaggugguuagugacucauuuucagagccaggaaggugaggugcagccaagacccaagcaccaucaacuacgucugacagcuaagaggagggcagccgagauccucagguguaaccacagccuuacaaaggcacacaaagccaggacggucugaucugagagucagcagaagccuagcuuuacauauaaugaagcuggggcuggaaggaggcgggaggaucauguuacauggcggggucucccccagaugaccuuaagggcagcuuggcaggaauuuuacuuccuugcauugauuaaagcccaugaacagccuuaaguccccagacaaaauagcaaaacagguccuggacgauucagcgcgaggugggacacaacagggagggagaagucaguauccaggggcacugcccggacccagaaggcggaggcugggauguccccagcagaaacggacuucccuggacuccagcaggcucucugcggauaagggauuggagugagugagaggaaagaggaggacagaggcaaacuuuucuuucugcccaguucuaggccaucaagggagugaaggauccccaaagacauaaggcagagcugggagaagaaaggagaggaggaaacaaaaaaaggaacaagaaguaaggaugaggagacaaaacaaauggcauggaacaugcuagaagccuuccaaugacuuccccauguggaaacugcacacccgggcaucccucccggcuuucuguggaugggcccauccaacgcagcucuuguuagaggagugcacacuccccucuacuauuugguaaguguuuguagcaagaccagugcauaggugggacgugaucugaaaguuuacaagaaggaagugaaaaaccacuugugagauuguggggagaaaacgcugggagcccagagacaccacaggcgucaagaguccagggaccaugcauggugguuuaucaguggcaaggagaccaagguuugacccagccugaccucguagcacuuccucguccagauggaugugggcuuguccucccaucacgcaccuguccaagcuggcugcaccugcauggacugcucuccacucugcaagggccaacacagcucacacccaccccgaugccagaggaaaccgaggcacacggcuggaagcugccagugggcaaagcgcuccagccccagcuggugcagaagcaucacggagagacugcuauggcucucacccagcgcacgcuccccguuccacccuacauggcgcaaacacgcuccccuaaaauggagugaacguuuauagcggcaaagauggcagccaggguuuggguuuggcacucuaagaaacugacgccuuggaguuaaaucaaccaaaaugacuuuuaguuuaguuuuuuuguugcuaacaguuuccuuaguuucugacuuuucucuggugaagagcacaguaucaaucacacuucaaaauaacaagucaggaaacaggaaccucucacucagauccucacccuguuaaaaagacuuuuguaguuuggauaucaugaccuguacuaaguacaaagcucuauuuguuucuacuuuguaacacagaguguuauguucuaugguugcuacacaaucacuuugaggaaacauuacuauaaaaauaaauaaguuucuuuuuucauucaaagcgagggaaaauaacaaggacgcccuaaauacacccacaaaccuuuuccaagaacacuugcauuuguuccugagcugguaagaaugcuuugcugaugauaucaaagcccuuuaauuuaucuacaaucgaccugacuuaaacacaaaggaaaaaauacucauuuuguucuacuuuaaauuaaaacaagcuauuuuuguuguuguuguuacugggcugucucuguuuuucucugaacgcaggggaauacaguauucugaagcacugcaugauuauucucucuuggcuguggaaggguggccaagcacacuauugaucucugagugggauuguuagaaggacaaagugugauuucacuuugaaagugauuacaaaccucuacuucucacuaagauagaauaaaagugcagugcaggauuuacucuucugcaucaaauaaguaagaaaugcauguuaagaaaugauuuuuagacacaggaaugaaggacaauuauccuauaauaaggcaaaacaaggugagcucucugucccaguucaucaucugaggagccaggcagagccugcaggcgcccugaauggagccccacggagacacgggcagaugaaguuuguaaggcagugccccagaaggagagcucuaguugucucuggaggguacccuugagauuguggcugaggcuugaucaguacaugcaugugaggagacuuccccaaguucagggaaagacccaaugguaaaagcaaaggaaaguuuaucuggagcucaccaagauccaggaauaguccuugaucucaccaguuaagguagaaauucacaggucaucagguagaguaaucugauggguauuaucucagcgcuaggggaaaaugccuggauuaaaggcugcuuugaucccaacuaagaaagguuaaaaguaagccuccacagggcccaccuguucugaguaacuucucugcauccuagaacaaagcucaagaauauuuauaugaacauaaaaauguccagcacuuuguaaggugaaauucacaauguuagauuuccagugaaaaaaagcaggcaugcaaagaagcagaaaaacacaaccuacaacaaagcaucaaucaauagaaaaagauccaggaauggcagugaugauaaaaggaauagacagcagauaaaacacuugugaaauaucccuguguccaagaagcuagaggaaagauuaaguuacauagagacauggaauggauuaaaaaauaaaauuuuuuaagauccaaauugaacuucuagaguugaaaacuacaaugucucagaugaaaaacccacugaugggauuaaugacagauuagacaucacgaaagaaaaaaaaguuagugaacuuaaagacaaaccaauagaagcuauccaauaugaaacagacuuuuuuuuuuaaagauaaggaaaugaaaaguacaucaguaaucuaugggacaacuucuaguagccuaaucuaucuguaaauucaaguuuggggggcggugggaaacagagaaacaugcuuaaagaaauaaugaucaaaauguuuccacauuuacugaaaaccauacagccacagauucaaaacacucaguaaaccccaagcacaggaaacaagaagaaaacuacacccaggcucaccauauucaaauugcuuaaaaucaaugauaggaaaaaucuugaaaacugagaaaaaaauauuaauaccuuauauauacagagaaguaaagguaagaacuauaacaaaugucccauuggaaacaaugaagcaaaaagacagaggagcaucauaugucaggaagugaaagaaaacugcccgccuagaacucugcacuggugcaaauguauuuuaaaaacguaggaaaaauaaagacuugcucagacuuaaacaaagacauucaucaugggcagaccuguaccauggcaaauguucaacgaaguccuucaggcagaaggaaaaugaugccagacaaaaucugcguguacacaaggaaugaaacucaccagaaauggcaaagaugccccucugccugguuccaccaaugaugucugcagaccaacgugauugggacuggaauccaaaucccauuugcccuuuuccucaguaccauccgugaugacaggaaccucaucuuccucuguuucuucaaaaucgcucuggaauaugcccacuucauugugaucccuggaguccccacaguccuaaagcugggaagcugggcaggugggagucagcuacuucuaaagacaagugaauaagccuucuuuaaguuaacuuaagcuaccgugcauugcccuuggaaccguucugucucauuugggaagucauuuggcguauaaaaagugcaaacaccuuuuauuuccaaaucugaggacagacagaagaaaaaggcagagccagccacauagucugguacugcaaagcuugucacagccuggcaccaaugaugaaaagccagugagaaaaugcacaaacacaugcauuuuuguguaugguguguaccuuauaaauacgaaaaauccaccuggcuuaugaagaauguauacacaggaagguucucucaaagaaucagaauguccuuuuaaggaaaaagaugcccaacagaauguccugcugguuguuaaaaucaacuugauuagauggaucucccuccauccccuacuaccaggucgacaucacaccaccaggcacucagaaguuacgcuccaugaaacccgacuacuauucuccaucauaagaaaaacaaaaccacaaauaaaugccuacucacuuaaacaacccaguuaguugaaauuacugauaaagggagaucaucagugcucaaaauguuucacgugacuuccaguuucagaacaugcaugggcuucuugggaugugaccacgggcaggcugcucacacacucuaagccuguuuucucauuuuauaugugcacagacuucucacuguguaaaggaugaacgguagcucccuaucugccucaagagucuauucccgacacuuuaaaaauagcaucuauacagugcaugggcagucuauuucaugggggugucgagaugccaaccagugauggaaaacuuaaaugcaucagcuuugcuacuuuuuagcagauguucugcaaguugcagaauccuaaagagcaaagaaacuuaagaguucaccucucgcaacuguuacccaucacacagacuaaaaccaaacccaaaaaugaauucugcaaaaaaauuuguuaagcuuauuuaaucauuccauuuucugcacaugugaaaaacugcuuuuuccacgaaaauaaaauguuggaaauguuaaaagacuguuucuauuuguuagccauuuuaggagaaaagcuaacuuuauuaagcaacuagcucgccugcuuagaauaacacauuuuugcuuuauauagaguaucuuuguguuuuaauugacuuauuuugguuccaacucuugcaaauguaaggaaauuuugccuaacucuaugcuaauaaucuaaggguuaaucugacaauuguguaggguggaaaguuuuaagaaaagaagaaauuacuuagauauuuuuaaaucaaagauuuccacgguagaagaucuagaaugccaguaauaauugacuuauaggaaaauuaagaauauuuuuuaaagugagauauacuugcuuauuuacuaucaauaauauuugaaacuuagaauuuaaaauauuuuaaguugguaaacagaacuucgagaacaauaaaaauuauuauaagugaaaugaaagaucuuauguugcuucucuggguuuuguuuuauuuugcuuuguuuuuuuugaugaggggucucacuuuguugaccaggcuggucucaaacuucuggccucaagcuaucuucccaccuuggccucccaaagugcugggauuacagauguaagccaccacauccagcugcuuuucuaguucaguuuuuaaaauuaaaaguggaaaaauauggaaaaccaaaugaaaaacuuuuuccuuucugacggucccuaaauaauaaaauugguucuacauaugauauaaauucaaguuuguguuaagugauggguacaguaaaaauaugaaauacagaauucugugcaauuuuuagagagcuuuuuaaaaaauauuuucacaaguacugccauuccuuucauaccucuuuaaaaaguaacaauccaccaugcgaaagauuuguguacuucuuucccuaaccuugcaaugucggugauaaugcuauucaauucugagacgguaugauauuguaaagaauuaacaaauaagaagaaaacauaauuuuuuugucuuagucacauuauuuuuuaagguaugaccuaucugcaaagugaaaagaucuaagaucuccacuuuuaauguauuauucuccuuguuagggaaagaagaggcuuacaaagaaaaaucuggcauaaaaauggaucuuaaaaauccaauuguaaaacaaacaaaaaaaauucuguuguaucuuacacucuuggcuauaaacggugugggccucuaaccuaaaauuuguuaauguguaggaaaaaaaaauccuaccugaauuuuacaauuuagcuagucuauauaauauacuaucuauaaugcaacuuucucugucuuucucucucucuguuuuuugguuuuguuuuguuuuuguuuuuuucuugagacagagucucgcucugucacccaggcuggaguacaauggugcaaucuuggcucacugcaaccucugccucccagguucaagcaguucuccugccucagccucccaaauagcugggauuacaggcgcccgccaccaugccuggcuaauuuuuguauuuuugguagagacaggguuucaccauguuggucaggcuggucucaaacuccuaacuuugggugauccucccaccucagccucccaaagugcugggauugcaggcgugagccaccgcacccagccucucucucuaacaaugugguuuguauccaacuagaaggugagguucuuauuuaaauuagaucaguuuaauaaaucaauuuccaauuuggauaguauaaagacaacugaaaugcaaauauuagcaauauggggaaauacaacuucacuuagcauauuuaauccuaugaaagggucuaaauaagauugauaaaauaauuuacagaagugcagaaaacaacugcucaaaugcacacaaauuauucuuuccuuucccccaaaucucuagucuacucugauuauagcugggaggacacugaucaucaccaugguucaaaagaaauaacaagguucaauugucaguucagcucaauacauggauauccaccucuacacauuauuuaaccuuuccuggggucagauuucuugucucuaaaaugggaacaauacaacacggggcucuugugaagaugaaacgguuuaaagaauuugaaagauuacauguaauaauaugaugaugauaaaauucuguuugcaauguacauuccuuuaaagagaauauacaaaguuguauucauuuuugguuuucacuagaaauuaguuuuaguauucuaguuaauuuuuggcuggucagaugguaguggguuaucagaacuuauuaacauugcugucacuauacaauccccccacugcuaaauuuuacuagcuuuuaaaaaauuauuuuuaaaaaaagcaauuugcauggaaauuguuugaaacaucugggauauaaauucacuaauauauuaaaaaaaccuagaaacacauaaauaucucauacuauuauuuauuugaacuuaaaucccacuaaagugaucucuaaggaaacuugaauuuucaauuuaacuugauuuuuaugcaaacuauguaaaagucaaaauauuugcucuuuauaggagauacuccuaaugcaaguuaaaucuagaauaaguuuuuaauacgaaaaauauauuauaagccaaauauacaaaaaaagguuaaagaaagguaguaaguucauauuaaacaaguauuuuuagaaaacuacaaaacauuaauaaaauaaacuguagaugacacaaacauggaaaacauuccauguuccauguucguggaccagaauaauuaguaucauuacaaugaccauacugcccaaagccaucuacagauucaaagcaaucccuaucaaaauacuaauaucacuuuucacaaaauuagaaaaaaaccauccuaaaauucauaugaacccaaaagugagccugaauagccaaaacaguccuaagcaaaaagaacaaagccggggcaucacauuaucugacuucaaauuauaugugaagccuuuaguaaucaaaacagcacaauauugguacaaaaauagacacacagaccaauggaauggaagagaacacugauacauucaacugaucucacaaagucgacaaaaacguaacaccaggaaaaaggacacccuuuucaauaaauggugcuggggaaauuggauugcuacaugcagaagaaugaucugggaccccuaucucucacucuauacacaaaucaagauagauuaaagacuuaacucuaagaccugaaacuauaaaaguauuagaagaaacccgagggaagacugcuggacguuggucuaggcaaagaauucaugacgaagaccucaaaagcacaagcaacgaaaacaaaaauagagaaaugggacuuaaacuaaaaaagcuucugcacagcaaaagaaauaaucaacagagugaauagacagccugcagaauaagagaagacauuugcaaacuaugccgcugacaggggauuaacauccagaauuuacaaggaacucaaacaaauuuacaaaaaccaaguaacuccauuaaaaagugggcaaagaacaugaauagacauuuuucaaaacuagacauauaaauggccaacaagcaagugaaaaaugcucaacgucacuaaucaucaaagagaugcaaauugaaaccccaaugcgauaccuccuuacaccaaccagaauggcaauuauuaaaaaguuaacaaauaacaggugcuggugagacugcagagaaaagggaacgcuuaaacacuggugguggaaauguaaauuaguacaaaucuauggaaaacaauauggagauuucucaaagaacuagaaauggaacugccauuugacccagcaaucccacgauaggguauguacccaaaugaaaaaaaaaaucauuauaucaaaaagacacaccugcaccuguauuguuaucacugcacuauucauaguagcaaagauguggaaucaaccuaaguguccaucaaaggauaacuggauaaagaaaauguggcauauauacacuggaauacuauucagccauaaaaagaaugaaaucaugucuuuugcagugacauaaauggaacuggagguuguuaucuuaagugaaacaacuaagaaacagaaagucagauaccacauauucucacuuaucagugggagcuaaauaacaugaacacaaggauauagaguguaaaaugauaauauuggagacuuaaaaaggggggagggcggaaggaggugagggaugagaaguuacuuaaugugcauuauauacaugugguagauacauuaaaagcccaggcuucacccccaggcaaaauacgcuuguaccccuucaauuuauacaaauuuuuaaacauuuaaaaauuaaaaacagcacuaaaggaaggaauacauuguauuauagauagaaauagaaauacauauagauaaauaaaaauaugauagaacuacaggaucauaauuuuaaaccuucaauaaauaagccagcuucacaugaacaaucugcaucagcaauaacuagcucaaaaaucugggaaaagggguuuguccacggaagguagguccauucaccauaacacaaaaauuacaaaaguuaaagaaguaaauuucaaaauuaauggacagaaugucuauggagaaaauggcaguacuuucugaaagacuuaaaaaggaaaacugggcuaauacaaagacauaccgugucuuaaacagaaacacaguauaccauacugauguugauucuccugacagaagagcaaucccaacuaaaacuccaaagucgaggagagaaccugacaauaauucuaaaacuuacauggaaaaauaaauaggugaaaacacacaagaaaacaauuucagagguggguuuucaccacuauguguugaaauguuuauaaauguucggcauagugugcaagauaauagcaguggucugggaaaaaauguuuuaaaaagaguacaauaaaggucgaauuuuaugugguaaagaagagaaaauucaaaaaugcugcuugggaaaauuuauuauaugaaggggaaaaacaacaccuguacccaaacagaauacauauuuaaaaguuccagauaaauuaaaacauaaaaccauaaggcaaacagaaauaaauguaggcaaauauuugcauauuucaggguucaaaagaacuuuuuaaguuaaaaaguacuuaaaagggaaaagguugauauauuggaagguaugcaaguuuuccacuuuaugugucaaaaacacucuaaacaaaauugaaaguaaugauaaagugggaaaaauacuugacagauaaaaauaaacauacauuacagucauaucaauauauccuauaaacuuuuuaauuuaaaaaaccuuaauuuuuagaaaaacuggcaaagaaacaggcaauuuaaagaagcagcagacugggcacaaauggcucaugccuacaaucccagcgugcuuggaagcuaagacacguggauccuuugagcccaggaguucaagaccagccugggcuacauagcuagaccccuacaaaaaaaguuaccugggugucauggcaugagccuguggucccagcuacucaggaagcugaggugggaggaucacugcagcccgggagaucgaggcugcaaugagagcuguguucucaccacugcacuccagccugggugacagaguaagacccugucucaaaaaaaacaaaaaaaaaaacaaacaaaaaaagcauauggcuagugaccuuacagaaacaacauugaauagauaaaaacuggaaacaaaaagaugucauuuuugccugccuuaaaggaaagaucaaauuuaaggggguggcccagugucagugagaguuggggaggggccucucugggugagcauuucaacuguggcauccaauuuuggaagggguuuugcuugaaaucacuggaagagugcacaaauuugucuacaaggaucuaugcccaggucaaaacaaauaaugaagucaauggucacacucuuuagagcagaaacauuguagucuuuagaaaucauauuuuugcagaauauuucauggcguaggaaacauaauacuguugggacaaacaugggacacaaaacuacagcuaugccaaauugguaacagcucugaauggcaaagaauccugcaaaugauggcuguuuucuuccacauuacucuaggguccaaaugaucuacaggaaauacuguguaccuuuuagaauuaugaaaauucagucaacccuccaguacggaauccugugggaaacugguucuaggagucccccauaccaaaauucacagaugcggaaguuucugaucuaaaauggcauaguguuugcauauaaucuauacacauccucccacagacuuucaaucaucucuagaugcuuauaauaccuaauacaauggaaaugccacguaaauaguuauuauauuguauuguuuagagaaugacgacaagaaaaaaaggucuguauguguucaguauagacccagugauuuuugucuuuaauacuuuuagaucugaauccagggaugcagaacccauggauacggagggcuggcuguguguguuauuuacaaauauauguuguaggaugccaaguuguucgguaguacuucugaaaacacaaauaaugguaaauaauaaccuauguuuuuucagcauuucauuaacauucuagacuggauauguaacuuugggacaggugugaauuuuauugaucugaccuaugcuuugcccucccauuucugcuggccuaaugaucagaguggcaggcaggccccaggguccugacacaccuuugccuaucgcacaauaaggcuacaugaggcaaguaauacucccaguuuacagaggagcacaaggccuaagugucgcacccaaauugacacaaugagcuucuaagcagaguggaaacaaaacccugaccugucucacuccaaggacaaaccuagucacauacccucuguaccccucucucucucacacacauacagaaccugcugcuuagaaaauaauuauuagagaaaauuaccuuagagauaacuauuuccccucaccuuuuauaccuuauacaaagcaguauaucaucaauucaccguugaaucaauguuuaacugcaguaagucaaaguuuuagccaaauagaauugcuaauuucaaccuaaaauaaaaacaagcuagauuccuauguaauauuuuuucuuagacuuuccaucuaggauuguaaauucuaccuucacuaaauugugagucauuuaaucuaaauaacaacucuuuuuuuuucaaggacaugaaaaaaauaagaacuauugaugcuucugcaauguacaaacuuucagaaauuaacuauucaaagaagcaacauuuuuuaaauuaaacuuuuauuguuuuugaaaaaaaucucaagagugaaacagaaacugggguuugggcuuggaaagcacacaguguuuuuaaauuaauggaggguuuaauauuuuaaagaaucuggcuucaaugguauggcuaauggcauuagcaacagaaaaaaaccucuucugcaucuugauuacacauuagcaacaguaucgaugauaguaauaguacagacaauuguucaacucuuauagaucaugaggaauauucacacacaaccucauuuaauucauacaauguuuucagaagaguuauauuacacccauuuaauagaggauaaaauugagaccagaaaaacaaaguggccugcacaaguucaaauaacaacugaaaacuugaggacgucccccaggugcccuucuguggggucagugcccuuacacaggcauuccuccugcuuuugagucagauacccacuauguuguauuucaaaugcuaagauuuaagugacuggaccaaauuguuucuaaauagaagucuuccaaggaaguuacgguacaauuuauucacagcaccaaaagcauuacuugaauuaacucaacuauuguugaucuuuaauuucuauaaggcaagcaaaaaauuuucauagcauaacauugcccacaaccaaaauguucucauaaauucauucuugacauuagagcuuuuaaaauaaccauguaguaauaagcaaacuuaaaguuaacacauuucccaauucauuacuauauuuaaaauaaaauagcuacuuacuuuccuaugcacgagggguuggcaaacuauuucuguaaggagccagagaguaaacauauuaggcucugcaggucaugugcguucuuuugcaccuaugcaccucugcaacuacagcacagaugcagccacgggcagugcauuagcagaacagcaugccuacaugccaguuaagacuggauuuacgaaaaugggggcuguaguuuaccaacccccaccacuuacuaaaaauuugcuacaaggcaaacuuacuuguauaugaauauaacauuuauagauuacacuuccuacuauuaaagagaaaaaaaauauuucacuaaacauaguaauugaaaaaaacauuucucagccuggcaagguggcucaugccuguaaucccaccacuuucagaggccauggcaggaggauuacuugagcccaggaguuccagacuagacuggacaacacagugagaccucuauuaaaaaaauacaaagaaaugcugggugugaugguguacacuuguggucccagcuucuagggauguggaagcagaaggguugcuugagcccaggugguugaggcuacagagagcugugaucacaccacugcacuccagccuggacaagggagcaagacccugucucaaaaaaaaaaaaauagaaaaaagaaaaaacauuucucaacucauuccucuuccuuacauuuuuaacauucucacuuuuuguguguguuuuuuuuuuuuuuugcauuuuaacgaaacacauuuaauauccuauguuuaggaagucagugaagaugguggagugaaggaccuccaaaaauuaucuccuucauaaaagcagugagagagaacaauggcaaaauaccgucaaaaucaacuuuuuucaggucucugaaaauuaaucaaauauuagcaacaauccaaaaacauuuauucaagaaaaauggcugaaacucaguaagaacagugagcuuuguagcguuuuacguuuccguauuuccuacucuccucacugcagcuccaagguagccuuuaaaaccagccacuaggccaggugcugugguucaugccuguaaucccagugcuuuggaaggcuaaggcaggagguucgcuuaagcccaggagucugagguugcagugagcaccacugcacuccagcccaggugauagaacgacaccuucacucugggaaaaacaaaacaaaacaaaacaagaaaccagcuaccgaagggcaaaauucgagguuggagcuccuucaaagcccauaccagagaacuaucauuaguugaccaggcugcuuuucccuggaaaaucccauucacaagucuguguuuauuuaaccugacuuggaacucacccauuaggaaaagcguuuucacuugacauuugucaaauuagaggcaguuguuuagaacaucugagaugguggcuaugagguggggcaaacaacaagcagaucaaaaucuuaaaaagaaagccugaggaaugagauauuaacagagggcuuugaaacuccagcauauuccugggaaucucuaagaccacacccauguguaggaauauaaacaugcucagagcuaugcauacacucagaagggacaugagagggccaugagcccucagcuuuggcagacaugagguucugcacaagcaggaaugaaggcuaagacagagagguaaccaccuggcucagaguugaaggugugcccaaaacaugcacacauaacaucagcaaagauuaggagacucuguccaucauuauuugaccacuaagauaaucaagcacagucuucaguggcuaccacaggacaaagaauacagaccuuacagagcugguucauaaaagucaauaaauaaacaacaauagcaacaaacagcaacaacaaacccuggggagaaaaaaagaauucaauuuccaaaguuuccacauuguuuuauuuuaaaugccauuuucaacaacaaaaaaauuaugagacaugccaacaaauaagaaaagaaaguccaugcacacaggaaaaauuguccccaagcaagcucagauguuggaguuacuagaaaaaauaaauauuuccaaaaaauuaaagaaaaccaugucuacagaaaaguaugauaauaaugucucaugaaauagagaauaucaauaaagagauauugcaaaaaagaaccaaauacaaauucuggaguugaaaaguacaauaaaugaaauaaaaauuugaagaucucaacagcagauuucugagcaaacagaaaaaacaaucagcaaacuugagaauaggucaauugagauugcucaguaugauaaacagacagaaaaaaaaugaagaaauagcaacagucucagagucccguaggacaucaucaagcaaacagauguaugaauaaugggagucccagaaagaaaaaagagagacaaaaagaagaaaguacaguugaaaaaauaaugacuggguuggguacgguggcucaugccuguaaucccagcacuuugggaggccuagguggguggaucgcuugagcucaugaguuugagaccaaccugagcaacauggcaaaaucccaucucuacaaaauaaaaauacaaacaucagccaggugcgaaggugcaccuguagucccagcuacuugagaggcugaggugggaagauggcuugcacccaagagguggagguugcagugagccgauauugcaccaccgcacuccagccuaggcaacagagccagacuuugucucaaaaaguggaaucaccugaggucaggaguuuacgaccagccuggccaacaugguaaaaccccaucucugccaaaaauauaaaaauuagccagaugugguggugcacaccuguaaucucagcuacaugggaggcugaagcacgagaaucauuugaacccaggaggcagaggcugcagugggccuagaucgugccacuguacuccagccugggcaacagaacaagacucugucucaagaaaaagaaguaauaauaauaaugaugauaaugauaauggcugaaaacuucccaaacuugaugaaaaucaucuaucugcacauguaagaagcuaaauaaacaauuccuaguuagauaaacucaaaagagaucuaaacuuauacacaucauaaucaaacugucaaaagcccaaaacccuacauucgguaaugaacagaaagaaucuggaagaaagaaagaaaaaagugaugcaagucauacaagggaccuucaguaaguuuaacagcugacuucugaucagaaaucaugaaggacgugaaggacaaaauggagucaggugacaucuucaaagugcugaaauaaagacugccagucgcuaauucuauauucagcaaaaacuacacaaaauacauaggugaaauuggacauucccagauaaacaaaaacagagaagucaccacuagcagaccccucuccuacaagaaacaauaaacagaguccuucaggcugaaaugaaagcacacuagacuguaacuugaauagaucagaagaaauaaagagcaccaguaaaaguaucuacuaaguaaauauaaaaugcaaagguaguuuuucuuuguaacucuuuuuuccccuugauuuaaaagacauaaagcaacauuuacaaaucuauguugaugggcauacaagguauacaagauguaauugacaggacuugacaacaccagcacaguggagggaggaugguggggcuacauaugaacaaaguuuucauggcacuguaauuaaggugguauuaaucugaccuacauugcuggaaauuuagaugcuaauuaaaacccacaaggugauuacuaaggaaauaacccccaaagugauaaaauaaaugacaaggagauaaaaauggcacacaagcaaauaucuauuugacaaaaaaggcggcaguaauggaggaacagacaaauaaaaauaccuaagacauaaagacugcaaauagcaauauggcagacuuaaauccuaccaacucaguaaguacauuaaauguaaauggucaaguucuccaauuaagaggcagaacugacagaauagauuuuuuaaaaagcacaauccaucuauaugugaucuguaagagacacacuuuagauuaaaaaauacaaauagguugaaaguaaaaggaugaaaaaaguuacacugugcaaaaaguaaccaaaagagcugaauuggcuauguuaguauuagaacaaaaaauagacuuuaaaacaaaaaaaugauaguacaaaucaagaaagacauuuuaugaugaaaaaaaggucaauccaucagaaggccauaacaauuauaagcaaaaaugaagcuaacuguaaguucccaaaacaaaugaagcagaaaaugacagaacugaaggaugaaauagacaauuuaacaauaacagagaauccagugccccacuuucaacaauaaauagaacuagcagaaauuaacaaggaaauagaagacuugaaaaauauuauaaaugaacuagaccugacagacaacuguagaauacucugcccagcaacaguagaauaaacuuucuucuuaagugcacguggcguguccuguaguacagaccauaagcuaagccauagaacaaaacucaguaaguuuaaaggaucgauaccauacuaaguaggcucuuggaaugaacuuagaaaugaaaucaauaacugaagcaaauuugagaaagacauacauacguggacauuaaacaauccacucuuaaauaaccaauggaucacaggggaaaucacacggaaauuaggaaauacuuugagaugaacgcaaacaaaaauccaacacaccaaaacauacgggaugcagcuaaagcagggcuuagagggaaauuuaacaucccguauuuguuaucauuuguauugcuuuauccagucauaagcauuuccauguaaccagaaaguaucuuaaaauauaauuuaauaaauacacaguauuccaguaagugaaccaugauaucuaauuauuauauggauuuggcagcacucaugcuguguuuuacaugugcuguuguaaaaacugacuauccucgggcacugugaucuuugacugcaucaaagauuaucuucccaggauagauuuauagaaauggaauuguucacucaaaaagguaggcauuucuauggcuggugauuccuggcaaccuuauuaauaaagcuuugcuccacaucaugcauaacgcuggaacaugugcgagaaaggaggggguaacagacacacaacuccagucuguuugcaagaaccaacguggaguaaggaggcggaaagucgaugcaaauuuuauuuccuucuuucccauuuuucugguaauaacacaaguguauuaaaauaauguggugaaaagugccucuuuacagacaaauuuucauaaagccuggucacaucugucugggagaaagggggaagguucguucaaaccucuccauggcuggcuggugaugucaccugugaugaugucaccucacagcacccagaucagugacuuucagagcuuugcauccauuuccccugaacuuaggcuaaggaggcaagaucaguuccauuuuaaggaugaauuaaaaugggauacccaggaaaaaugucuuaaauaugugaauaaaugaguauugaguguugauguuauuuguucuuucaaaaaaauuuuuuuuucuugagcaggaaccaagcaugccgccacacagaaaacaaagcucuugcucccaagaguuaacauucuaaugcggaggaggguggguagagaaacaucuaaaugcccaaauccauacgugggucagacuguaguaagauaaacagaguagggacagagaugaggcauuuagggaggaucucccugggagugugacacugggaaaggugccugaacuaggcaggagccaggagagagcugggggaaggggcagcagcccagggcucuaaggcacggcucgcucuggagucccaagaggccaaggcguagugggaugggaggcggagagugaggguacgggggagggacacagugggccaccagguacaggacccugugggucaagcaaagacuuuggaucucacucccagggaagggaagacagugaggcuuccaagaagaggagggccccagucugcuuucuauuguaaggaaucacuuuggccauuggguggaggaugcucaggugugugcuaggggccgggguggaggcaggaggugguuaggguaagcuaggaggccucggucaccaucuggagggagauggaggugguucaggcggggagaagugcggugggcagccagguccaaggccucagccagcaggagcugugaauggagccacggagaggaggaggccuggugaugugccgcugccagcacaggcaccuggggguaaaugcaggagagggggugcagccaugcagcgcuggccuuccugggucauccccaccuuccccucauucagaauggccucagaggccaggcuccacucuccuaaggggugcucugcagagccaccuugggaagucacugaaagggguggaagugucccucuauugugcccugaaacuagcggccagccuguccaaaaccacacaguucugcuagagggaguggcaaagguuaaaauucccaccacacugccccuuugcaacagcauuucucaagugagaaacugacuugggcuucuuuacaccuuccuuccuuuccaaagaaaaccacgccacaaguucaagaauuuggagauuccugaacaggcucucaggaggagacccagacccuuucucuccggggggguccugugucccugcacuggccacaugaucucuuaacagcccaguucgccacggcccccuuccgucuucccucacuguggcucugggaucuucagucccaaacucagaggugacaacuuauuucugucccccugcauugucccaugaggucaugacauuuuaagauggucuauauuaaaccuguuucaaaagaaacaaguggcuuuaguaaacgugccaccugaugaggcuuucagcacuuaccugcuccugggaaucacuguuucaaaccuaaggacuucauuuccucagacuuugaaaggaagccaggaaaaugauucacugaacuauguucucagagugggacggcaauacuucccaggcuucagagcuuuggcugugccgggccucccuucaucuggcugcuucgcuacaugauucaaagccaaaauuauauuuggggcaaaugaugagucugcaaugaaaugcaaacaaaagucccagccacucaccccaccuuccccaccaugcccugcccgcuccucagcagacaggcuggaccccgugcauacccagcacccuccacagugucuggaugucuaggaccgcugcccauacccucucccaccucauuccaaagcuguguguggcucgggggccucgggggcuccaccccguaugagauucucuccccgcugcaauuacacauuguugggcaaguccuggaacuguaaugggcucuguguguuugugcuaccucagaaaaaugcuggacucacccauguggacaguuaaucuccuugacaacauuuuccuggagaaugcugcgagcagggaauuccuaauaggggauggaacugcauuuagucauucucuaaaaauacauguucagugugucgagaugugaaaauggcuuuuuguggaguguaaaugacugccacugacuuagcaauauccucauaauucuuggcaaucaaugacagucuucacagauucagcuaaauaccauauggaucgauauuuuguguuuccugaguuucuaucuguccacaaacucugagcucacacgaugugcaaagcaugguaccaaggggaaccugcaccuauagaggcuccuaugggcaacaccucacugccugacccaggugaggggaucuagaagauagcauugucauauauuuccaaagagccacacaaccuucugaaccuccugcuguuaauaacucauuauucaugagcaaaauggaaugcuuaaaauaaacaagcaaacaaaaacccuccagugccaguaggacagugccaguacgugacuuuggcgauuacacuguguugaaugaauagugucccccaaaauucauguccaucuggaaccucugaaugucacuuuauuuggaaauacgauccuugcagauauaguuaguuaagauaagguuauacuggaguauggcgggcccuaacccaaugacugguauccuuauaagcagagaaaacagagacacagagacucaugacagagaagacagccaugugaagacagagacagaaaucagaucaacguggcugcaagacaggggacguaaggacuggcggccaccacagacgcaggaagaggcaaagaaggauuuuucucuagagcuuuccacaggagcacggcccugcccacacgcuggucucagccuugaagccucagaacuguaagagaauacacuucuguugguuuaagccaccugguguaugguaaucuguuauagaagccucaggaaacucauucagcaauggguggaaaaucugagugcuacucuccuagcagacacaaggccucauuucagcaaaggcagcugccugugagugugccgggcaaggcaaagucaucacaaagaucugucauguucuggaccauugucgcagucuaaaauuggcaucuuuauauuuaagguugucaaugaccagauuccauuuuuugucuuaugcuuacagguccuauguaaauucguuuccuuuuuuuuuuuucaaacacauuuccuuuuuugaauacacucugcuuucgugcgcuauaugugaagcagaaaaauaaaacaaaaacaggcaacaucuagccuucugcccaaagaaaggaaaugaaaagaguauguuacuggauacuaaacuacagcuggagaggagggauaaguuguggcauuccgcagcacugcagggggacuauaguuaacaguaauuuaguguguauuuuccaauagcuagaagagaggauuuugaaugcucccaauaaaaagaaauaaguauuugaggugauagacaugcugauuaucacaauuugaucauuacaaaccguauacauaggcaauaucacucugugcuccacaaauguguauaauuguuaugugucaauuacauuuuuuuaaucuauuuuauucuuuuuuuuuuuuuuuuuuugagacagagucucacucuguugcccagguuggagugcaguggugugaucucggcucacugcaaccuccgccuccuggcuucaagugauucuugugccucagccucccaaguagcugggauuagaggcggacauuaccacaagugggugauuuuugcauuuuuaguaaagacggguuuucaccauguuggcugggcugguuucgaacugcuggccucaggcaauccacccaccuugaccucccaaagugcugggauuacaggugugagccacugcgccgggcccauauuuuuuuauuuuuaucuuuaauugaaagaauaaaaagcaugaaugccugcuggccauucuccccaaaagaccucacugaaaagcaacacugaggucucuaaacagccagagaaguccagccccgcagagccgaagaugacuggucugaggccugcucaccaugaauuucuugugauaacccucacuuuuauuuauuuaaagagcaguuugacaguagaguaccccuaccacacuucucuucacucuggagugaaaaauuauuacaaaauggaucacaguggaauggcuaaaucaagcuaauuaacaugcgccgggcaguauuccauuuuuucuuccucucaguuccuauguuacuccugcauacuucauggacuuaauuuuuuugugcuaagaacacuuaaaaucuacucucagccgggugccguggcucacgccuguaaucccaacacuuugggaggcugaggcggacagaucacgagauugagaccauccuggcuaauacggugaaaccccaucucuacuaaaaauacaaaaaauaagccgggcgugguggugggcaccuguggucccagcuacuugggaggcugaggcaggagaaaggagugaacccgggaggcggagcuugcagugagcccagauggcgccacugcacuccagccugggcaacagagggagacugugucucaaaaaaaacgaacaaacaaaaaaaaaacaaacuacucucucagcaaguauacaauacauugucauuauuuauuauuaugcuauuauaugcuauuaacuacuaacuauguguguuauuaacuauucauuacuccacaauguauauauauuucaaaacaucauguuuuacaccauaaauauacacaauuuuuugucaauuaaaaauaauaauuuaaaaagucugugcuucaaagggcauaaucaaggaagcaaagagacaaccugcagaauggggaaaaguuuuugcaaguccuauuaucugacuggaacuuguaucuacuaaaaacugcaacuaaauaauaaaaggcugaauuuaaaaaugggugaaagauuugacuagacaauuccccaaagaugauacauaaguggccaauaaacacaucaaacaucauguacuuaacaucaguagccaucuggaaaaugcaaauccaaaccacaauaagaugugacuucacacccgauagauggcuagagucugaaacagacagguaagcauuggaggauguggagaaaguggaacccucggagaacugcuggugggaaugcaaacagcucuccaguuaaaccucagggguaucgugugcuccagcaagucuccuccuagggacauacacaagagaaaugaaaacacacgucuauacacuaacuuguacacaaauguucacagcagcauuauucauaguagccaaaaguagaaacagcccaaauguccaucaaugacaaauggauaaacaagaugugguacauccauacaaugggauaccauuuaacaaugaacaaaaaucaaguacugauacaggcuacaauaugaaugagccugcaaacaugcuaugugaacgaaaccaguuacaaaggaccauguauuacacaugauccauuuuugugaaaugcgcagacuagguaaaucuguggaggauuaggaggugacagcuaaggaauauggggcucauuuuucugcuaaaaaugugcuaggccaggugcaguugcucacaccuguaaucccagcacuuugggaggccgaggcaggaugaucacuugagggcagaaguuugagaccagccugggcaacacagugagacccagucucuaccaaaauuuuaaaaacaaaaauuagcugggcaugauggcaugagcuugugcuuccagcuauaccugggaggcugaggugagaggaucacuugaacccagggguuccagguuccaauaagugaugaucaugccccugcacuccagccugagcaauagagugagaccuuaucucuuaaaaauuaaucaguuaauuuaaaauguucuaaaguugauuguggcaauggaugcaaaacucucccagauacucaaauauauuaaaaagcuacugaauuguauacuuuaacugggugaauuguaugguacgugaagugggucucaauaaagcccccgcaggagcagcagcccacggaagcagcucccucccuggucgcagugagggcagggaccauagcugcuuuccugacuauggggucagcacaguuuuugccaauuguccugaacagggucccaagccuggcccuuugcacacaacaaggccggccauaggaaacuucauccuugggcacagccuccucccucccaaucaguauuccacuuuuauauuuucuuuaagagacugggucauauucugucacccaggcuggagugcagugguacuaucauugcucacugaaccccaaacucccgggcucaagcgguccucccaccucagccucccaaguagcuggaauuacaagcucgugccaccacgcccagcuaauuuuuuauuuuauuuauuuaucuauuuauuuuugagacggagucucacucugucgccaaggcuagagugcaguggugcaaucucggcucacugccagcucugccuccggggcucacgccauucucccgccucagccucccgaguagcugggaccacaggugccugccaccacggccggcuaauuuuguguauuuuuaguagagaugggguuucaccguguuagccaggauggucucgaucuccugaccucgugauccgcccaccucgggcucccaaagugcugggauuacaggcaugagccaaagcgccuggccuaauuuuucaauuuuuaguagagacaagaucucacuauguuggccaggcugaucuugaacuccucaccucgagugaucaucuugccucggccucccaaaguacugggauuacaggugugggcccccagccugggaguauucuacuuuuucuuccucuuaguugcuaugcuauuccugcuccucuuuucccagcuauauaacuucaacucucucuuucuaaccuuuccucuuugcuaauucucuucucuuuccaacuuccuuuccgcggguugucugaaccaaccauccuacagguccagcuuggcaagagaaacacacccaacaacagaguggcaacacuggcugcaaaaugagaagcauuuaaggcucacggugcaggcugaacaccaaagccaggcaaucacgcacgucgauuucaucaaacuccugucuacccaagugaacaucaaggcuggacaggcccagcaccuucugaagggugucuuccaggcagcgcggccagagcugagcagccucccuguucccucaggcagcuuugucccuaccucuagcaaacacacacacagugccaaccaugugccaggagccauccugaauccuuugcagcuauuggcucaugggcaccagugcccauagcaacccuaggaagugggcacuaucguuacugucgguucacaguaggagaugagggcugaagucacuugcaaaagucuccgauccagcaagaccgucuaugcaugugcugucccucucccuggccugcaagucucucgaaggcaagacccaguauuuaccuucagguccacacaccaccugccauggggcucucuuuucuuaaaaaaaauuauuauauacauauaagguacaaaacauuauauuuugauauacauauaacguagugaaauacauagagaaaugaucaccacagucaagcaaauucacauauccaucauuucacacaguuaccucauuuuuuuucggugaaaacacccaaaaucuacucuuuuagccaauuuccgguauauaauacaagaguaacuaccauauuagcuucaguccucaugcugugcauuagaccuugaggcuuauuuuuccuaccugccccucaacaggguucacaacagcauuauucaaaagaaccaggauacagaagcaaccuaaguguccacugaggaaugaauggauaaagaaaauuguauauacacacaauucaauacuaugcagccuuuuaaaagaaggaaauccugccauuugcaacgauguggaugaaccugagggaccugaagugaaauaagccagacacagagaugcugugugaucucacgcuaacaaacaaucucaaacacacggacagaguagaaaggaggcucccggcgcagggagugggagaaaugcggagacgguagucacagggcaggaaguuucaaggcugcaggacgcauaaaccuagggcuuuccauguaguagauguugaugcugacugguccugcugaccugaagaucaaagccgaaagugucuuucagcccucagaggauuucccaucuaacaugaacgagcgccacuggguaauggaccagaaggcaagcacguccacaaacagcaaacugcccgaaaggcaccuuccugcuuugcgcuggcuggcaggguccugggaaacagcucgagggcauggggaaggcucugggcuaacggaaggggaaacugcucaggagcacguggcaggcucagguggaaggggagccaggcaguggggaagacggguggggagggggaacuggugacagugcucuuggaaggaagguaugcuggagccucucacugccccuuggcaguguggaggauggaagagggacagcugagcugccagggcuccgggccauggagcuaguuugcacagauuaauguacaagauucacuguuuuaguaaaacuagggcauccugggauuucaacuuuaauacauuucauuaaacaugaaccagcauccaacguguagagcaaugaugaugaaagguaugaaaguccauacccugucuggauggcacuuguuugacccaauuugaacauaacagaaacugugaugcuuugauguuucaaucaaaugugaagccaacacacucaaaaaagugcuuauuacucagaaauaagagccuaagaggccuaacacuuuggaauauacugcccaucucacccaggugacuugccugcaccuggcacgcuaggugucugcccaacccuuagauuccuuuagggagauaggagugaaagcccuggagcuguccauuccaagugccuugucuaugcccagcaaggugacagugacaccuucacauccccagcaaagccacccuuggcaaccucccuaaccacacuguuaauaugaaagccuaaggggccucucccaccauagaauuacaaccucagggcuuggcugggagcugaggugucgcccuuuaaucuccauccuagaaucauauuuuaguaauccagcaacggaguguuauuacucaagugcagaugaaguuuugauuuucugcaucuuuaaacucacuaugcaacagagucccucggggcuuuuuaagagaagcagcccuuugagaguuguggcgcuugaugauaauaucgcauguggcacuuccuuaguacuuauuuccccugagaaaauggggaaaggacgggcuuuacuccaggguacuacugcaauguuagaagcagccuuucuuuauggugagcgagcaguguguuugcagaagcauuuccuauugagagcuuccuugucuucccauauaacugcaagacaccugccccgaguucacuguaaacuugucugguggagcaaugcgucuaaccacaagcugggucauucaggaauaucccauagcaguauaguauuuauuucucuuugguguccauuucucauaacuguguuacaaaggcguguuuaccuaggugacagcaaugacuuaacagcgggcuuguauccaauacccauucuguuuagaagacacuggcuacaccuuagcuccaguuuaaacuccagugucacaggugaagggcugugauauucccaggaucaaggcugggauaauauguaacuccagcguaugugcgucggcgcaucccugccaacuguaauuauccaaauugcucauaacuacaagaacaaguacauuaaaauaaaguacuuuugguauuuccaggaguuaauguaaucucaucuuccagagcauuuuauguacccuuuauaacuagacagccaagucuccuuagaggccaggucugggggaaaaaaagcaacauucucccacucucccucaaguuacucauaaaucuuaaugcuuaucuccguacccgugagagaugccguugaccaagaucuucaucucugcuggaaagaggguaaaucuacacuagcccuccuuagcaaggcggcaggcucguccucucucccgcucugcagagcaugcuggguccugaaaaccucacauucccaccacugggcacuccguuggcaggagccccaccugggcaacauguguacugggcacaccaaauuuccaugucuucuucuuaugcugacuccuuaccauuaauaacucaauggucauauuuuaagcuuuuuauuucggaauaauuacagauucauaggaaguugcaaagaaauguacagggaggucccaugcacccuucacccagccuccccuaaggccaccaugccccaaaaccagaggacaaaaucaaaaccgggaaauuggcauugguacagccgacaaagcuuauucagauuucucuagcuuuaagugcauucgugugcgugugugugcgcaugugcaucugugcaguuucucaaccacaaccgaaauaguacccacacacaaucaagauggcgccaaugggacaagaccccucaugcuaccucucuggggccacguucacccccuccugcaucccuaaccccuggcaaacacuaacuugucccucaucccccuaagaauguuauuucacaaauguucuauaaaugggaucacgcagcauauauccuuuugaaauuagguuuuccuaacuuuuauuuuagguuuggggguuuguuacacagguaacaaaccuaugcacaugugaagguuuguuacauugguaaacucacguuauagggguuuguguacagauuauuucaucacccagguauuaagccuaguacccaacaguuaucuuuucugcuucucuuucuccucucacccuccacccucagguagacuccagugucuguuguucccuucuuucuguucauaauucucaucauuuagcucccaggcuuuuuccauucaccaaaaucucccugaggcccaugcaaguugcuguguuuaucaacagucuguuccuuuuuacuacugacuaguauuccaccguauggagggaucacaguuucuuuaaccacuuaccuuuugaggaacaucuagguuauuuccaguguuggguuauuauuuaaaaaaaaaugcugcgaugaacauuucugcaaagcuucucugugaauguaaguucucauuuaucugggguaaaugcccaggagugcaacugguggauuauaugacaauucuauuuuuaguuuugugaagggacuauuuuccagaguggguauguuuuacauucccacagcaacguaggagagaucccauuucucacacccucagcagcguuuggugguaucacucuuuuuauuugugccauucugauagaugcgcagugguaucucugaguggcuuuaauuugcauuucccuguuuuguaaagauguugaacaucuuuucaugugcuuacuugccaucugcauaccuucuucagugaaugucucaugucuugcccauuuuuaaacaggauucauuguuuuguuaauguucaauuuugagaguucuuuacguauucuagauauuagugcuuuguuggguaugugauuugcaaauauucucucucgucuggaauuucucugcucuuuuucauuggaucuuucccacagcaaaggauaaugcuuuuggugucaagucuaugaauucuuugucuagucuuagaucccaaaaauguuuuauguuuucuuuuagaaguuuuaucguuuuacauuuaaaucuauaaucuuuaacaaguuaauuuuuauaugagguaugugagguuuaggguuuuuuuuuuuuucuaauggaugucuaauugcucccacaccguuuauuggaaaacuauauacuuccuccacugaacugauugucaaaaacuaauugggcauaucuguugggacuuauuucuggguucuucacucugguucauuacauaugugccaucccuuugcugauaccacacuuugcagcuccacaguaagcauuaauauugggagaagugagugcuuccacuuuauuauucuuuuugagaaaucuuguggacauuuuuggaccuguguuuuuccacguagaauaagcuuguguaugucuacaaaaaaaaaaaacauugcugagguuuugauaggaguuacguuaaaucuauagauaauuauagagaaaacugacucacuauuauguucauuuuccgauccaugaacaugggaagucucuccauuuauucagauguuccuugauauuuuucaucagcauuuuguaauguucauccugcauccuguaugagcauugugaaacuuauauguaaguauuuuauuuucuuggugcaacuguaaaugguauuauguuugugauuucaguuuucacuaguccauuguggggauacagaaaugcagucaauucauagccacggaucuuguauccugucauuguaaugagcucauuuuucaguuguaagagguuuuguuuuggguuuuguagaaucagucuuucauccucaacugugaaauugguuguagguuuuuuguaaaugcucuguauaaaggaguggaaggcaguucccugggccaccuguugcuguuguguggguggaugggcaaaagccccugggucugggucuccuggagccaccggauagggagugguccacacagcagcaucaggcuguccacugguggcuuggguguggagcgggccuugggcucccacuaggucucacugagcuuccccuuuggccugacagagccuuuugguuuugcuuuauuuuguuuucucuauaccuguuggcgguucugguuacaggccuuccugugcccacacuggaaggauacaggagauaaaacagaaguccagggucucaugguguugcuacccccucauguccugaggccccagucagucugccugcuuuuaguuuccagcguccuuuuacuguuucuuguuaaauuauuuacuuguaaucacggggaggagcagggaaaaaugaaucuacgccaucuuguucuaaaaccagaagccccuguuuuuaaaguuuucuaccguguuucagugcacugccuagaaaauaaaacacuggguuucauuuccuuguauuuugggggauauuucuauaggagccaaaugauuuucauacuaggaugaauagaaugaauaugucaacagucuuuuaggucucagucauaaacauuaucucugauuguauagauagguaaacgucuuugacuccauaaucaagcagacuuuuuuuuuuugagauagaauuucacucugucacucacaguucaguggcacaaucauagcucacugcaaccuugaacuccugggcucaagcgguccucccaccucagccucccaagucgcugggacuacagaugcacaucaccacaacuggcuauuuauguauguauacauuuuauagaaacggaaucucacuauguugcccaagcuggucucaaacuucuggccucaagcaauccuccuaucucagccucccaaagugcuaggauuccaggcacaagccauggugccuggccaagcaggcuuacuuaaauaucaaaaugaucacccuccauuauccagaauuucaaaaccuauuguucugaguggcugccaggaggugccaacaguuggcacgaaauuaagcuaaacucauguccagcgcagucacgccaugugccuccucccuggcaccagagggcugccaugaacccuaggagacgcaggcccacccuccaccccccaccccccacccccaccgucccggggugugaucucggcacuccaccuaucaccacccaaacccacaucagugugugcagaggcucccaggagcacagcuccacauaugucaaaguucagagauggaaggaaacuccucagugcaaguggagagagacagaugugauuuaaacggggaguggggagcaucauaaauucaccaagaaucuggcugaacugugccucuguauagacaggaugauagauuuucccaaaccagagcccagacuuggugcagaaaagaguuacuccucucugugcaggaauucaucauuugcaucccgcaucacagcaaaagcaggcacagaggcuuagagcccucuuagacaccuaugagugaauacagcuucuuauaaacaucccucccagacuccaucuacucagaguuuauccaggcauccagaguagaaaagguccuuuggggauauucaaggaaaacugguccccuguagaaagacagacgcacggcugccacagggaaacucccaucugagcuaucugggaaaaucaugccaugcccacagcucccgucgcagaccccacuaacucuagaagcuauuuuuggaugcacuuuccgguuaacacaagaaacuaaguucaagaacacggaccaggcacuggaagggcuggagucucccuuuuagccgauuuccugcuucccauggucucgcggagcuguuuuagagugcuugucugaaaugacacuaucacccaccgccaaaacugagacagcgcccaccacaguggauaccuguguucaagacaaaucgaauagagagaucaccugauuuuacugucaccccaagaacaugaaggagucaaaauuucagaaacuaaugauacaaggccacaaagcacacgguauuaaaacauaccucugucauacacuuugcucgcauauuuguuauuuacaagggguaugugucacaacacugcaauuugaacauuuucauaaagacgaggggagaaucugccauucaguagaagggacccugagggaacagguggugcguuucucuccacggcacgucuuugccagcuggagccucuacgaaagggaggacucauaaacugcaaccucaaguuaaauuaugaggcaaguaaaagggaauuuuaugggucuuccuaaacugaggaaguuuaagagauauuuuucuauuuuaucaccauguuccuaguccauuugauuuuaugaugucauauuuuaaaauaaagggauauuaauuguccagguaaucaaaaguaaaccaaauaauugaaauuguuuucuuucaggaaaaacucuccauuuuccugugagcuuuuaaaauguagggagaacaagcacuuacucagggugcagccccccaaccugauccuccugcccgccccaugcacccugaguggcaaaggaagaagagggcuccugccccuccuggcuggaccacccugagaggcugcggugggcgagcagugaggagggcagaccuggcugugcacgagcugccaaacagccagcacuuguggacccuguggcuugccgucuggggacaugcuuagccccugucugcaaaaugagacaaggaggggcuggcagccugcaccggcacaugagguggcuucagcuugucuuaaaugacagguuucaggcauggcuguucucccugucccucccauccccagucacugugugcuucugauuuuauccaaggggcacaggccugaacaagggccauagcaaagggaugaaugaaaagguuuuccauaaacuccuaccaaauacccggagaaagugguucuccacaaaucccccccaaacaccaggagaaagugugugaugagguggacacucaccaagcaagaccucgccucucacagagccccucuggcuggugccucuugggaacugcggggagcgcuggcaggcagcuucucacugcugacugccaggaaucugggcacgcacaagggacacagacugaauguauuaacgaagguggcagugacauauucaacaaaaggccaagaagaccaagugaagccuucaaaaucaggaaaucagcacggaccguuuguguguuugugugugugugugugugugugugugugugugucaggccaccugggugauggccgaaguuaacugugauaaggcccggccaccuccaccaacauacacacugagccuccccggaacuguuuugcauacucugccucgagcucacagucaugucccuguuaccagagagcagggccuuacaagaagugucaagguugagagaaagugugggaugacaucuaggcaacaagaccacagacagggcacccgaccccacccaugcugacagcaacucuccugggcucccuggccaaaggacuacagggaggggaguaaacacccagccagggcccgacaccucuccacuggcagcagcagcauagugaguuaaggggccaccucccuagagguccugagagcagcacaaaugcuaccgugggaggguccccagggugcaugcugcccuaggcaccaccccaacaaagccgucccggaauccaugcagaaugucuccacggacgaaaaaggcaagacacucaaacagacacugguacccccauguucacagcagcacuguuuacaacagccaaaagguggaagcgcccaagggucccuuaacagaugaauggauaaacaagauguggugguggguucaugcaauggaaugguguccgccucagaaaggaggcucuggcacaugcuccaacacagaugagccuugaggacacgaugcugagugaaauaagccggucacuaaaggacaaguacugugugauuccgcucacgugagacacccagggcaguccacuucguagaggcugaaugcagaacgguuguugccaggggcugggcaugggggaagggggaguuaguguuucacgggcacaaaguuuccguuugggaggauaaaaaguguuggagaggagggcggcggugaugcucacaacaaugugaagguauugaauuccacggaacugcacacuuaaaaggguuaaauggcuaauuuuauguuauguauauuucaccauaauaaaacaauuuuuuaaaaguaaagcacaagauagaacacgcuuaagguuauaaggcugugugugccaguggagcacagcucagcugcucagugugacagugacaagccccaaguuagcacgugguccacuuccaggaaguggaggagucagagcgccccaccccucaugccucaaccuucagaacugacaugcucagcgcagaagggccaccccugggcaugaggguagaccauggugguggucccacacugcugagcguucuucaagccuuccuaaacaucccuggauaaaagagacagcaugagaaucaccuagccugacaugugccggacacgugccugacacgugcaauguuccuucagugaucuaaaaugacaucacaacauaaagcuccuggaagauguucuggguaguggugccuaaagugaugcccacacacaaaaacauacaccaucacaggagugcagaaaaacacuaccaccuuuguuuguaauugugguuuauuuuauuuucauuuauauuuuguauguuucaauagauauaagauauuuaugcauuacaugccgguaauuuauaaauaaauacacacacccccacuuugggugcacaugcccacuuuuuacugauagaggugugagaucaaaaacaucugaagacuguggcuguaaugaaccagcuacacuaaaaaggaucaauaacauauacauuuuucuaaaaagcauccauagagcaucuuugucagcuauccuuguuaaauucuggguauuggcuuuuaucaggauaacuaucugguguuagacacuuucucaaaagccagaaauauuuaaacaacuugaucucauccacacacaucaaagaucaaagggacacaggaggcucugacugagcagcacgcgcaggcacucagccaguggcccugaguaacaucucuugggaccccagagccccagggccaccuguucugcucccaggcucugccccuuuuggacugaaaccucccucucugggcucccauuuccucacaggaacaaugaagaauuuauaagcucuucacagagcuagcuaagaaugguaccauacaaauucauaaaaauucaggcaaguauauggugcuagagaaauacgugaaguuuuaucacuaaguauuugaacaacaauuuuaaaaagcaccuuuuuuccaccguaucaugaucuuugcgggucacggggucuucaugaucccacuaagcaauuuggagcuauuccauauauuccuagcuaauucaaacagcuacagccuuuuuuuuuuuuuuuuuuuuuuuuuuuuuuuuuuuuuuuuugagauagagucucacucugucaccugggcuggagugcaguagugcaaucauaaucacgucucacagcacucuuaaccuucugugcucaaacaaucucagccccgcaagcagcugggacuacaggcaugcaccaccaugcccagcuaauuuuucguauuuuuuguagggaugagguuuugccauguuuuccaggcugguauccaacuccugagcucaagcaauccacccaccuuggccucccaaagugcugggauuacagaugugagccaccacaccuggccuacagccauuuuuuaacggaaaucaucuuaaucaauauuaacacacaaaaagcuguaguuaagaaggugguuucugccaggcauggcagauagagccuguauuuccagcuacuugggaggcugaggcaggacugugugaggcccagaaguucaagaccagccuggcaacacagcaagaccuggccucuaaaaaguguuuuuuuuuuuuaaucaucuguaaaaugaggaugcaaaacaaacaaaaaaauaaacaugguaucuguuuguuaaacucugcaaugaacacauguauuagcuucccgcugcggcaacaaauuaugacaacuugguggcuugaaguaacacaaauuuggggaguuuuauuuuauuuauuucauuuuauagagauggggucuugcccaggcuggagugcaguagcauaaucacagcccagugcaaccccagucuccuggucucaagugauccuccugccucagccuccugaggaccugggacuacaggcuugugccacugcaccggcuaaacaaaucugucauuucacaauucuggaggucaaucugacauggaucuuacugggucaaaacgaugguuucggcagggcggcgggagagaauguuuccuugccuuuuccagcuccuagaggccgcccacacuccuugacucuagguccuccacuuucaaagccaacaauggcaaauuaaguaguauucauaucggaucucucugcccgcuuuucuuccacuuuuacagacuugugauuacacugggcccacaauucacuccagaauaaucuccccaucuuuuuccaagagaaaggggaauuagaauuggcugcaguuaagguggcaccaucagcugauuagccaccuuaacugcagccaacuuucauuccccuuucucaugggaccuaagggagggcaguagcuccagggauguuuuacaauuuaaguucuauuauuauucaagcacuauggggcugacaggucaggagaggacugccauugaaaagaggauuuguuacucagaguccuccagagaaggagcucgccacaccuaccgcugugggagggggaacauaggggagaccagcguccuaggaggcagagaccuuggugagaggagggagagucuuuucugugccuuccaugggaaagaacaggagaggcgggguaagcagguuuagaauccauuaguuugaauaaccucgguggacccugggacaaagggcugucccuagcugcuugguggcuggaccuggggugaugagagcaggugcacaguggaugaaacacagagggggccgaggguguggacguuggauuggguggcuugcacacguaaggcaugcugcagcaaugcuguuugcuaucucuaggaauuaucuagcccugggagggccugucccuccggaggcagcaaggcuccagaugucaaagcaccagacaagagaaaauaaaaagacauccuuaguacaggacugaauaagcaggaacugaguuuagaugucacugcaugcaguaguugggaacagagccaagaauuacagacaccacccucccuccuucuacgccuucuccaagucccaagggcgcauuaugaaggaauucccauuaagucuggccagacgcuuuacagaggaauuaacacaggauaggaaacugaaaggagaaaaagagaaaagaccagaaacggaggaauuuaaccgugaucaaggaggagcacggcgcagcugcaggacugagcucaacucuggcucucaccuccaugccagagagaaccugagggucucugucagcauggccuccuggcccccagacaugcuccccauggaugugaaagaccacaggcagcagccagauuucuauggaaugaaucaaacuuuccauccugcuuaaaagcaaugauuuucuuuccaaaaaaaaaaauaaauguguacauggaaaauauuacaaugcaagucacaaugagaguuaaaaaagacacacacaucugauuugacuaaagucuguccuggcaacacgaauaaauaaaauaaugacaaugacacgauggcacuaugaaaugccauuaccuagguuucuaccaauuaauuaugagggacaagacauacauaacuaaauauaauuaaaucacgcaggucgauaagauuacccuuuuugagaaaauaauuacaugccacguauauuuugaaacuguucaguggaggugaacaauuguagcccauuauguguaugagacauucuggaaaauaucgcuuugacuuauguucaaaaaugguuggcuuguucagagagagagagucaguggggagcacccagcaggaacaggggccuccccagcucgcucucucccugccucgucuuuccucucacaaugcucucgguuuucugagucaaccaugcuccugggccaaggugcagcacuggagaugaccgagacagacagcguggaugcguuuuguacggggaacaaaacugauuuccaacuuggcaaaaagcaacaggagaggccccggcugugucugguaccgccucagccgagcccugaagggaaaggcccagaaaaagggauguggccacacccugggggccagcccacaggcgaggcgaguccccaggcgccauucuacgcggccaguuuuggagaacuggaacuguguagagcguccggcggcagcggacccagcgcugcuccauucucccucccucccuccccccccagccccggugacucacuccgcggcccgggcagggcgagaccacgcccaccaccccccaagaccuggccgcgcucaccuccccuccugcacagagcaccuaagggcccaaagaucacaucugaacaaaggauggaacuuggaacuuacauuuaccuuuccugccccugacuuuuuaaacuguuauuagaaguauacaaaaacaaaaggcaggacauaaaaguagugaaaugcuuuaaacucuacaaaugacucaguucaaaugugcggugacagccuggguuuccugccauuucguuaaccccucguguacuggauucuuuuagaagcagugguuuccaugccagacaucacuucuugggggaagcaaagcaaacagaggcuggggaggggugaguggggaucucggggacuccgccgaacuuggggagggagccuugucaagucuggccuggcccacgcugagguccguucgcaccccaggaccuuucuagaaaaguccuagauuacuauacaacaggcagaucugaugcugaaacagaaauaaggcaggucucugagcggaucuaaaguucccuacuaugcaagagcucacgggccuccaaagcaccuacuaagcaccuuucugagaagacuugcauggagggcucuguuccaaggcucuccauucguggccuagguugaguuuccuuuugaaaaccaagacuuacuuuagguuuuuuuuuuuaauuauuauuguuauaacuguugauaagcaaaaaucaaucaaagacaucguuaaaugggccaaugaauuuacuucauuuuauguuuucaaaacaaaccuucccccuaaaagguuauuaccaaauccaauuucauuuacaauauacgccacauugccauuuaaacaaagaaugcuuucauguuaccauuuccccagaaugcuucuucuagugagguacauuuuucagaagacauuugagccaacagaggguaucucuggauccuuagugguccucaaaauucucaguggggaucggaucuauucccaauauuucaaaauucuuuccaaaagcuguccauuuccucaugguacaaguauacagcuaaaugacaccuaaaauucuuugggcuuggaggcacaauucagugucuuagcaauguggacaggccaggugcggucucaguauuuugggagcugaggugggaugauugcuugaggccaggaguucgagaccagcaugggcgacacugcaagaccucaucucuaaaaauaaaacuguuuuagaaauuuaaaaaaacugaggaaguuuauuuugaucaaaagaucuuaauagcaauaaugacagcaguuguaacaggaauacuaaugaguugcaacuaaacuuuucaaauucuuaccugccugccugccuggcacuguagcccacccucucugcauuauuucauguauuccucacagcacaccagaagcugcuaucuucucucuuccccucccuccaauuuaaugccauccucccuccuauugaaugccacccuccuuccaauuuaauguuauccucucuccaauuugaugccauccucccucuauccucccuccuguuaagugccauccucccuccuauugaaugccauccucccuccuguuaaaugccauccucccuccaaaguaauguuauacucccuccuauugaaugccaucuucccuccaauuuaaauaagaacacugggaugaagagaaaugcauucugccuagcaucuaacugcuggcaagggucugaccucauugaggguguuggggcucaggaaccaauaucgcaaaauauggcacuuugaugcgcugaacuguagaacccucagcgucucucuaaccgccccccaaccucaccucucaauccucugucucacccaaagcccaagaugaacuccuccgaaguucccuucucucccuaaaccuaaaauccagacacuccaaagaggaaaacagguuuuuauuaacugaauucauauugugggaagaaaaacugaagucugucaacacagcuggacaggcuuuugucacaaaccacugucuguuaugcaggccucaaagacuguggcccagacuaugguguguucuucaagcacagugaauuccccuaaaacucauuuacuaccccuguacaaucauccccacuucccaucucccuuucccuugagaaggaggguauauaacccugcguacuccacugagauugggcaaucauucucccacaguucuucugugcuaugcauguuaauaaaugugcuugccuuuucuccuguuaaucugcccuuugucaguugauuuccagcaaacuuucagagggcaaaggagaaguuuuccucuagccccuacaagggcguuuuaauugucucuaacuuaaaaugaggacaaaaauucuuaauugccuaauaaaaauaguuugguaggcaaaauguuccaaaauacaguauccccaguggaaaaauaaccacaagguaugugcaggguaauucauacaaacugcacuccgggaaaaugcaaaacaaguaaacauagaaagucaggcuaagagucuucuaaaaaagcagaaaucaaaauagcucuucaugcuuccuguaaguucugucagugugcuaaauauggcaaggugagucuuguacaaaugugcacagugggcuccccugcugcaggaguucaacaagaagcugaagcaccauguugugaccagcaggagucuaacagucacccagccccuuuucaaccuucccaaaacguggggaagcccugucuuuaaaagguucuuccaaacaugcuucucagugaaggccugacuggccuuugggaaaggguagucaauggggcaggaccuuccugggcagguggggccaucacaugucagccaguaaccccgguugugaguaccagugccagggacacugccagucacugugauuguuaaaugucuaccaacacgucgggaaggaaguacucccccccagaugagaccccugaccccuuacuugcaggaaggauggaaccugagaauugacaaucaccacaaugaaugaccauuaaaugagcaccaugcaggccauggcauagcacccaggaacaggcagguggggcuucaaaggccacugaaagguacagaagaacugcauuaaaaauggcaagaccugguggaauccaaaagaaucagcuaaaacaaaacaaaacaaaacaaccaaaaacaagaccacuugugguuccaaugagcuaugauugcaccagugcgcuccggccugggcaacagaguuagacccugucucagaaaaaaaaagaaaaaaaaaaaaagacucaggagacaacuugauugguuccuacugaccaaagaaaucaauuacaguaauaacugcaaugaacuaaaaucaauaaauuauauuuaaauccacaaauucauaauaauauauuuuuuagaaaaguuauauagcccucaggagaagugguugguucuagagcugggccagccaaaauagaugagccuggaacagcccauguagucagagaguaagggagaguucagaaagaagaaagccuggggccugugaaggacaggacagccagcuugaaagagcucccaaaagccacagccuggaacagugugagcaaaaggaucaauuacauuaauauccacugaucauccccagaauaaaacaaauuuccaguagacuacaaugacaucagucauggaguauacaaaucaauaagaaagaaaaacagcuguucuaagaauucuaguucaucaauagagaaggaauagggggaaagaaaaucccuauuagaccacacuacaauaauuacuacagacuucauggaaauagaaaggauuacaagugcauaccaagugcauaugacaacaaauuaugugacucaaagaaauggacaacuuccuagaaagauacaacuaucacaacugacuugagaagaaauaguaaaucugaaaggagucauaacaaguaaauggguugcaauaguaaucuuuacaacuccgcacaaagaaaagcccaggcucagacugaaguugucuuccauguugaauucuuccaaggauuuaaugaaggauuaauaccaaaucuucacaaaaucuuccaaaaaagaaaacaggccgggcgcaguggcucacgcuuguaaucccagcacuuugggaggccaaggaggauggaucaucugaagucaggaguucgaggccagccucaucaacauggugaaacccagucucuacuagaaaaauacaaaaauuagccaggcauugugaugccugccuguaaucccagcuauucggaggcugaggcaggagaaucgcuugaaccugggaggcggagguugcagugagcugagaucgccccauugcacuccagccugggcaacaagagugaaacuccgucucacaaaaaaaaaaaaaaaacagaaaaaaagaaaauaguggaaacauggaaacacuccccaacucauucuaugagaccaguauaguacuuuucugauaucaaaaccagacaaagacacacauacggcccccaaucccaaauauugcauaugaauucaaaugcaaaauucuccaacacauucuagucaaugguauccagcaaaauauaacaauggauuguacaccaugaccaaguaaguuuuaucccaggaaugcaagauugguuuaacauuugaaaaucaauuaaugaguauaugucauauuaauugaacuacacauaaaagcuacaugaucauuucaacagacguagaaaaagccuuugacaaaauccaaaauucuuucuugaugcaaaaacacucaacaaaguaggaacaaaagggaaauuccucaaccugauaaagagcaucuauaaaaccccacagcuugaaaucucaguauugguuaaaacacacacacacacacacacacacacacacacauacaugcaaacagcuagcaucauacuuaauggcaaaaaagcaugcguucccccuaagaucaggagcaagagaaggacauccauuuuugccauuucuauucaacauuauacuggagcuucuagccagggcaaucaggcaagaaaaagaaauguaagguaucaaguugaaagggaauaaguaaaacuaucucugcuuacugaugaaugguucuauauggaaaagacuaaggaagccacaaaacaauuauuagauauaauaagugagucagccagguggcaggacacaagaucaacauguaaacauacugaccaaaacuuauuaaugcauuaauggaaaacuguuuagaucuaaauaaagaaugugacuuagugaauagcuuuguacuaauguuauuuucuugguuuuugaaaauuauagugcaguuaaauguuaaaauuaaaagaagguggguaagggguaugcaucuguacuauuuuugcaacuucucuguuaagucuaaaaugauuucaaaguaaaaagcuuaagaauuuuagaaagcuaacugguuacugauauggguuggcucucuguccccacccaaaucucaccuugaauuguaauaauccccacgugucaagggcaggaccagguugagguaacugaaucauggaggcgguuuccuccaugcuguucucgugcuaaugagugagucucacgagaucugaugguuuuacaagcgucuggcauuuccccugcuugcacucauucucucuccugcuaccuuguaaagaggugccuucugucauuauuguaaguuuccugaggccuccccagccaugcagaacugugagucaauuaaaccuguuuucuuuauaaauuacccagucuuggguauuucuucauagcagccugagaauggacuaauagaguuagcguuagauguuagugauccaauaucaagcacuuauuucucuuuuacuauacaggcuggaccacugggaaaccagggaguagaugaggggaagugucucuuuauaaaaguauuuccuauaauaaauuaggacaccaccauuuggcaaccucuaacaaaucaauggauauaggcaaugaucaucaauggcugucaacaucacaaaaagacaaguaagcacacgugucuccuaauggaagugcagaacaccaccuaggaauguggagaccaaaacaacgacaacaacaacaacaacaacaaaaauucaaaccugagccugaugaaacacugaggaagugugcagacccuccuaccaauccacaggaauuacaauagaaaaaaaacauguuaccugaaaccacacagaaguaaucagcaguauucaggcccuggaaaaccccauaggacaaauaacccaauuucuucaaaauaaauugcaagggaaaaaaagaaagagaauagaguuuucugggggaaaaucuauagacuaaaagugacuuaaaagauuuaucagccaccugcugaguaggccucauuuauagcuaauucaagcauacauauugaaaaguacacaucccauuuaugagauaaguggaaaucugaacacacacuggguauuuaacaguauuaggaaauuaggcugggcacacuggcucaggcuugucaucccagcacuuugggaggucaaggaaggaagacagcuggagcccaggaguuggagaccagccugggcaacauagugagaccuuaucucuaugaaauuuuuaagaaaaauuagccaggugugguggcgugcacccguggucccagcuacucaggaggcugaggcaggaggaucacuugaggccaagagauggaagcugcagugaaccgugaucaugccacuguacuccagccuaggcaacagggcaagacucugucuuaaaaaauaauaauuuuuuuuagguaugauaaugguauuuauaguuuaguuuuaagaagagucaugcuuuucuaaagacaaauacugacacauuuacaggugaaacgucaugaugucuggaguuugcaucagaaugacagaggagaagggaguaggugggaauacagauaaaauaauguuagccaugaguugcuaauuguugaaacuggacaaugguacauggcaguuugucacaugugcacauuucuauguaugugaaauuuucuagaauaauuauuuuaaagaggccuguuguucuuggggugggaauaccaaguaagguaauaacugugaacacggggucagagcaggguagaucugggcucaaaucacgguacugccaucuccuaacagugugaccuuaggcaagcuauugagucuugaagccucaguuuccucaucuguggaauggggauguggaaaugauaugaucguugggaggauaaaauggaauugugcauauagaacauuuggcucauauuaacaaguaaaaaaggaacugccucaugaacaagccugccuuuggaugacaaccaagguuuuaggaaaagaaacguucuuuuuccacugcaacuugaccucaugagcccaguaauauaugauauguaacagguaccgaaaaauuauuuccaacaaacaugugaauggcaauguggaaauaauauuccgcaagcguccagugcccuaaccuaccuacagggaugucaacccugcuuaagaagaacuggcguggucccugcgcauucuuaacuccugggucuuguccuggugucucugcuuuugcaaaccuuuuacccaaaugacagagaugcugugcuucccaggggaaagauguguugacugcugucuuguugcauuaagagggagggauggagggaauaugccaugaaagagccaagggugccacagaggaagagaugaggcucaccuggaagggaagggaaagaggcacggagaaggaguaggagaggggagacaagagaaacaaaagcccuggcagaaaagaaaacaaaaggaggacuuuguugagugagaagcucaccuucucaucugcucagcucuuccaaaacaacaaagcaugaagggcaggggacacggguuggagaaauaacccuggugggcugggaaaauggagcgaaaaucaaagugaggggaagagaccaaaaguagggcaauuccaaaauaagcagagagcaccuccugacuaccuguuucccaaaagaugacggaaagacacugagaugcugcccucagacccaagcacagagcccagaagauucagggaaaagucgccuccgguuauuuccugcagaaauacugcugguuacaucauccuggagacagacacugaaaggugucaauaagauuauauucaagucaucacaaaguacauagaagcaaaagggagaaaaaaaaaagauaacaauagccuaggcaggcuuugggggacagaugaaaucacuggcccagguccuccuccagcagcacccuugcaaggcacacuccauuucugggagcagggcuccaggucugcugauuuaagguuuccccccucaccccugcuguggaagagguggaugagaaagcuuucugcaaggcacaaagucuucuucugauaggagaucucugcuuccugccugcagaacugcccgccacucucccagccugggcugagucccuuugcccuucucuuccccucuccuccuccagcccugcccagcaggaccccugagguugcucugcugcccccucagcucucggccccgagggaugcccacccuguuccagcuggacacucaguguuggagaccgaugucagcuaaagggaaguccaagccucaaaugaaagccggaggccacaucccccucgacucucaccagggcucacugaguggcagggucucaagcgcaggcagccccuuucuucccacccggggcugugggaagauggcuucucugaacagccuuagccagcaccgagguccauaugaucagaggggcuucccacacccucccaucacaguggaccacagcuuagugacgcuggguggguggcccuuccccccugcaggcgccacaggcaggaccuaacccccccagaaucacccagugcucccccaaccugcugagcguggcucaagaggguuuuccuaaauagcgugugaaauccauuaggagaaaauggguucagaaggaggaaacaggacugcuucucaaacacccuggccuaggaagcuacauuucuaacaggcucuaaggggauucucacagaaaggggcccaaggauggugucacugaaaaacagcacauaaauaauaacauaaacgaugacgcacuacaggcugcacauccacauacaagggaaugucccagaagucacuucugggacaguggcagcagguaagacuuccagcuaaagucugcucauacucugcgugaacaauguguugcacgcuuggaccgacacuccuaugcacagcagcuagagcagcaacacuuggaggaagcgccacacaaaacagaccuagacaguucacagucgugcgucuggucuucucugcagucaaccaaacgcacugcacagaccuuggccugacacagaagucauuuccuuggcugcucugugcugucugggugccagguccugagagccagggcuucaugucgaugcuucaccccaguguacccuagaaccuguucucaaccucugugccaugacccuguccaccccccgcccccgaucucucacugcagcacccacucucugccccaccuugcuuggcaccauuuuccugauccucacaccaccgucccagacucuuguccugcacugggacgccucgccagacauggagccugcaucccggggcugggagccccacccaggacuucaccugguagacaugcccuauggugccaucugucccuacaguaaacucugggugaaaccagccuccuccuccuucuauucccagggccuggcaccaccucuuccagccuuucugggacuggaagaauuugaccugccuucccagggaacaauaaacagaaguagggcauugcgcccacuguccucaaggcagcugggaagugaaugaaaaaugcugacaguuccuucaguaaggaagaagacagagucugagggagaguuaagauaucuggagucaagggcagaguggaaggggaggggaacguagauggguguaguccaaauggaagcuaaaguuucaaagucccaugaagccuuacaaggucacagagacaagagaauagcuuuuagaucccaaccucaguuuccucaucggcaagaugggugugauaguuacuauaaggaucgaaugacauaauggauucaaagcacuuugccaacugaaaauaaacuguauuucuccugaggcauaaguauuucuaaaaaggaggcuacaggaguuacgggcucaguaauaacaggaagugguaucugugcaaaggcuuaaaacuguugagccccaccagggcuaugugguggaggccucgcucaggggacacggaggccauuuguguaaggggugccgcucuugucccugcucaggcuucuggugaacaggggccaggaaaucccacagcccggucuaaugacagucacucuugcugacuggccaaagagcaaggcuugggagcaggcagagugguguuucugaaagugugggccaucauauaagaguuacgugcacgcuaaucuaauacauuccugggcucaaucccaggccugcugagugagacacuuuggaaaacuguaauuuuaacaagcgccuucagugacucuuacaaaaguuucagaagcacgagcaaagaaauauucaaaaagcugugcgggcgggaagaccugggucaaaucccaguaccacgaccuugcugcugugugacacugggcagguuuacuuaaccucucugaacccguuuacucuguuuacaaaaauauggagcauaaccacugcaguguugcugggagggugaaagguacucaacuacagaggcacgcauccauggcuucauccaagcuaugagugccugugucuaaggcauucgugaaugccuacguuuaagaggcaggagccacucugacccuccucuuuuaggggaacaaucugccacuaagagagcauagggcuuccuagagucuccccaugcauaauggaagccagauaccgcuaauguucuauucagaagcccaucucagucccuguuccggggucaagcaaggugaggcaggagguaacgaugggcugagcuuuggaggaaagcuaagacgacccaccuuucucagggacagggccuugaggugguccaggcugcuggacacagcuccaagauggaucuaccaaggggcucuccugggguggagagcauaaaggaugaaaaggccgcaggccucuggacagguccgccggagacucuaaaacucagggagggaaaaagagcaggagugguccaucgcagggucaccccugguacugcccguggcagggcucacaaacaccccacagccucuuucccccaggaagcagguuaagaugaagaaaauuaggcaggcagcuaccgggcggugccuggcucgcggcucauggcucacaguggaggauggacacugcuguuauuuccccugcccugguaccugggccgugccagacauaucagcacuuggcggcaguuucacuuugcugcuguccugagccgagcuguuagcagacugagcuuuacuguccugugccggcuguucagagaccacugugccuggccgaagacugaggcagggacuucaggccagggggccaggcuggcuuuuccugccuuucacuucaggugggagcggcuguggaugaggauguccagcggccgucgguuucuagccuugggaucauucuggccccgacacggagugacaggggauccccacgcguccccgcauccagggcgccccuuuagcugcggcggaggcacagagaggccuuggcggcgcuguggcuucggucggcaccgggucccgcgcagccgggcccuccacccugaguggagcugccuucuaagcacccagccccugccaaucacugugcccaacaccaaguucccggggcgcccugcccugcgccaccgcgcgcucgcucgcccgcccgcccaacucaccugcugaagaccaggcagcccaggugguugaucuuguggucggagcgguggcggcuguaguccucccacaggucccugaaggccgugauggccaggaugaagagcaccggcgccagugccaggccgggcuggaaggcguucaccgccggcacgaaguugagcagcgcgaugaagacaaaguacacguuggccgggcgguggaacugcucgaacagguucuugggcaggaaggacagcagcguguacuugguagucuugagccgguugucggccaggugcugggcacacccgcgccgccgucgccgcucgcccuuggccgcgccagccgcaggguccucggcgcccgggggcggcagcagguuggagcgcaccgugcgcguccugcccucucggcgccuccgccgucccggaggcccgggcuccucgguccccgccggcucccgcuccauggccgcgugucgccgcgcccggcuccuccgccgcucacgcccgcccgcgccggccucuuagguuaucaucacucgcggcccgggcgcggcggugcgagcuccccgc

SEQ ID NO: 192878 - RNA, 2455 nt, Homo sapiens
uaaacagaacugauuuauuuauaaaguucacgcucccuugaagaggugugccccacacaggcuucucccuagcagagcagcagugcccacaaacccaccccagggugggcugucacgggggccucacgccagggaccccgccccucagggacugcucguguccagaucuuggccagcauggaaaacuccagauagugggggcagggguccaggucaucuuuauuacgccccaggucaaggguucuuuguacaaaaauaggucuccguuugccagcagugucccuccagcagcucaaguuaauguguagaaaauggauucucugugcccuuagaaaauccucuccccuccggaaaaaucuccaaguguuggugccccccgccccacugcagucgagaagcuguggggaggggcggcgucggaggaagccgccagcccuuauggggccagcuccaagcccguuuccaccgcggcauuggucaggcugggccggacgaacgaggcggcgucggcggugcggggggugguggguggguccccggcucgcugggggcggagcgcgggccgguccaccuggcgggcuccccggcgaugagcgcgccggccgcucgcucggcuuccggggcugaggcugcggggggaagguggggaaccaaacgcgcgucaacgcgggcgcgggcccggggcagaccccgcccgggccggcccugcccgcaccucccccaagcgaagucggcaguuucguuugcucgguugguuuuggagucuugaguccgugggugccgcgacucggucugagacacggcgggggcggggcgggcgcucggagccgcggugagucagggcuccgcgcccgccgacucauuucugccgccccggcccgggagcgcgauuugcaaugcaaagucaccccgccuccagcaccccaaucugccccaggauccgccagcacuagagaccucaacggcccgacggccgcuccccuccccucgucuaccccucccucgucggcggcugagccgcgaggggaaguuuugcaaucccggacaaacaaacgccggucuugcacgggcuugaaaaacuuugggggaaaugaagagugagcgaaaucgaagccaucgcucgggccuggcgcucggcuccgcgggcuccugggggcgcgacccgccgggccugcccaccccgucccuccaccccggcccccggcccucccuccucccugccucccggcuguuaccucauaggucgagggcgcucaguagcccccuaaccagcuggagaagucgaguagcucgcgcuccgcaggacucagcgcgccuucgcagccgcugucguccgacgaguaggcggaacgcggggagccgggcuccgagcugcccccgcggcccggggacgaagaagcgcgggagggcgaggcggcgaccgggguggucccuggcggcccgcggggcgcagacggccgcacggccugcggccucagcccucccgccagcgcguugcgcacggcgucgugcucggccagcaggcgcugcagcgcgcggauguacuccacggcugagcgcagcgucuccaccuugcucagcuucuugcuggcgccgccgugcggcacgugcugccgcagcgccuggaagcccaaguucaccagcuucacgcgguugcgcucgcgcucauugcgccgcgcuacggccgcugcgccgccuccggucucugcgguggccggucgccgccgccggcugcagcgcaacaguuccggggacgcgggucuccgccgggcagcgcagccgacagggacggggggcgcagggggcgcggaccugggcagugugccgccguccaucgcgccugcauccacccgcccgcuccaggucccggcgcgccgcaggaaggugcaggcagaggaaccggaggcgacggggaaaacuguggcgccccaagggggcuucuggcacggcgccgccaggcaacuccccagggcacgcguccuaggucgucuggagcccggggauaggaggccuagugguggcaggccguacgcgccagggagcgugggacgcucgugucccgcgcgugcggccggacucucccaggucuccgcaggcgcggcgcaggcggcugguuuuuaaauguauagauaacccuccuccgcgccgccgccgucgccuuucucacgcccuccuuccuucgccucgcccucccgccacgcuucgcccucccccucgcgcgaucacauucuguaaggcccaaagcgugcgcaugucccccuagcccaucccccggacgcaguccacagauccccagugcgcccaacuggcgaaaucugcgaguucccggugcgcccccugcucccggcaggugcuuagugcgcccccaaagcaagguacgcagguccuggguugagccuucccguacccccacccuaaccccgcgcgcagccccgccagucccaagagccgccag

SEQ ID NO: 192879 - RNA, 78237 nt, Homo sapiens
aagagaacacguaugugucuguuuauuucaagguguggaacacagacacauccccagaugggggaggaggggagacaaggacacggguacaaaaacuggaaacaaagccacccgcuacagcucagacggcaccgccacgaugugguuuaaggcucuguacguauauauauguguagaggcucacacacgcgcacacgcacacgcagagcggcacugacacggggacugaggccagacgugaaggcugacugcagcucgcagcccaccuaaaauauugcaauuauguuuauuaaaaaaguguaaaaugggaagacugugcaucggucugaguaaaguggcgaacuugagccuccccggccugggugcggggccagcuaagccacaccccugcgccccccacaccccugcacacaccugcacccacaaccaccuccaccugcgugugcccccaccagagcgagcguccagguguggggguggggugguuccaggaccugccucuguggggcucccauccaaacagcacagcguggaauaaaaaaccaaaaugccuuccccagaguggcccuaaccugucccuggcacccaccaguggccccaccaggguggucccggcaauguggacagggucuccggaaggcaggccuaugcaucuguguguggggggacuccugggccacucggggcuccuccaaaccugcccacucacugcugcuggggugugacuguccagggcccccacaggcccucccacccuaaauccauccaucccccauggcaaguggaggccggacagggggugacacggcaagauggccaggagugcgucgcacagcagaagcugcauuuggcuuuagcauuaaggccagcgcugggcggaaggcccugcagagaggccagugccccugagaggggcccagcacaccugggcccgcagcgccuuguggccccgggucccuccugcgccuggacuccccgucacaguggcugugcuugccgggccucucugccuccauggagcaggcuuaaagugcugggugccugggagggagggcucaggaccggccaggagcucugcccucagggcuccuauuugaggaugugguuaaugaacagcugacacgccaggaacacgcagagcaggaaccaggaucgggggcucugcaggaggccuggggucggugccugugcugcccgugccguggagcucagcauggccgagaggugccugcaaggacaggcgacagaucgugggggcugugccaaugccagcaagucccccucccacaagccaggacagugcccuggguacuugaccaggugcuggacacagggccgagguggagaugggauggcccuccaggggcaacagagcggguggggguggaaagcuuguuagugggagggccccacagcaccauggcuauacugggauucccugggcacauucagggcagaggagggucagggauuggggagucagccuuuuacauccucccucccaccccugugguuauggcugagucaugccucugccaccuucauauguuggaguccuaaccccuugcaccuuagauaagacuguauuuggagaugggguccuuaaagagguauuuauuuaaauggagaccauuagggugggcccuggucccaugggacugguguccuuauaugaagaagagaugaagacacagacacagcgagaagcuggcgucugccaggcaggagagaggucucgggauaaaccagcccuguggcaccgagaucuuggacuccagccuccgggaccgcgagggaguagacgcgcuguccgagccccuugccggcaguacucugcuguggaggcccuggcccugagcuggaguacuuugccguggaggaccuggccucugaggcgguauccaguuugcugcagaagcuucuggcugaguccuggccaccugccugacagcugaccugcuucuggggagccaggccucccugcuucucugcccacacagccucaccagggagcaccuucuggaaaugcuuacacagggacaaugacaguuccccaaggcucuugagccucacagagcccgggccugugcccuggcugcauuucacccugggguacugcuaucaagcccacuuuacagaggggaggcugaggugugacagccaaggucccacagccagugagacccucagccuggcucagagucaggagcuuuggacccgagagggacccugugcucugcuccucauuggugggaucugcugacaggaaggggccauguggcccugguggccugcaccugccagcucucggccacucccauuugcuccuuccccagccauuccugagaagccacugugcgcagguauggggccaccacagugagcccaggcugccaccucgcucugcacaccucaaggucucuccuggggcuaccccaggccaugcugggcuggcaccuuccucuaggcuucaggacaucuccagcucaguaucugccaggcauggccaacuuggcugguugaucaucccgcaccaccugccgcucccacacccucucuccugcccucggcgguugucuuccuuucaucacccugcaggucuuguggguuccagcuccgaugacaaccccagccgcggccuccuggccuccccaccucccgcccuagcucuaccaggucucucgcacucucugacccggagucuggauggacacccugaguguggcccaccugugcagcuccugcugggccucucggauggagaggauggccucgugcagggccugcagccgccgcgccuccuuccugcaccgagggcaugggcucucaccgccugggacggccccgagugagacaaaggaggggaggggaggagugaggaugagcuggagguccaguggggcuggcacgugggucacagggucauauccagcucgggccuccaccccaccucaugggaaaccugcagggccaagcugaagacacggagaugagggaggggugcugaggauguuucuggagggaacccccaggcuggaccagccacuaacaggccugggaggcagaaguggccaaggcaaggcccauccauuacagaggcagggacaaaguuggggagacacagcuccuggugacaggaaaggagcagagggcuggggcaggaugccacuggaccugccccucccaccgcuggggagccccuggccugggcccacucccuuucuuccccacccccaccauuccccccguuggcccuugggcugccucccagacucugagagggcagagccugcuggggggccccucagggcagcagaggagcuuuugcugggagguugcccuacaucugggcaggugcuucucuggccuccccuccagccaggucagcaucugaggcaccccaccagacagaggccuuggggcugggcccaagggggcucaccagggacaaagucaccauccugcuccucgucugagagcucugggcaggacucaggcguggauccgcugcucuccguggccuggcuguggccggagggcuggucgcuggccuugcgaagccgcuggucugggccagaccucugcagagaaauggagcugcugcagcugaaagccacccacgcccccugcccaggccccagggacaugguggcaugcuuaugccaggacagugcuagagguggcagccagcagggagggcagcugcugggcuguggagcuggcuggaggggucugucucagccccggcauggccuggaguagccauggucccuuugagccuguuuccucaugggugagacagagcuacugaccccucacagugagcaagggccugcaagguggugcagacacgccugcccugugcucaccauggcguugcauccaauaaaugcagagaugauggcauggggggccgagggugguucugaccccugagccaugaggacagaugaaagccgaggccacugugggagcugggagguucauaggaaccccagauggcuaggguuccccaugucaaggggcaucuccaggggggaacccccacacucagccggcugcucacaaccccaggagugcaggcagggcucauccauucagcccuuacuugagcucacaaggaacccaggacaggaacugaugcucagggguggggaaaaagcagaaccuggcugugggaccaccauguaacaacaggcguuuggggccagagaggugccagggacgcucugcauuggguguggucagcgacggggcagguggggucagagccaggacagguggggucagaggcggggcagguggguuuggccacaagguacuccaugggaugguuuuugaggcauggcagggcccaggcugacugaccucagcaggggcugcggggugggaggcugcagagggcauuggggguggacaucugcuggagauugguggggagaggcugaggagcgggacugcgagggucuggggccaagggaaggcaggagcuagcagucuggccugagcccggggggauggagacugugcugcagacauagggggugcaucugucuaccuuccugaggcuucuucccuagucccuuggcaggcagagcaugggacaugcagccaaggagauaccgcggcccccagcuugcuggagaaguuagggccaucaggcaagcaaggccucucaucugagucuggcccagacggcaucagcuggggaacacgcccccauccuguccgcugcgggugagcaccggccgcgcucugcacccucugcacgcaguaggugcacggcuggggcggugcagcucagcacaccuggaacgggggcguguggguuuggcgccaccugguggccgccuaaggcauggcaccaagacacacccaaggcagcuuccucagguuacucccuggagccuccugcugucccgcuuccccuuuccagacacaagaucugugcaagugcuggcuccuccuccuccuaccugggaagggcccugggcugcccugaccuucuguuuccugaucaguggaaugggauaauguggcugcuaacuuggcagagggagacuuugggggcaguggacagagacaguagacacagggucccacaagccaaggugccccuagaacugagcauccugcaaaucccgguuuccugagucccaugcucggcagagaaggaaaggggacgagggggcugggggaugagggcgugagggaaacggagcgaggggaagggaggagugaggugaggagcgagggguggugguggccacacgugcagcuaagaccagcccuggguggggccuguggggugcugaccucgugccugggcccugggcugcccaggaagguggucuggcgggccacggccuccugcugcaagguccgcaggaucccgucuugcucaaacugggcgauguccuucagggggucccaggggcuguggcuggaggguccagagggcguucaucagcacaggcaguggcccucaggugagggggcuguccuggcccagucuucagccccccaacaguggccagagaccuccaggagaaugaccacugcccacaccccaugggcagggccugcaguaaggacugaugauggggggugucacuaucugacccucccccaccgacuccuccaggggacaggcugaaggugagagggaagccaggagccccugggcccuucucagcccgucugcuaggcccagccccacccuguggcccccagggcuuugucggcacucacuccucguaucgguagugccacuccugggugaugggguccagguggaacagcugcggcuuccagggcaugaggcucuccugccgcucacgggcccgcugccgcugugccuccuccagugcaaacuucuccuguguggcccugugcuggucgcccuugcugauggcccuggugacgugcugccagagccugcgggccagugacccauccugagccaguggcccgggcagcccgaccccuaggcagcuaggaaucagggccccuuggcaccagaaggaaggcacagagcaaccucugcgugauugccuacagugacagggagcucacuacuuugaagagagcuuuucuuuuguccaugagauggguuuuuccaacacugagcucccaucucccgccugcagggaccucccugugcaccuguuggucacucgccggcagugaugcagugagaggucacggcagccggcuccucuccaggccacaccccuucccuccaucuguccuuuccaggacacgugaucugccaccaggggugcaccaggccugcccucccugccagggacauccuggggccaugcucacagcacuguagcccugcugaccugccugcuuggccaugucaggcuguggucagcagggucccugggcgcugacaggccucaccucucggacuccagcuccgucugcuccuccagcggcaccgugugcugccucagccucugucugcggaccuccccgcucgggguccagaaaagcgcacugcuuccgcucccuuccuccuugauaaacacgucccuguccugccccagauggccagcggggucagaggcuggccuggcguugaccgcccggccgugccugcccugagggacggccccuuacccaguggccacugaggcucgccaggacuuccucucccgacgugaucuuucccgagaucugguugaugcuggugcuacccccgaagaagggcugcggggccacacccagaacagagcccagugagcgggggcuggggccuccagaaucacauccucaugggggcacggaacaguuauucucuuggggugccugggagcccaggagggauggacccaacccucgccaacgaggccuucgggacccccacgccuccgcucaaggauguagugucccugccacagagacagggccuaggcuggcucugcuguguggcugcaggcagcagccucccuucucugggcccugucuguguuccgggaugucaacagcugcuccccuuaugugcacugccuuggggaaccuuccuuggggccuggggagagugugagggggauccccaaggcuucguuccuucccuggccucgucucccccaggcugcagccagcgcuaccuugaguuugaauuccagcugggccuggaaguuguucuucgcacacucgauggugaccuucccacccagcuccagggucaucgugccauacaggauuccugaaaugcagccagugucaggggccaggcggccccagcccugcugagccccaggcccugcugaguaccgacccagcagcaccgaucccugagucccgacccagcagcaccgaucccugggaggccugugucagucccugggagggugagaaggacaggaggcgcugggagcagaaccccacagggagaggcuggugggggugcggagccugggaggugcggagccugggaggcacggagccugggaggcacgccuggucccucaggggccgucucccccacuaagggggcucuguccucgccagggccuuugcucaugucaggugucgccuccuguuccagccuccugggaggccaccagcccugugagacaugcaucgugcuucacuugacucugcaguucccgcucuggcauugggcuccugagggcaggcaucuucucgcucacugcugcgucccaggauggcacccagaacacagagggcaccagcacccaugauggcaucccguauguuuaaaaaaauuaauacgucuuucuuuguuuuguuuuuuuucaauuaaugaaggaaagaacaacuuuuccaugucuggcauauggaggagguaaucuaauuaaagaagcaccaccaccuccaccaucaaaacccaaacauuugcacucuaaaaaccacuuagaaauguguggcagaauaugucucuuaaaaaugaagaaaagaaacaacaagcuacuuguugcaacaaaggcuugaaacacccccaaaucccuccagagggggcugugugagugcacccuggcccaugagcacgauggaaagcuaugcagccuagaaagacaaagcggcaucucugugcagcucugauggggggaggucuccaggcuccacggagaggaagaaggcccaggaggcggagguuguagugagccaagaucacaccacugcacucuagccugggcaacagagugagacucugucucaaaaaaaaaaaaaaaaaagaaaagaaaagaaagaaaagcaaagcaggucugaccuccagauugugaucacuaaauauuauuuccuagugaagggaaccuggagcucccgggagaaauggucgauuugaggucuaguguaggaaauguccuaggugcacacauggucagggcagaaggaagaauaccagcagagguacuggggugugcagggggccccugagccaacuauggcccccauuggccaaagauggggcaauuucaauaucaauaaaguuaauaacugaaagguucugaaaucaccaaauacguuccuaucaaauaauacguggcaauaaugaccuucgccagucaccuuuggaagacagcaggggaaaaaaaucauuauuuugaaaauauaaaaaaccugggauuuauccuaaaacaaaccaauccuguuggguaaccacauaguagacaaggggaaguuucucuuuugagaagccuuccggugauuaagugaaagaggauggaacgucaccaucuagcaaugccuuuuacaugaauggauccaggcauugagaaucaauguccacuaaugucacaaggaacaacaggcccugugcacccugcuguggaaagacacaaaacccccauuaagcgucguguugaaaaaaacugugcugaacgugaucaggcaucucgagaucaaaucaauucgugguuuauaggaaauccccagggcagaggaaugcagccaggaaaauccaugcuagaggggacuaggaggaaaugaguaauacucugcaagggaaaaacaggagggagggacaucaaggagauguaaacauaggacauccaugcacggagcauggccugaugcagagacccagccaaacggccaacugucacgugugugggggaucaagacacaggcacguggcagcuggggauaugaaccagauuguagacucgaugacaacuaagaguuuguuuguuuguuuuucaucugaugauaguauuguggcuaugguuaagaagggaaaucccggccuggcgugggggcucacgccuguaaucccagcacuuugggaggccgagguaggcugaucaccugagggcaggaguuugugaccagccuggccaacauggugaaacccuaucucuacuaaaaauacaaaaauuagcuaggugugguggcgcacgcauguaaugcuagcuacucgggaggcugaggcaggagaaucguuugaacucaggaggcggagguugcagugagcugagauugcaccauugcacucuagccugggcaacacagcaagacucugucaaaaaaaaaaaaagacagaaagaaagaaagaaagaagggaaauccuuaacuuuagugauauaaaauaaaauaaaauacacaaaugacaugacaugauauuugggauuuacuuccaauuaauucaggggagagcaugaaggugggugcauugcugugcuguggguauaugggguguacuguacuuugauauauguuugaacuuugccauaauaaaaaguugaaaaaauauaugaagcauggaugagucaaugagcaugcaagaaaagaugggaauucucccacaagaaaaaauaaaggggagaagacgggaggaggagaggaaagagggaggagaugggaggaggagaagaggaaagagggggaaggugggaggaggagaagaggaaagagggggaagacgggagggggaggagaggaaagagggaagacaggagaaggagaggaaagggggaagauggaaggaggagaagaggaaagagggggaagaugggaggaggaggagaggaaagaaggggaagaugggaggaggaggagaggaaaaggggggaagagaaagaggggcauuugucgaucugagaucuugguuucugagguugccguggaaagugguagacagguccuugggucagaguaaccaggagagauuuuuuccgagacauuuccacuaagcaggcacucucacauggcuacacccucaacagaaggaacagucgcagaaaggccguucauuccagagggagagucaaggaaacauuuguauugggccugcgcuccgggguuaaaaagaaaccccagaacucuccaugaauguguaggguaaguuugggauucaaaucuauacuuccucugugucccagaaacaaccuacuaagaaaaugugagagccaacaaaacaauuucagccaacaaaacgaaaacaaacaaacacaaaacuagcaaauuagaaucccaagguuuuacuaaauacagccauucuuugaauaauuaucgagcaccuucaagggcaacacuauggucagugaggacacagcagcaaacaaaacagaauaugagagugaccagcuagagaugauaaaacaacugugcuuauuacaaugcucaaagauuuaugagaaaggauuggaaacaugaccaaggaacaaugcacgaguauaaaaagaacaggcaaggccgagcgcacuggcucacaccuguaaucccagcacuuugggaggccgaggcaggcggaucacccgaggucaggaguuugagaccagccuggccaacacggugaaaccccaucucuacuaaaaauacaaaaaauuugcugggcgugguggcgggcgccuguagucccagcuacucaggaggcugaggcaggagaauugcuugaacccaggugguggagguugcagugagcugagaucaugccauugcacuccagcccgggcaacaagagugaaaccccaacuucgucucaaaacaaaaauaaaaacaaacaaacaaaaaaaccaggcagguuugaaaugaaaccaaguagaacuucuugggaaacaauauaucaaaauggaaaacucaguggaugaguuacacgucaaguuaauuagaguuaaagauacaucuacauaaguuaucuagaaugcaaagagauaagagauacgauggaaacauuaagagagacaaagcaaaggaggagaugguucaaauucugucucauuggaguucuaggaaaaauggagaaaucaggagugaggcacuuaaaaaaaauggcuaaaauuuucuggacuucaucaaagccacgaaaccucagguucaaauaauucaaacaaacaaaaaccuucaaucagcaaaaauuaaaaagaaauccagagcuaucaagccauaaaaagacaugaaggaauuuuuuuuuuuuuuuuuuuuuuuuuuggagauggaguuucgcucuuguugcccaggcuggagugcaaugacaugaucucagcucacugcauccuucaacucccggguucaagugauucuccugccucagccuccugaguagcugggauuacaggcaugcaucaccaugucuggcuaauuuuguauauuuauuagagacggagauucuccauguucgucaggcuggucuuaaacuccugaccucaggugauccauuugccucaaccucccaaagugcugggauuacaguugugagccacugagcccagcaaagauuuuuuuuuuuuuuuugagaugggaucucacgccagcccaggcuggcaugcacuggugccacgauggcuccucaaagccucugcccccugggcucaaguuauucucccacuucaaccucccaaggcugggaccacaggugcaccaccaugccuggcuaguuuuuugguacuuuuuguagagacaggguuuugccauguugcccaggcuggucuugaacucuugggcucaagugauucccccaacucuaccucccaaagugcagggauuuauaggcaugagccaucaugccuaguggaggaaucuuuaagugcauauugccaagugaaagacgccaaucugaaaacgcuccacaccguaugauuccaacuacaugacauuccggaaaaagccagggccuggagggacugaggaauauguggcuccaucuagucacgucuaaucauaagggauuuuuaggguagugcaacuauucugugagaugugguaauggcagauacauguccuucuguauuuagcaaaacccacagaaugagcaacacaaggagugaaaaggaaggugaacuguguacucaguuaguaacaauguaugaguauuggcucaucgaugauaccaaauguagcaccucagugugagauguuaauaacaggggaaacuguguaggggacacacaggaacucucuguacuuccugcucaauuuuucuguaaacacaacacuacuguaaaaaagaaagucuguuaaugaaaaaauaaaaaagaaauccaaacuuugaaacacuguagcaagacuacagggcaccaaggcaaggaaaauaucuucaaagcagcuacagggaaaagcagauuagguaacaaauaggcugacagcugaucauccccaacagcaauggaagccacaaggcaagcaaaacgcacauauucaaagggcaguaaaauagcaucuacauggaauuacccaccuucaaaagucaugggcgaggcugggcgcgguggcucaugccuguaaucccagcacuuugggaggccgaggcgggcggaucaccugaggucgggaguucgagaucagccugaccaacauggugaaacccugucucuacuaaaaauacaaaauuagccaggcgugguggcgcaugccuguaaucccagcuacuuggagccaagaucacgccauugcacuccagccugggcaacaagagcgaaacuccaucucaaaaaaaaaaaaaaaaaaagucaugggcagaugaaggcgaaguaaagauaccuucaagcaaauaaccaaaggguuuuagcaucuagcugcucucacagagccuggcucugcccucggaguguguggcugagccucucaccuuugcagugggcguagggcaugguaaggguguaauccucggcucgguucaggaaggugagcguggcuuugccguccagcagcgccgacagcgaguucccugcagagacaagagacagcaggaccagugagugcggacagcccuuucacaucugaggccaccccuaagucacagggucugagcuccuuccaacagcugaacacgcuccuggcacuuccaguggugugucugugcgugagucacuuaaccucucugggccucagauucuguaaaauccuuguccagugugcacaggacaucugugcugagaaguuauuucaccuuugacuuguuagugguuuauugcagucgcaaaacugcagauucgcaggguggaggcugcaaacuuuuucaaacucgacugagcccugcucagauuuuaaacaucccuguggagggaguacgccucgcuuggggccacgagucgcagguacugcuggugaggagaggacagaguugggaaaggugggcugaaccugagggucgcaccugggacccccucccagaguuccacacacccagcagagagccgagcacacagaggcaacaggcgcacaccugcccauggaugaaacugaugaaaaagguacaacggaugggacgaaauguaaacggacacuuuucugagcacccaagucugccaggccccagagcagugcaguccaauggggcugucucugaagaccagagcuucccuccugccugucccacuccggggccaacacugagccugugugauuuggcaauagagggacugcaguuucaguuucauuucuuuuuuuuuuuuuuuuuuuuugagacagagucucacccugucguccaggcuggaguacaguggcaccaucuuggcucacugcaaccuccaccucccggguucaagcgauucuccugccucagccuucccaguagcugggaugacaggcacgugccaccaugcccggcuaacuuuuguauuuuuaguagagacaggguuucaccauguuggacagucuggucucaaacuccugaucucaagugauccacccaccucggccucccaaagugcugggauuacaggcgugagccaccaugcuuugacuaaguuucauuucauuuuagccaauucaaauagucaugcagugcucuggggcugcucagccccaguccgcaccuuuccauguaggugcccucucucaguccccacagcgucccuacaaaaggugcccacucucagcucggggagcugcgggcagcucugccucauggccgggucucagcaccugaccaccacauggucucugacuaggagggguugggagggacaggcacauggcccccauccagaucuugguccacuggcucccggaguccucccgaccaucgcauuucccugaggccccagggagcgcccagggugacccccucaccauaaaaccuggacuuggcugugaugcugccacugaugcagaagccguccuuccgguugcugacguggaaggcagacacgggcggguggugggacaccugcgugcagggaggcggcucuguaaacagccccggaaacagguaaucccaggaagcgagagcccagcuucccccaaaaaaccugucccugucccugacgccacaucuucucccccgaucccaggauucggguaggggccuuccuggcucucgcuuacgacgcccagggcagguaggccucagcuguggggcuugcgggcccugaguugccccagaaguccccaucgggagaugggacacacuguccucucccuagggagacacugucugcugucacagucaugguggugucugcaccuucugcaagaaucccuguuggcagcggcuggguccacagcccuuccggugugcaggaugugggguccccuggaagccggcccucggggucacgcuugccccugccugcugccagggccccgcccccacagagccccgccccauagagcccagcacccaggccgguugcagcagaggugcucuugccugcucugcuauguagaaugugcggcugucagucugcggguggaaccagcagcagcggaaggucucccccaggaugggguuguacggcuucuugauucccugcagacaacagagacuugugugaggagccagguggguaagagguccgcugugcagagcaggugagggauguggacggaggggcagcgugggugggcuacccgcugccugcuggccugguuugcugcuagcaucugggaacaacaccucacuucugcuuugcggggacuaugcuuugccugugguuuacauucuugggggacagccucaggggaauccuguccacuucuuagcucggagaagggacacgagacccugaccuugucacacucuccuuggaccuuggguguaaccugcacacagccugcugaaagccauggaaggcaccaggcagucagaaguccugccucuaccccaaaccugcuguacgacucaggccauccuuucaccugagccucaguuuccccaucugcacaauaaagaaguggaaccacggucgugguuuucaaacuugcuucccauggaaccccagggcucugugguggggucaggggagcugcgggcccucuugcucacuacaacgagagcagcccugcugucacuggaguccuggguuugggguucuaaaagggguuuccauggcuaaaaauuuaugaaaaccacagaucccaaagguaccuugagguuuaagguuuaaagcuccuuucuuuuggcaccaucuguaauacggccugaggcuguuuucuugggggguggggaagggguccagcuuggggccuugagggaugagaccacccuuggggacccggccugagccauccagggccccaacugugggaaguggggcccugucccccaucaccaaggaccugggcccucugugggggugaccaggauccuucuaagccaugugggguaggggguggcccggggacucagggaagugccaagggacgagggcugagcagacagacuccugggccggagccccacccucccuggcuggcaggggcucaccuugggcuucuuguagaagccagacagguaccaccgcagcaccagcuucaugcggcuguaggcauccuccuccaccgcagcccugccauggggcaggagaacgcugaccccagcuccgggggccgugggccacccucccuuucccugacccuucccuccuaccaucccgaccuccaaccacucagcuggaaacaggccacuuggcccaggcgcucuggucacccccaagcaggauaauuuucucuggggaaguggguucuucuaaucagaaagugccagggcugcucccacgcuggggcagagaggacacugcugaccugggcugccagggugccccugucuccaggaagccucccugcccaugcucuuguucccaccugcucccucugccuggcuccugagccugcagcccccuuccugccucuguugcccccuuccagucucugcagcccccuuccagccugcguacccccuuccaggcucugcugccccuuccugccucugcaacccucuuccagcucugcagcccccuuccagccucugcagucccuuccugccucugcagcccucuuccugccugcgcagcccccuuccagccucugcagccccuuuccagucugcgcagcccccuuccugccucuguagccccauuccugccucugcagcccccuuccugccucugcagcccaucccauccagcucgagggugcagggcucagggugcauggcaagugcuugggacugaccccccucucaccacggauggcuggcuccucccaggcccaucuuggagacagggcccccugggaggcuacagcugcagaaacagugggcugagaucagccaugggauucucuggaagcccccacagggcagguaggggcugggggugcugcagggucucaugcagaugcaggacgagguguggggugccccucccggcauggcgcgcaccuggagagcaggucugcgugguaguaguagucggagagcuuguucaggaaggagcgcggcuccaguacgaacguggguagcaccacgcgggacagguccaugccuggccguagcugcuucagcaggguccacaucagacucuuguucuccucugacacugucuccaccugggacgccucgcccagcugcagcagacaggcugcagucaggcccugcccggaagagccgggaggaagggguggcgggacaguggcagcucuggcuggaggaggcuguaccugccaccccuuaggguguaaaccccugaccuggccuccauggccucaugaggcugacucagccccaucagaugugaacucuucccaaugcgucuccaccccaccccuggagcacccgcagcccagguccaggcccgcuccugucucugcuccuugcccagggaccccaugcccugcccuccucaaaguccagggugcagccucccaacaccugcuguugaaaccugucugugcaucgugggacccugggcccagggaacagagagacugcagcccacccugucuucacagcugccaggggaggcagggauuuggccugcucuuccauuuuuuaaaaaagguuauuguaacauuucuuuuucuguuuuugaaccacuuuauugaggucugauugauauacagaagccuucagauauugaauguggacaacugggugaguuuggaggugagccugcuccugcaaaaccgacacgggcaugugaacucaccccucacuuccgaagccugugugccccucacgaaggcccccucaucucuuccuuuucugagacaucuaacccucaccacagcuccagaauacaugacuugggguggcggggcuccccuuacucacuccagacuugcaccucaccgcagccccagggaacggggacccugguccucccccuccacagaggggacaagugacuuguccaaggucacacggcugcuaugcggcagaggucagaucugaacucagggcucucugcauuuuuagcccaacggcagcugccccagggagcgggcaagauggaguguggccugugaguccugcaucaggaucucauccccgcugcugggacuccucaggcaaauggcuucgccucucugugcacgcauggccacggacagauccugguggcacuggcccaguggacaguguguguggacacccaggagccaugucugaccccaugaggggucauggggagcccagugcuguagcuuuggggcuuggaaaucauggguagcuucggcugucaggaauccugcucuguccaugugcucccgucccguccuccuuaacccucuccaccaggcuucugccgucuucucuacugagacugucuugccguagguccccaccacuccucacugguccagcagccaucccugcuucucauccugccccaccucucggaccagcuggcucugagacaccugggcuccuggauccucccaccucccugccccaccucugugaagccuuaucugugcucggccucugaagguugggugcccgggccccuuggcugcccgcuccaugcccucugcccggagccccaggcucgcaccugcagcagcccgcucugccuggcucacagcagcgucgcucaucaccaucuggcugagaucuacccaauccaacuuccgaaauacccugagucugcccacuucucccuucuccaucacagcuggguccaggguguccucagcuuucuccuaacaaugggucuucccuacggguggcccaguguccacccccgccccucggcugucccgaggcccuugccuaacccgccgguggcuuccccaauacucucagccugaggcccccagggcccucgguccacuccccauaggcccauccuaaccuucccauccccgcacaggagccugagcucugugggaacagcagcccgcagggaggccaugguguuccacugaacacaaggauuucacggaccacggaggagcccccucugucccugugcagagcaagaugcgaacacgacgcuguccaaacaacagcaaggaacgaauuccccuuuccugcugaaaccgggacugccccuugcccucagugacagccacggccuugcucuugucucgccucccgggugagaaugacaagaucccagaucacagagccccccguuccugacagcccccaccccagagcgcagcccccaccccagagcccggcuuccucagccugcacccgucacccagcggaagcuuagauccugugauuccuuccggacuccccuuccugaggcgccccacggugcccagggccacgugaguucucuccagcugcggggagucagcugcccuggcuguucaucugcaggcaugcucuggggacacugcugcccaccgccugcugccucccuugagcucgugcgcuggugguccuucuucuuggaacgccauccucccucccgucacucacgucuucagaaagagcccauggcccgguuugccucccucaccugcuccccagccuccucuuguguuuguggguuuaucaucuauguuuccugcugcccauacacugggggcccagagcccaggucugucucauucauggcucucccagggccccaggagagcaccaggugugcaggugccugugagcaugggacucagguccacacgcccuccucugcgcuccuccaggaaguggggccgcccagcagauggggucaagggccccucuugagccuccuguucucccaucagcgcauuccagcccaaggagggaguugccugucugcagcaaaccccugcccgauccccgcaucugcaugccagccagccagccagccagcggggcagccucuuuggaagacgggaggagccuguuuaccuaaaagacagcuccuggacucacugccaagugauggggacaaaagcuacccccugggcccugcgugcucccccuaggaugaggcauggcuaccucugcuuccggaacaaggggccgaggcaggggagacgcuuggggcuccuggcuggggggcucucaccucccccagcuccuccuggaccugcuccacauagguggucccucuccgcaccggggccccaggggucucugacuggucgcugccacucuccgucuuccggcuaugguccugggucucgguaucugacuccucaggguucucucucuccgacuugucugagaaugcaucguucuccagggaagacccguucagucuggaagguggauggugccagugggucccugucacaggugagagcccagcacagcccucugggcugcccaccccucgcugcuccgcacuucacauacguuccugccugucgucaccuccacaacccacauuugacacgaucagccccguuuuagaggaaggaaccgaggcucccagggcacacugcagcgaacaagucccugcgugcagccugcagcccaccagagcaguggcuggggcuguccucuccccucuuccucgccuacaaggagaccccgugaaucaccaccagccccugugcccucgccccacucacgggaacaggucuuggucuggguggacgguggcugaggcuggcagcccacagagcgaugagggugaugcgucuggcgaggucccuggcuccccgucucggcccggcuugcaggugcccagucucaguaggcuagagcagcgcagggccagcuccagggcguccagccagcagcgaccugcggggcacacgggaugagcaugccccacccccaccucuguauaucccgcaucccccaaggggccaccaggaggcucccccucacucugacucuucagggacccacccccuccaucccagacccaccccuggcccugccccagcagggacaugcccucccuuccugcccccacauccagcugcagauugugugggggcagacaucgggaaccccugaggauugaggacuucccaaggaggcagacccggccuggggacaggugugccaggggaggcagcccugcagaggcaccuggggaugcucacagcacauccccacgcaccuccaccacccacauugcugacgaggggcuggcauaagugaccccuccaggucacaaacccagaacacucggaaccagccucccacccugauggccacccacagguuucugcagguggaguuagggaggaggguccucccucacugggaagcacuggucagggugccaggggcuccugccagccuggaguccagggaggaggguggggaaggcugaggaggggcuugcacaccagggaggagaccugccugaggccgcccagaggcucugugggcagcgguggagcaggggcuggucgacagcuaggcgccuccaagccccacucugggcccugugcccugcugccuuccuaagcagggugacagcaccacccaaggguccuccuguggggcacguguccaccugggugacacugauguccuggugugauaacagcggcccccgcacucagaggagcaucucgugguggccugugacaggucacacuauuaauaagguuuuuguuuguuuguuuugagaugggguuuugcucuuguugcccaggugggagcacaauggcacgaucucagcucaccgcaaccucugccucccggguucaagcgauucuccugccucacccuccugaguagcugggauuacaggcaugcaccaccacacccggcuaauuuuguauuuuuaguagagacaggguuuccucauguuggucaggcuggucucgaacucccgaccucaggugaucugccugccuuggccucccaaagugcugggauuacaggugugagccaccacaccgggucaauaaguguguuuuuuguuuuuguuuuuuuguuguuuugagauggagucucgcucugucacccaggcuggagugcaguagggugaucucagcucgcugcaaccucugacuccaggguucaagugauucuccugccucaaccucccaaguagcugggauuacaggugccugccuguaauuuuuuuguauuuuuaguagagaugggguuucaccauguuggccaggcuggucucaaccucugggccucaagugaucugcgucggccucccaaagugcugggauuacaggugugagccacugugccugggcuguuaguaaguguuauucaaagaaagccuccuggggucacgucaggugggaggauggggcugaagagcauugaaggcgguucugugccucucugagccucugccuuuucgagcuccuggagacagugaguuuuucucccucacuuugagauccauuaaauccugcucuucguggggcaucucaggguccaguguagggaggggccugccuagacaguggcuccugggucucuagagcugcccuucucauuggguuggggggauaucugggauccugcugguuccacugcaggcuugguuggugccagagcggccaagccugggcggaacaccaggguugggggagggauggcaguggauggugguggggagcuggaggggucacaacugccgaguuggccccagggccugaacacgugugcuuuguagcugccacaaaggacuagacauccugaauauuaugcauccuuugaagcucauuccgagaccucuuccuccucuuccuggaagcccacccugauacccacaggggcugcagacaccucuccucccgaaugguggcccacacccuaucaggggcucagcucacaccucagcccaaccugccuuaucugaugguugguuauccaccucacccaggagcacagaggcugugggcugcccuggccauccccgggccugcaugggaccuggcacauaguggggcacucaggauggcccaggaaggagcauggauguggcaucugaccaccaggggugauguggcaccgagacuccaaccugagaggcaccggagccccguggucaaggccagacugcuuuaggucugcaccaccggcgggaugggagcccuucaccccacugcucugggaggcaucacccugggguuagaggagguggagcaaccgcauuuacccagagcagccacuggagggcgaggugggguagggccccaaccucagguuagagggaggaacggccaagagggaaucccuccagguggaggaucaucgcagucacagcugccugagcggccacucagggaacagcaacagcgugcaaugcauuugggagucagggaaauucucguucuagcacuuucuugcuggcaguuugccugugccucaguuuccugaccugucuaauguggaugauaacaguagaaccuguuguuucaauggugccuggugugaaaggaaaaucuugggccccucaaaucacuaagcuaaagggaaaaacccaagcugggaacugcuuagggccaaccugccucccauucuauuccaagucaccccucugcucacugagauaaaugcauaucucauugucuccuuuggagaagcucaucagaaacucaaaaaaaugcaaccaucuuucucuuaucuaccuaugaccuggaagccccuccccgcuugaaguugucccgccuuuccagaccaaaccaauguucaucuuacauauguugguuaaugucucaugucucccuaaaaccaaacugugcucugaccacccugggcacaucgucaggaccuccugaggcugugucacagguaggcgucuucaaccuuggcaaaauaaacuuucuaaauuaacugagaccugucucagauuuucaggguucaaacauuuugguaaccacugaaggauucugaguggagaugccccugacuuuucacaagucuccuauuggugcuugguaccagcuugagcuaacuuuauggcucaaaccaauaagacaauuugcugaggccuggaagcaccuccccccgugccccacccccacccccugccacagagaaucccugaucucucaaaauuuggucgagaucuaaaguuuauuuuguuuuacaacuucucuuuuuggaguuuuacuugcuuccgauacaaggaaggcaaguuuucccugcuuccaugacgauggaaggcagguaacuccuuuauggaguucgagcuugcuuccaacagggaagaugaauuuuuuuuuuuuccugcucccaggaugguggagaucugaguuuucagccugagacccaucccuagggaaguaacugaauugugguuugucuuagcuaaaguuaagauuaacaaccagcuggucuuaauuucuccuuaccauuagagcacucagugaucacguaaguugugcgauuguuuguuucgcuuaacuguuuuuuuguuguugauuguuucuguuuuuguuguuuuggucuuuuucccauugaccucuaucuggcuugaucaaaucugaaggaaguuccaaauuauggggaacaaggccucugaaguggcugaauuccccuccccacccccacacacaaugguggcgugauggggggagaaaaacggccagcaaaaggaaaaaaaaaagaggaaagauuuugauuuugacuacuaaggggcuuuauucauauaacaaggccacauuuucacuagcuaggccaaacugaaagaguaaugacuguacuucuguguccucguugaaauuuguccuaguugaaauauggaaugagauuuaaaaagauuuuuucaaagaagcucaaugguuaaaagucaguuuaaugaaaagcuaacauccaagcugugugugugugugugcauaugugugcgcgcaugugugugcaugugugugugugugcgcgcaugugugugcauguguguguaugugugcgcgcaugugugugcauguguaugugugugugcaugugugugugcaugugugugugcauaugugugugugcaugugugugugugcgcauauguguguguuuguauuuaagagaccuucauguuucuguuuuuguuuuucuccuaggaccuugucuuuuuuugagcaaaaggguuuuuucuucucaguugacugaauucuguuucuugauuuacuucugcugucucuccuuucucuugcaccuucugccgcaugggggaccuaaaauaguuuauaguagccugggguuccuuaaagaaaauggagagggugccagacuccccuugggggagaaacuuguuuuuucuuaugaaaccccaagaauguaaacagacaaguuugucucagcucuuaaacugcuuacuuuuguauuguguaaccuguuuuguguuuucuuuucuuuuuuuuuuuuuuuuugacuaaaguaguuauugcaacagugguuacucuugggcuuuuaaggaagagugugguuuagacacuuagaaaugucuuuguuuaaaaaaaauuuguaagugcacuauaaaagcaucacguggucuaaccucaugauaauucucccuuucuggagaccuaggauucagugugggcucuucccagagcucagagauccaguuaaaugauagguagucccuacuacauaaaauuggucuccuuaugcaauccuaugauagauuucuauaauuuuguuugauuuggcauccaucuuuagucucccucuagcaccaccagacuuuuucucucuguaccuuaugcaaauuuugcuauuugauuuucaccugaguuguuucccuuaauaugcaaauuuaaggcuauuuagcugacaauugccuaggguugugaaacagguuaucaagaaucugaaagucuaagacaggaaaaaaaaauuuuuauaaaccuaugagauguacuucuauugccaugccuaauaugucuauguauuuaugugucguguacacaauguuucacuacugaaaauauauaaaagggcucuaauugauuggcuuaagaaaguaaaugcacuugaaucaaauacuugaucaggaaaaaagaaaagacaagucaaaugcuuuuucaaguuuauguaacuuaaauaaaaucuuuaauaaauaagcuagcuuuaaaauuauugguaaaguaauauuagaaaugucuuaagaauugccagcauauauuuuuguuugcauuuauuaaucaagcaauuucauacuuaucccugccaaauaccaugaggugucaaaauuuggcauaggaguuacgaaacuauaaacccagcccaagacagaaugaucuuugcuuguguaaucuuuaauaaugccuguaaucucagcacuuugggaggcugagguggguggaucacaaagucaggaguucaagaccagucuggccaacauagugaaaccccaucucuacuaaaaauacaaaaauuagccagguguguuggcaggcaccuguaaucccagcuacucgugaggcugaggcaggagaauugcuugaccugggaggcagagguaacagugagccaagaucgcaccacugcacuccagccugggagacuagagcaagacuccgucucaaaaaaaaaaaaauuuauauugguuuaauaaaaauagcuacaucuuaaauuuaguaagauuaccauaacuucuaaucugguggcuuuagguagucuaguccacaggcaguaagguucauuuugagaaagacuguuauagucuuuguuucagguaaacuauaaacuaaguuccucccaaaguuaguuugaccuaugcccaggaaugaacaaggauagcuugaagguuagaaacaagauggagucaguuaggucaaaucucuuucacugucucaguuauaauuuugcaaugguguuuccauaauuuaaauaaugacaauugcaguuuuuauaaauaaucuagguaaaugauuaaaauaauuagguaaauguaauaggacaaauacuuguagacaaauucaucauaauuuagaauuuaaaguuagauuaaauaagauauuucacuauuuggauauuuuccaauaaaaauauauuuguaggaaaauaugcuuucuaaaagaaagcauguccuuuugaaaaaggugaacaauuuuugccuaauucaaagcuuauuuaaagaucauguauaaaacaagguaaaaggaaccaggaaauaaaagaguaaaagagauguaaagaaaguuauaaaaaaguguuuuuugguggagaguaagaaagcuuaaagagaaauaauuucauaugagaaagaaucuuguaugguaaauuuaguccuagaguaaaaugacugguuguuuaagaaagagggauguucaggacaaaccagaaaguccaagcguggcaugaauggucuauggaagucacaauaagaggaucuauuaaaaaaaaacccuuuuauaugaucaaguugucuaugacuaaagggaaauuauaauggucuuucuagagauuggguuugauguaaaaaaacaguuauagacuaaagaauugguuagaacaaugauuuuuuuuuuuuuuuuuuuuuuuuuuagacagagucucgcucuguugcccaggcuggagugcaguggcgugaucuuggcucacugcaagcuccaccuccuggguucacgccauucuccugccccagccuccugaguagcugggacuacaggcgcccgccaccacgccuggcuaauuuuuuuuuguauuuuuaguagagaugggguuucaccauguuagccaggauggucuugaucuccugacuucgugauccuccugccucggccucccaaaagugcugggauuacaggcaugagccaccgcaccuggccgacauuuucuuaagagguugauuuacucuuaaucaauuauaagauauuuuaauuuuuuaauuuuaacccaaaguucaacuuucauugcaucuugccaguuucaguuuucucuucccucuuaaaaggaacaaaauaguaacacuucccuucaacucauuuucagcucauauaaguuuuguuuuccuccucagguucuguuuuuuuguguguguguggccugaugcuaacaauguuuucuuaaagaaaauguuuucuucuaacauaauauucuauacacugcagaagguauuugcuuuugccuuuugguaaguggccuaacagauuuuauguuuuaucaaaauaauuccuaugccauuauuauuaaguuugguuugcuuaggaaaaacagauauuaaaauuuuuuuuaaaucaagguuauuccguccuuauaucuucuuguaugugcuuuuaaaguccuugcgacauugaguuacagggauuugacucaugggucuaaaaagaacaccaaguccugcuaaauuuuaaacacugacagcaauuaaagcuucaucuucaggcccgguagaagaugccaaucaaaauaaaccacauuccugagacacagaaauuaaagcuguucaacuccucaaggcccagagacuaucccagaagagauagacaugugagauuguaagggcugacuuugagagauaaaguaaguucaguuccucuauaaauuaaucauuaaugucaaaggcacacugaugcaagacuagcauaugggccccugugucagauuaacaagguuuucuugaaacaauaacugacuccuuaauaaagguuauaaaggcuuauggaaguuauaucuuaugaucaagaugaaaauuuuauagauuggaauuuuggaaaacaauuuaauuggcuucaugauguuauuagggcuuauuguuuggaaaacuaagucuccugucucaaagaaugaaggcuuuugccuuuuuuuuuuuuuuaaauccuugagguaucacuuuguucaaaugagugaauuauuuuacaaugacuuguaauccuacuuuguaauaucaaguguuuuaaaccuuuaaaauuugacaaacuuuccaaaaucaaauuauaaauuaugucuuuuucuaaccuaauccuugaagauauuauuaauagguucccuaaaguccaaaaaugacauauuuggcuuauuugguauaaaaaauuauacaggaagcagugucaaauauaaaaugguauuuggucuucuuugggcuauauuuguacaaauauguuacugguauguguuccaaaauuauaggaaacuccuauaauucugauaugaccuaauauacauuaucaguaaugauuauaauuguuauguuaaauuauuuugugccacagagguaacaauuuccuugucaauugugucuuugaguauggcugcccuaaaacuuuuuaucauccacaagcaaucauugucuuguuuugguccucuuuagaaggugguuuuauaaucagcuguaaaacucuaacaggugcucuugaaugcugguuucugauaacuuuagagacugugacaucagaauagaggaaaaacuuucaggguucauggagagcugaaauguucauaaauuugaagcagaacaggaauuaacugcauggacuaaacuaauagaagugugaaguaauugccaggugugguggcucacgccuguaaucccagcacuuugggaggccauggugggcggaucacuugaggucaggaguucgagaccagccuggccaacauggugaaaccccaucucuacuaaaaguacaaaaauuagcugggugugguggcggaugccuauaaucccagcuacuugggaggcugaggcaggagaauugcuugaacccaggagguggagguugcagugagccgagauggcgccacugcacuccagucugggcaacagagugagacuccaucacaaaaaaaaaaaaaaaaaagaagugugaaguaaucuuuuugacuuuuugcuuaaaacauuguggauccuuucuuuuguuuuucagagucaagaaaacuuuaagcuauuuacagcuuuuaacaauugaguauacuccugugaacaaaauuuggagcauauuuguuucucucuaccuaauuuuuacagaauuugaaaacuaucugugaguauucguaacuuaugacaauacaguuauuugcauaagugcaguaagaaucuguuuucauuuguaacaggacacaaucggagaaauugguuauuuuaccaaggcuuugccuggaaugaugugcuuuccuuuaaggacucaaacuugacuuauggaaccaaugaaagccccuuggaaaaacuggccucauaccucaucuacacagucccuguacaggguuccugaccugugguaaguaaagaaugucacuuucugacaggcccaggagcuccaaauuuaucuuggaaccucaagaagauaauaauucgcccaacuuauagguguuuaaugguacaaguccaugacugggcucagcuuuaaaaaagucuuaucugagauucuuucuauggaacaaaguuccaucaaagacaauuuaaaagccuauguaaaaacuaauuacucuugcugcacuguauauaaauaauuaguccaaguauaauaaagcaaaccaguccuaccauaauuuguccuuaguuaaaaugggaaacuggagagaaaaaauuauguuucaaaaacuauaguacagcuguuguuagauucuacucuucccuaauguuuuucaauuuuuguuauuuucugcacuuuggaugaaauccuaauuuuuguuggcuauaggucuucaaaauaauguuuucaauuuuuuuccuucauuuuuuucccauuuuuccuaauuuggagucgcugaagacuaagcugugcuuucuuaaagcccugcaaacugaaacuagacaacuuaaacuucagaagaaaauaacagcaaccuacuuacauacauaagccacuuucuugccugccuacugauguauggacuucagaguaauguggccuauaccaauuucccaggauuguucuuuuguuuguuguuguuuuucugccuuccuccuacuauuuucucuucauaggacaugagacuucacagccuucugaaaaugagcuuuccuaauaacuugggaccuaccuguguaggaauaaaccauccuagccaugagagaucagguggaaccugagaccagagacucguuuucuucuaaaaugcuuucuccaaaagauuuuuaaaaaggggggaaaugugaaaggaaaauaucuugggcucccaaaaucacgaagcuaaagggaaaagucaagcugggcacugcuaggggccaaccugcccccccauucuauuccaagucaccccucugcucacugagauaaaugcagaucugauugucuccuuuggagaggcucaucagaaacucaaaggaaugcaaccauuugucucuaaucuaccuaugaccuggaagcccccucccggcuuugauugucccgccuuuccagaccgaaccaauguucaucuugcauguguugacugaugucucauaucucccuaaaauguauaaaaccaaacugugcucggaccaccuugggcacaagucaucagaaccuccugaggcugugucacaggcacggccucaaccuuggcaaaauaaacuauuuuuuuuuuuuuuuuuuugagauggagucucccucugucacccaggcuggagugcaguggugugaucuuggcucacugcaaacucugccuccuggguucaagggauucucuugccucagccuccugaguaguugggaucacgggcacccaccaccaugcccagcuaauuuuguauuuuuaguagagacaggguuucgccauguugaucaggcuggucaaacuccugaccucaggugauccaccugccucagccucccaaagugcugggauuacaggugugagccacugcacccggccuggcaaaauaaacuuucuaaauuaacugagaccugucucagauguuugggguucacacuggcaugugguuggagcucaguaauuguuauaugggugcuuuuauaaggucacuggguucucauaacauuggggugacaggugguuuuuuuuuuuucuuuaagacggacuuuugcucuugucacccaggcuggagugcaauggcaccaucuuggauugcugcaacuuccaucucccggguucaagcaauccuccugucucagucucccgaguagcugggauuacaggcgccugccaccacgccuggcuaauuuuuguauuuuuuaguagagucgggguuucaccauguuggccaggcugguccugaacuccugaccucaaguaaucuacccgccuuggcuugccaaagugcugggauuacaggugugagccaccacgccuggccuuugacaggugguauuuuaaugucacauuuuacucaugggaaaacugaggcuaggcaugggggcucugugaguguaggccugacuccgagccgggcucauccuggccagacuucaggcugcccccagacaguagaagggacugaacuggggccaccuguaccugggcuacaaccucaaaagggggcccacuucaggugggggcacuggggagaugcgcaagcuggcagggacucaccaucugacucggaggcggcccugaagaucagguagcugcugggcaggggcugugugauggagcccacgcucucaccuuuggggcccuggagagagagagaucugggugucacccgaggcaacacccagggccagcugcacagauaggucaggcagaaccaugcggauccacaccugggaccaccuggacacccccagggccacagggccaccagguggggccaggcaccuggccagguagacacuuggcugcagagaggcggguaggugggggagcucuguccccuuucuuagcuggcagcucugcccucagcuuuccagcucugagccuccugacuugggcuguccagaaucagcaaaggcacauccaggaugcccaaugauguucgaaucccagagaaaccaugaguagcuuuuugguguaaguauuucccauacaugacuggggucauacuagcaugaaagaacucugauguuucucugaaauccaaauguaaccagguguucaggguuucucugguuucccacccguuagagcuggcagggcagccccggguuaggaggggugagggcugggcgcuguuccucggccaccccuggggagcagccacuguugucccuccuggacagcagcugggugaggggcuggggugaccuugaugccaccuccuugcagccuacugugugcuucacauggagcaccaguggccauaucugauccccuggccgcauguggggcucagagaaggugagacaccugcucaaggccccaagggggccauucagcugguuggcuccacccuccaccagggcccuaggaaugagccccuuggcccuacggggccucugucuucaaccccaccccuccgcagcaccuucacggcccagacggacugauccagcggguggaagagcuugaagcagaagccguccuucuuggagggccgcucgaugagcucgcagcagugcagcagcaccgugcccacccacuggcccaccuugggcgucuuguagaugagcagcacccccggcuucagcacgcaccacagcuugguccagcucuucagggugccgcggaucugcagggaggaugcuggcgucgaugcccacccucuggggccgccaucccuggggcaucuugauggcuuggcggggagccaggcacagaccagggugggcugccgaggggcccuuccccucccucacucccccacaccaguucggaacucaccccuuccucacccucacucccuggggugauguccugugucuaucguguacccgagcaggggccaagccacggcaagcggugccccaggacucagaguggaacucagggcaggguccuuguucaguuuuuaaaaggagcccauauguuauggugaaugcaaagaaauacguggcagcagggacagauuuacuugugagggucacgugggucaaguucaaggucaagggccucagggaggaaccagcaaugaguggugugacuuguaacuggcagcuuuguagauucuuuuuuuuuuuuuuuuugagacagagucucuguugcccaggcuggaggugcaguggugcuaucuuggcucgcugcaaacucugccucccagguucaagcgauucuccugccucagccgcccgaguagcugggauuacaggcgcccgccaccaugccuggcuaauuucuguauuuuuaguagagacgggguuuugccauuuuggacaggcuggucucaaacuccugaccucaggugauccacccgccuuagccucccaaaguguugggauuacaggugugagccacugcacccggccuggcagcucuguaaauucugaaaguaguugucuucuuuucucauucuaaauacucacuuuugcaccuaacuuuugauucaucauuuugguaugcggguagaaggagccuacaugggccugggcucugcagacaccagggcugggcacacuuaucugguaugcguugcccagcagccucggaguugggcaguuuuaccuccacuguacacaaggggaaauggaggcucagaggcgagugaauggccacggucuccgugaggucugaacacaggacacccggcccugaugugggguccucucccagaagccagagcaaugucucccuccccagcgcccuccgcccacuggccaggccccaccuuauucggaaauggggucuuugcagacauaaucaggugaagauggggcuacacuggaguaagguggcccuaauuccuaccacugguguccuuauaaaaagggggagagacagguggauaaggaaaggccucaugaggaaggagcagaggcugcagugauaacggcuagaugcagggaagugaauuuccaucguuucaggccaccugguuuaugguccuuuguuauggcagcagcacgcugacccguguccuggguggccggaggccgggcaucaccuaccuucaggcugucagccaugaugaccacgcuggggucugucagagcgcugagcagcugccguguggcgcgcuucuucuccugccgguaguucuccuucugcgccugggcccggggcacccgcggugggucaugggagaaggcaccgagcugccccagcuccucccaccguccagcccagggauggguccaggggcaggggcaggagaggaaguaggaggaaguaggggguguggaggcgaccaggugcgguuuguccccuccuuuugacagguggggagggugaccucccuggcucagguggccgucggucugacagugacacugcugcacccuccccgggcccgggcucaccuugagagucuccuucuuggugacccuggcggugggggacacacauuccuugucugacccguugcacagccuguacucugccugaaagagagagguggguaugcgggacagggcacaggggccggcccagggcuaggagcccagguuggccugaugccaaggauaugagggcagaagucagagaagggcgcuccacucguuucccgccuggcacccuccaucccccccaccagcacuuccggggcugccauggggggauggaagaacaaggguggcugacgagagacccuccaugggcacacgccagugacaggaggggacccauccuccccggggcacaugcugggauggggcaggguggucaggaaggagggaaauguggggacaucaggguucagggcugacuuccuacgggucugacugagcccugagggacagccgucuuugaggggacaccugggaggccgcugaggaaagcagucagggugccagaggguggaguucgcagaagaggagcucggcggcggccaugagaugguggcaacaagcacucacgcugggucucuggggaccagcccugcauccacccaaaagaacagcuucccugccuugucuucccccuacgguacccagcauggcugcuccuuggccauugcaugugcccagcucugggcagggccaauguacugguggggggugugcagugggggugcccaccccauccccugggagccgugggcagaggucacuguccagguccgaaccugaccccagcauguggcugacugcacgggcccagggcggcagucccaauaucuuggaggcagaagggggccacgguucuucuacagauggggaaccugaggcaggguagggggcgaguugggacacagaaccaggucuaaagccugcaggcuggggacagcaagcuacgacccgaauccugccugcugccuccuuccgcguggucugcaagcuaagaacagcuuccacaguuuuaaucaguugaaaaaaaaucacaagaauaauuugugagaugugaaaauuauaugaaauucaaaugaggaguccauaaauaagguuuucuuggcacauggccaggcgauccggcaggcguugucuguggcuguucucgugcuuggauggcugugcugaguaccuggaacggagccugcgccgcggcggggccuaaaugccgucuggccuuuuccagagaaagcgugcccgcccugcccugcucuggcugggcgucugcgggugcucagcacuuuccagcggagccucuagggcgaggaaagccucccucaggccuucuccuggcuagaagcccugggcgcuggggacugcccccaccccaaucaugauggugcuaaguacagagcuaaagccuugucugcuggggcaccagguccuguucgggugcugccuguauucaucccccucauucuccagccaugcauaagguggggccgguuauugucccuauuuuauuucugugccugggaaaucaaggcacagagagguggagagcuagcaaggggcagggcauggaaccguuccacggacuggcgguccuggcagcacugggcaccaggcuuggccuuaggcacugagguuagaaaguaaagaugccaguguccugcucuuucagggagaggcagaccagccaccagcacgcagaggcgggaggagccaggggucaggugagcgcugcgguucugcguucugugcauggauguaagcacguuagaucccacagcucaggucaucguuguuauucucagcauuguacagaggaagagccuacgcacagagagguucagaaaccugcccaaggucacacagcuaauaaggagcugagcugggacugaacccaggcaguguugcuccauuguggcacuuucuuagccaaguaagagcauucaggaucacaagaagaaaacggcacaagauggggugccuggggggcucugacuuggaagcagucuuugggcugacgaugagugauaaggaggaggcagaucugagugacgaggcauaugcuggacccuggccaguugacaggccuccagggacccaggcuggcagagaagguguccuaaguugcccuccugggaguccccugagccaggaucuuguucaugaugcccuuaguuaccuuggcacaugguguucccagccuggaaugcuuuucccuguggcuggguagccccugcuccuuucuuucucaggcucccugagcugcuuccccagaagcaggacagcucauaucccugcuggcacagguccuggugacacacaccacccuuggcccgcccaggacuuuugcaauacaaccacgcagccguuucuguggugaacugaugauugucuguggcuuccaccaggggaggguucuacccuacugcccauucacaccggcagcugggggcuuagcaagcaucucgaaugaaugaauggaugaauggauggauggauggauggauggauggacgcaugaaccugcugccaauuccccucugcccagcuucccacuagaugcagcugaauggggcuguguguauuugaggcaacaggggaagagagaggcaagaccgcauggcaugggauggagcacuugcaaccccugcuccccaacugggcaggacccuugggucuggucacugcagccccugcagccccagcacugcagagagugccugcccacuccucccuccugcaggccagguggguaccccguccaggcaugccagguccucugcucacuccucagugcuacugugcaucagugacagugccauaaggaggcaccugagagaugagaagugcugcucagaacugugaacuucaggcugaccagaacuuugcaaccuaugaaaauuccuuaaaaauauaauuuagaaccaccuacggaaugggaggaaguagucgcaaaucauguaucggauaaggaccuaguauccaaaaugcauaaagaacucuugcagcucagcaacaaaaaggcaaacaacccauuccaaaaauggacaaauaacuggaauagacauuucuccaaacaggacauacaaauggcuaaugggugcacgaagauguucaauguuauccgucauuagagaugcaaacugaagccgcagugagaugcuacuucauacccgcuaggauagcuauaaaaauaacacaaaaaagaacaaaucacgccuguaaucccagcacuuugggaggccgaggcggguggaucaugaggucaggagaucaaggccauccuggcuaacacggugaaacccgucucuacuaaaaauacaaaaaaauuggccgggcgugguggcgggcgccuguagucccagcuacucgggaggcugaggcaggggcauggugugaacccgggaggcggagcuugcagugagccgagaucgcgccacugcacuccagccugggugacagagcgagacuccgucucaaaaaaaaaaaaaaaaaaauacaaaaaauuggccggccgugguggcgggcaccuguagucccagcuccucgggaggcugaggcaggagaauggcgugaacuugggaggcggagcuugcagugagcugagauugugccacugcacuccagccugggugacagagggagacuccauuucaaagaaaaaggaaaaaagaaaacaacaaaucagaaaauagcaagcguuggugaggaugugaggaacuggagcccuugugcacuguggguggccauguaagauggugcagccgcugggaaaggaguuuggcaguuccuccaaaaguuaaacagacaauuuugagaguucuauauuauccuggaauuaccaugugaccuagcaauuccaauuacucuagguuuauaccugagagaacugaaaacugauagucaaauacacgugcacacauguucacggaagcauuuuucaugacagcuauauggugaaaacagcccaaauauccaccagcagcccucccggagcagcacagucuaggauugggagcuguuucccccgaacaggcuggaauggcaggcucagcuggacgcccugcuguccuuuuccccagccguuuccugcuguccccagagccaggcucuggcucauggauccuccuauacccaggcucuuaccgguggcaccuucguggcagagcuuggggucgggggcccuucaucccugggcagcgacgggccguugggcuccauguccuucccugcaagagagcagugggagugaggacccaggcaugguggcguggccaggcuucucaggccgcugccuggugugaggcaggcgaagcgugggugcggaugaccugggaggggcaggaagucagccggaggugguggcaggaacaggacacugccugagagguguaauaaacgccagcaagcgucacugugggaggagugugccaggagaacuggcagggccuccaggaccuacagggaggaagcugggacaggagcugguaggaaccggcauccugggccugcuguagugugcaauugggggucugugaaggccagaguccccaguuuucagaaaaagaaugugacauccagucucaaagacacauggcagguuuggggccccuggacugugcaucccccuggcuggaugcugccggccccugcgugcugggcucuugcugggagguggucagcccugucugccaucccacccuggcaggcuggguaaggagggagaggcaaaggagggagaccugaggugucugcguuugcuccuuugggaaauggccuccccucccccggcucuguuugcuuuggugccaguuucccaagguacgauuucuggacaggaggaaggaggggauggcugcaggggaagccugaggucugcccagcagggccgcucccgcugcuuccuguggcuggugggcgaggguugacugccccggucccugacacugagacucggaggggcugggggcuggagugaaccccauccugccaaggccacaggcgacaggccagcaacaggcugggugcguggacagacgccacagaccagcuggaaggccuggggucuauagccguccuucccugacagcccugggcagggacuggauggggacgaagaacggaaaagccaggacgguggccugaggaagugguucuguccaaagguccuggaccguggccacucacagucacagaacaucgcugacccuggccggcaguggcugcucccccaccugggagccucugcuuccccaucugcagagugcuacgccccugacccggagugcuggggggaggcuagcaggagcgcucuucccucuggcacuuucucauauaguucuaggggcuuggccuguggccgccagcaaacuacuuuccauguggaugcugccuccuggccgggaggacucaaaggcuggggcccuuggaccacucaaagggauagggugcaggugcccugggcagggggaagucagcacugguccuucuccucacagccuguccacacccaccccacucccuuggccugggaccuaccgccuccauuccucggaaaaggcccuucccagcacgucuucugcaccgccugggccaguugcuaguugguccgagucccucugaaacugaccagcagcugggacccagcccuuccccuccccaccccugacucugcaagugcuucuaagccuccggccagggugaacgugacagcagagaauaaaagguguaggauuuaccuugccgggugucgagugccccugccugccauagcaccuucagcaaggccaccucuacgcugggacuccguuuuuccaucuauuggaugggacuuuggcugcgaccacacgccccucgagccugggugguggauccgcccaaugcucucccacuccccccagggcagaugagaugaccauggccaggcagggcuggggcucccacuuccucagccccaaagcaggcagugggaggagagggggcagagcuggggagaggucccccaggcaggugccugccccuaccuccuacucucaggggaacaggggaggaagggcuggguuuucugggggacagcagucacagcucagccuuggcuggggcagggguugugcauaguuaggugccagggaggggccuggagaguggcagcauuggcgggcagagguucugagucugugugcugggugcuuuaucuacaauugcacgaaggcaggccugguuccagcuguccccucucagagcccaggacccauguauagcugggaguagguacuaauauugucccauuuuauagaucagucaacugaggccuagagaggucaaguagcuggccugggguuacccugccaggacuggggcucaggccaccugucccuggagccugcacuccauaacucccaaagccugggcugacuuugggaugacugcacuccauaacucccaaagccugggcugugggaacccccuccucaaccagaugggcuucaccuggccccgcaggucaagccaagaagccguauuaccuggcacucuaccaagcuacaaaccguuugaucaugaaacccacacaguccccagcauggaagcuguggaccucaaggggcacagagggguugggccgcccggggucaccccaccgggcccaagcugagggccagguugcccugcccacggccggcacuuaccugggcugaguggguagagcucauugucuccgcugaggagcaaguuccgggugagcuuccgggggucgacuuucugagggguggaggaagguggacacagggagaagcggcgccggaggaaggccuccuccuucaugcugugggcgcucgggggcuucuggaaggaaggaaggaggggcagcaggaggucaccgccccggaaggggcuucagagccacauggugggggugccccuggcuaagaagucccccucucaggggacuucugaggcagggugaggagggccugggcccugggagccuggugguggguggucagccaggacagcccagcucaggcgaauggcuuuggcuggugccagcccuuuccacgccgggcaguagggcuggacggagcccuggucagagaggcucaucaccacccucggaagauguccuucucagaacccccaccccagguucugugagacccuggcugcagccaggcagacccacguguagacacagguuuucccucccgcauuucccucccacgugacagcacuuugugguggggaggggucuagagcuuccauggagaagaugcacgggggugagaccagguggccgcugagcaccagggaguggcuggcacgguguugggcaguccgggagccuggccugccauccaucuaagggucccaggagcgccucgccucugguuaagcccgccugaagcuugggugccccaacaguuucaguugcacccacaugcaccccagcaagagagggagcucugggcgcucacagccaggcacaccugcguccacgcccagcccaagacguugcauucccagugggagcuuccuugcugcuucacaaaagagggaggccccacagccaggcccugacacccaccugccucgcucucccagccccgcccacuggcagaccugccuuuccccuguggguucagaagcgaguuucuuguuuccuccccuggaaggagagaggacaacaggcgguccccucuguccugcuccccaccagcccuacaccuaguagugcugggccaagcagaggguaacugauugcagucacgccuuugcaggcacuugaaguugacggcgccagauccacugaggucucagcccauuuuacagaugagaaaaucauggcucagggaguggaaggccucgaccuguaaucgugaccugacaaggguuggcagagcauccccuccagcuucucaucuuguguccacuucccaagggcgagcuccuuaaaaacuacuggucaauuuuccuccuuucccaauuuucuggggcugcuuccugcugccucagggcaggccaguggcauccugccaagcccgggacaaaggccucgauuucucccaugguccugggcuuugcuggggggggccucagacacacagagacuuuccugcuguggcuucaggagugggcugggggcccagggugucugugguccugggggcuucuguccaccaccccagagcccccucugugcccccaguccugaagucagaguggggaggggcuccaaggaugcagccaggcugggccagccccucccucaccuggccccuggcucggcucaugaccuuggccaucuuacacacagggcagcuggcuucagagaggcuggcguuuuggcccaggucacagagcuaacaaucagcaaugccguccuuaagccagguggaaccgauccuaaaacccagccgcugagugucugcccacucagugucucagcuuggcucagccaaccugccgcagggaagcaggcagaugggaaguccugccccuacuugucaaucacaacaaacacguccuacuugcccaggugcagcucaggaugggaaccagcagcugagcggaggccgggcuuacucagacagcugagauuuucugagcacccaggcugggcugggcaccaggcagccaagguaagugagcagcgauccugcucucaggacccacagagagccccggaaugucccaggcaguguggugacagcgauucccagguaggucucccucacuuggaaccuccuggggcagggagaggggcucaaaaccuagccucagcugcccugucuggcugucugcuccaguuccaccugggccaagguagaaaggccauaggggaucuugguaccuuucugcucagauaccccacauaccuucucccagcaccaaugacagccagugggacuucuuagucugugagugccaccauccacucaucuauacaccagucucaucuauacaccagucucccgcucccuuguaucccuccaucuauacauacauacaucucccuuccaggcauccauccauccauccauccacccacccacccauucauccauccauccauccauccaucuacugucaucccaucuauccaucaauccauccauccauccaucuacccauucauccauccacccauucguccauccauccauccaucuaccauccucccaucuauccauccauccacccauucauccauccauccauccauccacccacccauucauucauccauccauccauccauccacccauucauccauccauccacccauucauccaucugucuauucauccacccgucuauucauccauccaucuacuguccucccauccauccauccacccacccacccauucaucuauccauccauccauccauccauccauccauccauccucccaggcauccauccauccauccaccaucuucccauccauccauccauccauccaccuacccauucauucauccauccauccauccaucuacccacucaucuauccauccacccaccaaaccauccauccauccauccauccacccauccacccacccucccucccuuucaggcauccauccauccuccuguccauccauccauccauccauccauccauccauccauccauccauccacccacccauccacccacccucccucccuuucaggcauccauccauccauccauccauccauccauccauccauccauucacccaccugccaccccucuaucccuccuugaagcucuccagccagucagcugaccugccugauuccaccuuccuucccauucaccucacacucagacacaucugaggugguauucaaauaaugucugaaacacugauauggaacagacacucaccaauccaaaugcaauacagguguguaccagggacuaucacucugugugccaacaaccccagaccaguguccagugccccgggcccugcagaccaccucugacccgcucagacagggugggcggcagcucucaucacaaggcauccuggucuguggagcccuucuggagccccccaucccuuggacuuccugaugcccuacagcugagaggugccugcugagugcccccaaauggucaccugguggggagguguuuuguucauuuuaaaggccacaucuccccaguggcuccauauggcauuuagaacaaauccagucucaucccgucccuguuccccaagcccucccgccaccccauuccccagcccacucugucgcccacucugcuccagccacacuggccccuuuauguucccauuccugcugaaugugcccgcccaccaucuccacauggcccgguccuccucaaauuccacugucagcuucaaugucacuucccggaggcuuggccacucugggagucgauucagauucuccacguagcacugggaguccuuggagggcuccacauugcacuucuuuguucuucgcacacacuucucccaccagaugcagcgcaggugaggggugguggggucugaucauggcucugucccagcagccaaggcagggacacgcgguaggugcuucccauguguuuggauucacacaggcugccugucgugucgcacggcuccaggguggagacccucggugguugugcagcaggcacuccccauuggaggugccuggggugccugccugccuccccacuguuccugaggucuccaggacagggcaggguccucagagaggugagcaggguuaguuuuagggcugauuuccacuggaacccuagugagguucccaucccccggccaucugccacuccaggcguugccuaaggaauaauggaaaguuggcaucugcagggugugagcugcugaggaaugaggcccucuuggugcugguaggacuuucauccacugcagugaaagcugaaggcugggagccccagggagcacagccccugaugggaaccccccaugaggggagggagagaaggaaagaaggaugggucgacaaggaaacagacacgcuggcugaggcagcagcgaccugggaucccacucaaacugggaaaugcaaaaggccuguuaucgccacugcccugcacugccugcggggaagccccgggccacgcuccggccaccaaggacuucagguggacccuuuaggcccagcccucaggauucugccugccugaggccacccaagguugauguggcggucgcucucagcggccuccaugcccuggggggcuggccugucccugacaccagcagcaccuucaccccagagcccccaaugacucucugcucaucuguacacagcugggccucagccugcaguugccaaacccuuuuccgccacugugcauggugcugcguccaucuccagcugugaucucauccugcccccacaguccugaaguccaagugcaggaggggacgcuguggggcuugggaggaaggagccccagagugccccucccacggugagacugucccuggggccaaagaggaagugugggcaauuccagucugaaaggucacguuucugccugguggggccccagccccgagaccccaagguccccuaaggaggcucauucuggaggccaggccaggaggccagggaagagggaguggcuggggaagaaggcggggcuugguggggggggggucacuagauguaugugguccccagugcccagcucugcccaagccucggaggagggaagggugcaggccuggagcucagaaacaggcaggcgacaggugggcccggaagccaccaccugaccccaaguccaagucagccacaacccucuucugcagcuuccauuccuggggggccuaaggaaauguccucuuccaaugucacaucagaugcugggucgccucgugggccuccugcugucaccagacaggacaggaagggccuccugcucuccuccaggggcccuguguuugccacuguagccauccgcuggccacccagcaggcacgacuuccauuguuggggguugccuguguccccaggaaccaauucuccaagugccccuugccugggggagcgccagguuuuguucagcuguugggcagaccuagugacuagggugggggccacucuuccuaguccagagugagccaggcccacuccccagccugugaaggcucaaggugagcagggcuggccccccagccccuccuccugcugcuggucccuagcccaucccaggugggugcccugcccagccgcucuucucagucaugacuuugugccucuuugggccuuuuggaaaggagggagggaggcaccaaaagggaacacuuuggacuuggguugggguggagacccgcuguccaccgaaagaaugugcucugagcagagccuccucugccauguggcgggaugggccggggagcccacaggggcugggcuucagcugcgugagugggucuccucagaggucugcugggacuuggggguggggugggggugauccugugacccagagaggggcugagggugggggaggggcaagugugggugccgggugcaggcccgugggcagggccaaccaccagccugggagagcugacaaucccacuuguggucccacuaggcuggagaggggacgcgggagaagcucggcccauggaaggccccccuuucucugcaccccagcccccgagcugggccuuugcuucugccuggcccucugcagggggcuccuccuucuuccucggagacccagccccuuuguccaagaacguuuccccagcugucaguccucaggagcagcugaccgcccccgugcgucucuuuggaccugaagugcgcccuggcggugcuucgcuuuggccuggguggguuccccugaacugagcugugcugggcugggcagggccgugcuuccgccaaggggacacuggcccagcugacuuccuugacuacucaagcaccucuggacccaguugggcggggcacacacaggggccaacucugcaucucuagaaugaauucgcucauggcuggaagggggcuugagagacgcuggagcugcuaagggccggggaacguucuggagggccagagaguaagggggacagagagccagaaccguggcagccaggcagaggccacuccugaggcccuccucugggcaaggagguggaugcccaggcaggcagggaugggugccccuuccagguccucuccugagaccccagcacccuccuccaggcuagccccagacucccaccccugccugugcccaaagcugcagaaugcccaggccagauggacauguggggcucucggggacugcagguggccgugauggugucgugcagcugcugcacuccugagaccacagcuaagacaccgccccgugguggcagcgccugggggccgccuugccugcggcagggucccacccacacccagagccacugcuugaccccccuuccuguuaaccacaggcaccuccugguccccuccucauggcucccacuuccuccugcccugcugaguuuccugggccaccuaggaguugcggaggggacagaggcgagggcacaggaagggagugagcucugacucugggcugaccaccccuccccaacccccacugcauaggcuggagcaggcucuuccuuccauuucucauguggggcaugaaagaccccuuccaccacugggagacaagaggucccauguggugccagcccagagcagauggggagggacaggucagguucugccucugccuggccagcccugugucccugaggaugcuugccucuggacaccuggggaggggccaugcucucugaccccacgccaaggccagcuguuuggcagcauggggcccaggcccaaugggggccccacccagagccagugcacauggccccccugccuccgccagcugccuucccagcaguaauccagccuccaaagugcuccuuacccccugccucccagacgcucgccuucaggcuaggauaaagggauucuuguaaagaaaggucacuggcgccuccucaggccacauagagccaucagcuggggccacacuuagcugaaccuuggccaggggcagacacugccucagcucugggaaaggcugaagcucugagaaggaauccagcugaguccuggacucauuccgcauccuuccugugcccaauuccuccucuguccuccugcagaggccuggggaccgcagagcuggggaaaagggcccagccaugacuccagugguuguguggccucagcuggccaccuucaucucucaggcccuguuuguaaaucaggacuugcucugagucagggagaugaugucccaggcccacaggaggcccuggggaaggcgccugcagaggugagugugagcccagacccagcccccuccacgccuauguggcuuccucacccacagcccagagugacagggcugggccgcgcugcaugggggcagagaggaggcucuggccacuggggugcuccaucaauuggcaggggccagaaaagcaggaacuccgcagccagccuucagcaguaacauccggcacagaugcuucugccuaaaccagauagauucucguucaagacuguggaggggaaaugcucuaaaaucacaaggauaaaggaacauaagcccaaaugcuuggcucuucgcacaugggauggagaggucagugggucccaaggaaggacagcagccaucaguuaaaggacagcagccaucaugucaacaccauacguuugcauuccagaaacuugcuaaggucaaugcaagugaccaugaagauccugcugugaggaaaccacgcaggccuccugagucaccccagggagaccaccacagcaacagaugcacucccugagagcagacagcagcauaagagaccaggcugcugugucuggguggaccgaaugccuagugcuaaugugggcagccugaccaccccugcaggagcagcagccucuucagagagccguggcaugcacuucagcuguggcagcugggcccuggggggcuugggacaugcgcuuucccaggacaucugcugcacugauggaccuuaaagcccccagguccuccuggauguucugucccaucugauaugauucucggaaugcucgcaaggugcggggagcaggggagcaggggucaucaucacauuuuaaagaugcagugggccggguguacugcaccugggauuacaagccuguaaucccaacacuuugggagccugaggcggguggaucgcuugagccuaggagaucgagaucagccugggcaacauagcgagacccugucucuacaaacauaaaaacagccgguugugguggcacaugccuguggucccaguuacucaggaggcugaggugggaggauugcuugagccugggaggucgaggcugcuaugagccauggucaugccacugcacucagccugggugacaaagugacacccucaucacacacaaacacacugggaccccaagaggggaaacggcccaucuaaggucucgugggccaggcugcgccugggauccccucaaaggagcacagcugaagccccaaauccccuuugcacuuuggagauagcuguggagcugagggggaggccaggccucccucuggggagacauuuaucagaggcagcuguggagugguugaaccucaagaggggcacaggaaguggccugcacugcugaggacgcagcaucgagccaugccugcguguucuccgggcugccucagccaaguccugugccugugggcccggccaggccagcccguccccggcccuguccaccuguccuccugauggacaccaggcccacugaaggcucagagcagcuacugggucagcuggccuugguaccccgaccccacaccccuguagucgaucacuccaccagcccuaagaagcccuggcaugggggcgggcugggcguggucccugaggcaggccuggccccaccaccucccagcuagacccaccaccucccagcuagacccaccccaccugucccaacugaaaggagacuccgauuuucagaugcuagcugcagccagguggcagcaggggucagccggggagggagggguaagggagugggggccgucacuuggaggcagugcagcuggaggcaggggccugcugggauuguggacgcaaucucaaacccgccacgcugagccucagcauucacacuggaaauaagacaugaaccugggcccccaguggagccuggacacucacuuccagaaaagacgcucgccugccgugcuguggggcuggccucuguccugaaugcccucaggcacaccuggggccucuucuggguggugccagugcccccuugccuggcccuccuggugaggcuccugggcuuggugugccacccccaguggacggcccugcaggccgcugccuacccaggugggggaccaagggagaagcagcugggcuguggccgccuagggacacgcggcugagaagcugagcacguggcugugucuccucaucuggccccagccugcucauccuccuaauuccagggcagccuggagccaggcgugugggcaaaaacuccaacaagaagaccagagcaaaacaaagaggacgcggcugcugugggccaagacugagguccgucuccgcccuccaggggcaccugagcuccaagggcagggaccgggugaugggucuucgcugacaccgaguggggauccuggggugcgagcaggcccacacucucccccaaaacccuccagccucagucucccccacugcccacccacacaccaccacagcuguucccguucaggggacccuggggugaccaugaggcagugggccugagagccagggagguggaagcuuccagcccuggaggagcagguggccaccggccagcugagugagcggagaccaggaggcugugcgggacggguggccccggggcuggggccguggccaagccugcuggggucugccaggggcaucagcucugaaggugcuggcugugcuguugccagugcucuguggggccacgagcaaccugccaggaugaugggggaaggaagagccaccaggcuggggcagagguggagacagaccccagugauggaguugagcccauucugggaaaggcagggaggaguggccuccagugagcuggggaaagccagugagcagggggcuuuaaucaccagcccaggcacccagcccugcccgcaggaguuugggggcaggauggggguggcaggccuuccccuggccucuggacaagcccccgccccagggaggccuugcugccuugcucuauggggaggagucacuuccagagggcacauccagccuccccuccucucucucugucucucggcuucccucucugggcuccuggacccuggguccaagugcugcuucccccggccucucuuccuucaggcagccagccuucccugcuggaguccccgaggcccagccacgcgcccugaaggagcacaagcuccuagggugcguuuacucgcagaggcugaagcugguggugggguggggcgcucacagccuggccugugguuggccaaggacaccaacaggagcucuucccugcagcuccuggcaggccugcagaggugcccccccugcucugagaagccagccucacaagaucauucaucgcaagcucugggcccacugcucggcugugcagccugggaggggggugugcagugguccgccaagcagcaccucugccaaggagcucccucugcagaggagaacccggccaaggucccccaaauugcagccaccaucucgggcuguauuaacagagguugaguccucagaaggagggaggggauaauugcaguggugucucccuggccaggcugcugaguucagcucuggaaggggcagcccacagcaaugcucucugugaagggccagcauggugccacccaggagugacacacacagccaagcucuccccuguaucccucaggugcuggacaggcaggguagggcucacagccaagcuaggacacccuucccagggccaaggcagcccaggaaaagccagcacagcguguccuccugagaggccuguguggacacucaggggucccagucugagggggaacacaaggccuugaccugguagcccacuuucaacacuccgugagcacgcagggccucccccagcagagaggggcaccgagggaagccaggaccccaggcagugcccucuguccacccaaguacaugcugccccaccaguggacaggcaucgucgucccggcuccccucugucccccagcucacauuacccaggacuggcuguaggagccuuguuuccaagaccagagaggucauaaggucaccugcugcccacacgucccauccuaguccuccuugggguauguggguaccuggggcggccccucauguccaggagcugaggcugccccuggguguaucaaggugaggugccuaccccaccccuacccgcccaugcagagcugcagcuggugcucuggucagcccaugggugugacagcccagggggcccuggggccaggugaccaccucagagccacuccuuccccgaugccaucugucaagggucaggggucacacacugcagagaagaagacacaaagccuggcagguaggacccugggggcaccaacuugggugggggucagcccaaugccuuguacgaagaggcccccaaaacaggaauaaaaaccaccuaacaacagaaacaacgucaacccauaaagccucauuccaggcaguuucgagugcucugaugcugacagccacccaggcuuccccccgcccagcagacaguaucgucaucaugugugaugcagggagggcacaggagaugccaccgagucgugauugcuccuggacaaugcacagcguccuuugaccaagcgccuccugcucacccgggaacacacccucggguccagcauccucccugugacucugcauagugggaaggacguggauucuagaaaccccuccugccccagcaggcagguccagccccgaggccuccuugguuccccucagaacagagcuuccagaagggcccccaaucugucucucaggaaauggggggggucucaaacagaaggacccccaaucugucuuccgcugugguggagagcuugccaaaguguucaggaaauggcauuaaugggguccauuauggcccgaguugcgcagagaggacagggaggggcuggauuuugcugaccuccaaggggaacccuucuaugaacggaaagcucgcaccucgcucaaugcauugccaaguugcgauucucaugcaucccagugcuuugccgaggugccuacgccacccuugcauguguguccuccccugggcacaggaugcuaaauggggugacaguaggaacacccaccccccacccgccucccacccagugcagggacugggaggacucuacgcccuggaaggaaaaaagacugcaagaguacaaaugcgccauuuucccacuuucucuccauguuacaguugcaguuucuuuucuuucuuuuuauuuuuuuugagacggagucucgcucuguugcccagacuggaguacaauggcacgaucuuggcucacugcaaccucugucucccggguucaagcaauuauccugccucagccucccgcguugcugggacuacaggcaccugccacgaugaccggcuaaaauuuuuuuguauuuuuucaguagagacaugguuucaccauguuggccaggcuggucuccaacucccgaccucaagugaucugcccuccucggcgucccaaagugcugggauuacaggcgugagccaccgugcccggccgacagcugguuucugaggccaagagaagaagcugacucgcccagggccacacggcagguuggugcaggaggugcugggcccuggugccaccccaaaguccacggggcugcccacagcugggggagugcaaugcccagaugguccaagagaacacuuucugggcugcuggucuguacaacugggaagccccuaccucuccaccacgaccccuccaugcccugcugccacaagggcccaggaucccuccccacucgcugcuccgugucccaggaggucagauuucacccggaugcuuagcuccccucccuuuuuacagaugaggaaacugagaaugaaacaggaaaaugaaaugaaugacuccauccuacaggucugagagucaccgucucgcggguggagagccuggguggugcguuuaucaacaggaccgcugguuucaugucucugucucuccucauagacccacucagguggagaccugucccucugucuccguguccgcggggcccggcaggaagucgugugcagggguggaggcuggaagaccagcaggucucccuucaccuggggauccccgagccccaugcagccuugcggguagaagggcagugacugcccacuccuugcacacaaggaaacagugagaccagaggaaaaggacaaaaccagucacccaggacagcggacggcacacggggugggggugugugagcagagacccuugggacccagcaucugggucuggacgguccuggagccugcagagcagggcagaggaggcaggugcagaggggggcagaggaggcaggugcgggggggggcagaggaggcaggugcggagcggggcagaggaggcaggugcagaggggggcagaggaggcaggugcagagccgggcagaggaggcaggugcagaggggggcagaggaggcaggugcagagccgggcagaggaggcaggugcagagccgggcagaggaggcaggugcagaggggggcagaggaggcaggugcggggggggcagaggaggcaggugcggagcggggcagaggaggcagguacagcccagugcguggaccagcgaccggcuccaggggcccauggggggcugcacugugggcgaaaacgcacggacgcgacacacccaagagaaacaagcacacgcccccaggugguccgcgcacgcacgcucccagcagcauggcucagggccaucagagagcggacacagccagacauccacaugggugaacggauaaacauggaucacaucugugcaacggauggaagaacauucggccuucaggaggcaggaagcacggcacucacacaugcgacgacacggaugagccgcagagaugcaccaagucaaagaagccagauaccaaaggccacaucuuguccgcuuccacgcccacgcaguguccaggacgggcaggucuggacacggaacgcagacuggugcuugccagggcccggcccgguucugucccgguuuccuggggcucuuuggggaaagagcaugggcuuuggaguccacuaugacuggaggcugaccagaugauccuggagcccugggcccuugguuugcuuuacugcagcccagggggauccuccuagcuccuggccguggucauagcugagcagggcccgaggaaggcacccgggcugcagugcacagcagaugcuguggaaucgacagcucuugggaucauccuguguggugggagcuaugggguggacacuggguuuggguagcaggacagagggucgauggccucaagucacacugagucaggccuggcgggggccagcugcuccagcacccacugagcccggcaaaccucgauggcuccucccauccucagggggucccacagcccugagaccaaacacggguuuauuguuugugaggugguucaagcaggcugcaucaggacagaaacacacaaaaaacccaacgcggguggaagugacaggcagguggggacagaacaugcccccuccucugcagcucacacucugggggauacaaugaaaccgcugacaaugagagccccagggaaguggggugccauggugccaaggagcagugugaggugcccucgacaugguaaagccccaugacggggagcuggagugugcagaaacgcuggcagcgguggacuaugggugaccgaugcuguuucuuuaaaaaacaaaguggaauuuccauaacucuucacauucccaucaaugcauugaucaugaucacagccagcagcaaacccgccaggcuccguggccgggaccagcugaccucugcaggggagugcgggcugggccuggccugaccccguuccaccgacacugagacagcagacaccggccccaaauuccaccaccugugacuggcugagcagccacacacguggguggucugacuuuggggacaccccauguuaugcugccucuuggggaacauuuuuauaaugggaaaaacaugucccccuuacaaauccugcaagcccggggucugcuggagccaacccccagucccccaaggcguccccacgcucaggcagccacccuggcgggaggucaggccuggggccagggcagcucauuccccaggaccugcgagagccaccccccggcacccggauccuccaggauggucucauaccaagaucuucaguaacaucuguacagacccggauuccaagcaaggccacauccacaaguaccugggguuaggaccuggacacauuuuugggggacgcuguucagcccauuacaggcagcuucuguagcaucuagcccagcggaggccuuuggggggcagccuggcucuuugcgacuccccacggaaggggcacugcgcuccccucagccacaggagcccaucccucccgcucugccuggcccucacgcucucugcgugcaccugggcuggccccgugcccgccuggauuugacgaagcccaucaacuugccccacugccucccaucgccuguggcagagccaccuuuucaaccccgucagccccuugaugaaccucccccagggcuccagccuccggaugaagccuggggcccugccccucccuccaccaccagcugugccaccucagcagggcccacaauucugucacacuggcagccccugcaaccagucccacaggccaggccacuucacgagccccauucccuuggucacauccccuccucccgggccagcacugucucccacugccccacagccuccacugaaccuucuggaagccaccccugcccagcgaguuggcacucacuugccugcuguccuggccaugauguucuugggguggggguuuggccucuugagggcugggagacaucggacccggcugcagucccagugccggcugagacccacacacaagagcaggggucugcgcugggggcugcuuccuggaggacauucacagacucgcacccucagaccccagaccagcagggccagcgaggcauuuacagccccugugcaguuuacagaugagaagagggaggcccuggugggaaguggggccuggccgaacaagaccggaccagaaccccggccugucgcccucagugguuggcaaugggcaccugguagcccagccugcguucacuuaacuuuguuaccuggaggaaagucacaacuccacgacacuccuagaugacucugggugggcugaggguuacagggacacugguacauccucccggggucacaaucggcaaaugugcucugaacaccacccucagcugccguuccacuugcggaugggaggauucaccugggggccccuccgcccugccgggagcaagccagacccaggggccuuggccccaggagcccacagaagccgagugucauuucuauuccaggcccuuccaucucaccagaugcuagggguacaaaagaaaaauaagccagggucccgcggccccgucggagcucucagaccagggcgggcagaccagcgagacagacacacugcccuuaugagcugcgcccccacccccaaacccaccucuggggaagucuguucuuuccugcgggaaacccccagggcgugugggacucuuugaggagacagagcucacuccgggggaggugagggcagacgaggaggggaacucacgggaagguaggaaaggggucucguuuguggauuccucuacaggauuuggggguaccucugagagugggggacggagagaaugcagguggagauucuggccugaggagaggcugggugggacgugguggucagaagcccccugccugugggcacggcuguuggacccugucacggcauggcugggacgaggcacccggugucuuucuggcacccgguuuccaucgcacccgguuucgggcacuccgucgcuugccuucugcagagcugcuaagccgcugggcacacagcugugccugagugcagggggagaggccagcuccaggcugcaggcuucucucuggggagggggacaauccuggggccccucugggguuugggagaugacugaguuggccuuuguacagccugucccgaagcggccuggcacagggcagcagacugcagggucccuggcagccagauccccuucgccguggcuggagcuggcguuucuauuuaugauucgccucucacgccccuucccagcacacccagcucuggucuucacgaggggcugggauuuuagagguggcucagcugagggcacgggggccuuggcagcugucacgacccuccugagcuaaacgcacagcccgcaccuuguuagcucugggugggccgaggccccagcucuguccugggauccuucccagucacccucacguccugggcuucacuuuuccccaaggcagaaccacagccgugugacucaccccgucucaagaggaccgggcgggugggagggcugcaaggccucugugaggccugagugcuggacuugggacuccugcuccagagucaggggcuagggcugggccgggcccacccaggaggaugcuggcagaggcccugggaggagggggagugggcgccagcuccaggacuggaugugucugacagccugugucccacagggcuugccaugggccugggcacggcuccugccucugcuggccgaccuggcuugaccucaagcggccugggucgggacagccgcagccgaggccagcccauggugacaaggccugcuuccagccucucccucgugccccaggcugugggucagcccagucagcccugcuaugggcacauagccccgugcaggcccagcugggacggagcaacgcaggcagagcugcacugaccucuccggagugccguuugugaacucgaaucgaggcgccaagugcucacguguccuuuaagccagggauggacuuccagaaauuuacccuugggacuaaaacccccuguaaucaauaucugcuggaagagaggcggacggcuggcagaggcauuuaugggagugagcguguccagggacgcgugggugcgucggggcagggaaggccgggcguggcccuagacagggcacaggggcaugaaaggcgcuggggaggaacaggaccagccucggcaagugggaguugaugcgagugacccgggcccuucugucucgucugggucuccaccaccaagagccuguucuugcgacugaacgcccaccauggcccuggccucaccgagcugcccucgguucccaggaccucuggggccacuagcugggcuccugccuggucacucuccuguuccucauccuccgcacgcccccggcacccagacuuggcacacuggcugcagaggcucccauugcauggugcagacagcucucccugcacccccagugcccgaacauggaguaggugccagugaaugccuccugggggagucugaccacgauguguauacaguacagccgggacuccccggggagcaggucggaaaccgcaccugcugacuuucuuaguugucuuuugggaaggugggcuggaccccacuacauacuccccaaggucaugaggggcaucggggugggaucuuccagaaccuuccccauuccuucuacuauccaacacugacaugugggcccccaccccugaccuggggaggcaagggccgaggagucagggaggguggagaggaagugccccucccaugacacguacuuugccccccacaccuuccugcuggcagcccugaaggcggguaacaagauggaagaacagaggucacagaagagagaggaacggaggugagugcggagucucuuuccagcggcuguccagguggaggagacggggcgcugucuggaaccggcuuccaugacggcagggcgggggcaccguccucugcacuuuuguacaucuuugacauuuucuaucauacgaagccaaacgggagaggacacagauuucucuugaaggcacaaacugaagggaaauccacuacccagauggaguuuuaagaggagaauuuuggaagagccuuaaagcaggagaggaaauuggcaugauagcagcauugcaucucccagagggaggcuaaggguuuuuaagaaggcaaaggugacaaccagcuagauaagaggcucaaacaggugaaaaaucaaguaaccggcacaagauaaaagagguuauuaagauaaggggauuaagacucaggaugagcuggagaauucgcagaggagcugaguagccucugcuguggguuggcaggggccggccaggucuccuccgugggcugcagccuccagagagcauggacccccagaggcucagaaccugccccagcccugaccuccccacugggcccaccacagagccaccuuuauauaucagcugccaaagccaccuccaggccacuccagcccugugucuuagcaauagcccuuuccagaggcuuccagccuuaucagcuuccagccuuaucagaauggcucucccacuguccagggccccccgagcguccacaccaccacgcuggaaguccccaaggccggaaugcagcagaggcccgggucaggccccccagagcugucuucuguuccuacaggcaugggcugggggggcagucgcccuuugggagaccucccagcaccccuacccuaucugguggccaggaaaggggcaagaucuugcaguguacuggccucuggugagggaggcagugagugcugugacuguggcugacccucuugccagcauccucccuguccccaucaacaugaccagagugcuugccgcuccaugagcuuccccugcccaugugugccuguggcaggggugccgcccgcgcaggccguggggacaguuuaugcgucaggcagcagcagcagcaggugcccgcugcagccuugcccaggcucuuuugaucugauuugguccucacggucguccugggaggcagguccuaucaggacaugugguuuccagcacacagcggugcuccccgaggccccugcgcccugucccuucuuccucuuugaucaucaaacgacccccccgucacugaccagucaacggguggucaccgcccuggcaggcaccacguagcccggggcacaagggccagcuguggcugcuggugaguguucccugugugccaggugcugacaugcacgagugugaugguggccuugcauuccucuuucauccugacugcucaccacccccuucccaggcacacacacacggaugcauggacacacacaaccacaugcauggcacacacacauacacaugugcacagaugcaugcaugcacacacaugcauaagcagacagaugugcaugcacacacacacagacacacacguacacacacacagcaaaucaggaugcugaagccaaccagcagcuguuuccccuguuggcauggcugccgcuucccaagagggcacuguugcccuccugccccaggcaggaggcuccaggcuaaggacugcaugccugagucugagccaguacaaaaaggcaaguugcccucgggagccagggucccaaguccccggggggagcagacggugcuuuucucccccucacuuuuuaaagacagcuuuuuuuaaaaaaaaaguuuuuugguucccagguaaacaugucugaugcaaccacaggccugucccagguugucuuccgggcaccugggaccaggaugcagccuuggggaggaacccagcagcuccuccuccuuagggaggagcccagcagccccuaggugggcacgucccacccguccaagcugggcugccaugucagcagcgugcagacaccaucucaggggcaagacaggggucaggaggccagggaaucaagguguccugccccacagacacagaggccagcggccuguggugucgugagagcucacuggagaaacaugccucuggggggagcagaacucuucccuuccccggggucucccccguggccacacccaacuuucauucccagcucacugcugacagccugggugucccaggcagcuccugguuucuuggaaagccucacuauucucaucugugaaaugaaaaacccccugcucccuagaacuaaacacgacugugaucacgcacgccugcaucugugaugucauccccaugccccagaaugccaccccuggucuuucuacagguuccgauccuaguccgucuucccaggagucacggcgggcugcccgcuguggccacccucucccggcgguggaggguugaauugugucuucaugaaagguguguccaaguccuaaccucaguaccugugacccugaccuuggaaagagggucacuguaugggguccucauccaaugccugggguccacgugugaaaagacaggggaggagacacagacaggggagaacgugccgugaagacagaggcggagaucggagugaugccgccacgagccaaggaacaccuggagccccugggagcuggaagaggcaggaagaauccucccccagagccuucggagggagcgcagcccugccggcacugggauuucagacuucugggcuccaucacugugaaugacucuguguuguucuaagcuaccuaguuuguggucauuuguuauggcagccccagagcacucaugcccuggguacagagcugggagcagggaagggccuggccaaaggugugaacgccucuuccucagccccucugccaccagcaugaagaaacugcagaaaaguccccacuucacacagcaggugaccagacagacccggcaucagccugaccuggccgcuuccugccagcacagcugucuuccccacuccccaugugcugggggugcauccaaaccgaccccugcccuuuuucccaugaaaagccaagggguugaagaugaagccucauguaccuuuauuucccccacggcacaaaaaaacgguucuuacaccccucugggauccccgcugaacacacuguccuggcguuaauccaaaaagaaaaccggugacuccucggagaaugguccaugacucggcagaugccagucugccccgugggaaggggucuccaggcaacacagccacgcugugcugggaaccuggaugggccccgucacuggggucaccuucuccugccucccuggggcgggcuuugcagccccgacagcugccuguuccuccggcugcuccuggagaggggcccguucucaaaucuccuggaauuggccacugaaggccccccucugccucucgagccagcucggaagugugcacgucaccgaggcuucuggugacaccagcaguacagguggccuucaccauuaggucacagugagaaagcgaggccuucugcauucucuucccagccucccgauuacaucaagggacaagaguaugggucuuuaugguggcucugccccugcucaucucucuauuuaagggaggcaggguggcccugggggcaaagcucacagcaaacaaugugaguccauguggccagggcacacaaaagcuaacauguagucagugguucguguucauggugcguguuuucauaguuaccugcaguuuaucacaggugacguugauuuuuuaaccgcagcaaugauuaacacgucuucuagguauaaagguacuucaaaaagaagugaguugauuuauuaaagaucuaggucuuaaauaacaguauaggugacacuggauugccaagguggucugcgcacacugaaagcuguucuaaacaugccagaagcugcucaaaauguggggcccacaggagaaggcuccuguguucccuucuccugugggcagggaccaggccuugguuuucaccagguccccuuccagggaucccauguggaacagcagcgggggccugcaggauuaucgggagcggccugcgaggcgcgaugggcucgggcucaggcgaggcacgcagcgccccuaagccuggcucuauccugaaagggcaccuaagcgugaacagagccggugccugcaaaaccuccaggaagagcugggugcgagugggcguuugauacacgcugcuggcugucaauaccgugugauccacacuggauguugagcgagaaacagaagaaugaagaacacagaaaaguaaagagcccucuaaacagcccaaucaagcaucauggaauaccacgugccaggucucauucaugccucgcugguacuucccggguccuccugccgcguccguccgcucccgguuugcucacuuuucuaacaaucuuacucaucugguuuccuagacagcagugggcgggaaugagcauugacagccccuccaacaaggagaagaggaggagucuggggccauugaguacagggagaaacagcccacagagugcaacaucccccaggcgccagggggucccggcuacgaggugagcugcuuccaaucccaguccugucauguagcggugggugacucugggcagguuuccucaccucuccgagccccaguguccccaccuguaaaauggggacaauaauagaacuuauggcauaggguuguuucaaggguuaaaggagauaagucauuccaaaagccuccauaaaauacauguuaaucauuaucaaaauuagcuguuauaaugacacaagucagcaggaagaggguuccaguguuucucauguagaccucaagguugcauguaaugcauuuugggauaugcacggaacagggcaaauguguuuaaagaucugagccuccaugggaauaagcugcucuugugugggaaagcccccucuagccugaagauguggcugccugaggucacaaauuccuggggcuauuccugcucuggcaagcugcgggggcugaugacgccagcaccgucgcuagggcugaggcccaggaauaaugaauggccacagccaggaacaggcgcccaccagagacaaacagcauguuccuugcacauucaaagcagacacaguuuaaaaauaaugaacagggcgggaggacaguuauuccugaggucauucguuaaaccucaauuucaaaacugaccacaggcucaagcugccgggaagcacagccccaaguuggcacgacucccgaguggcccaccaggcccggcugcgggugacggguggguguccacuauggcugcucaggagaagccuuuuguuuucauuuucuuuuuugcuacauuugaaguucuucucagagcccuggauagcagaggcuccauaugaaugcagcccagauaagguggcugcagcugggagccccgggguuaccggcuccccaacagcgccgucagccccgcacacacagcagggagccccagggcaggcccgcagcccccaaggaaggucugugcccgggaaacacauggcauucaaaccgccgcugguguguggccccuuauccacucucccugggaggaaaggccccgugugguguccagagagcugcuguaggagguguuugcuagacugggccagagggcaaaggugaaggggcggcugacacacuccagcccacagauccuggcccaggaugcugggaccuggagagcacggcccugcgugcagcaccugccaguagguagcaggaugugucguagagggcuugcugaccccaaacaugccgagucacccacauccuggccuccccgcccacuuugccggugggacagaguggcugacggcguguggcacaggcggggugagcccggaagggugagcaugcgccugcugacgcuucguucaccaagcggggggccucuacagcucgcccagguuccagcugagccaggccucuugggaaggcguaaaacagucaagauucaagcaggugaaaucugagaacacugcacacacucaugggugcggaaggcucugaucacaucaaaaucuuacuccgggcaaaugcugggcccucacaggggauaaaaacagaacccacugacgagacgccuggcagugcgggggccccaggguuagucugacugcuccacuacccaugguuaugggcuaaauguguccccucaauccauguguugaugucucagccccuaggaccugagaaagcggcuguacuuggagauggggucuuuaaagagcccccuauauaccuaauguaaaugacgaguuaaugggugcggcacaccaacauggcacauguauacauauguaacaaaccugcacguugugcacauguacccuagaacuuaaaguauaauaauaauaauaauaauaaaaagagcccauuaaauuaaaacaggucauuagggugggcccuaguccaaucucacugguguccuuauaaaaagaggagaugaggacacaggcacacagagggaugacccugcaaggacacagggagaaagaaggugguuaucugcaugacaaggagcgaggccucaggagaaaccagcccugaaaggccucgaucuuggacuccagccuccagaacugagagagaaucaacgucugggcugcuuagugguggaaaccccagcaagcucacacaccggcccaggagggccuuccuaggacaguugggcuacagcaccagcuuccuugggaaaaagggauuucucccuugacacaucuggaggugcuacagggacccucuccaggaauaauguccggcacagccuggcagacuucggcucaaaucugccugggccacuucccagcuggugaccuggggugaucccaagcaccgaggggggaugggugccccagcucugccacucaccccagcucugccacucacccuagcucugccacucacuccccccagcuuugccacuccccccagcucugccacucaccccaggucugccacucacucaccccagcucugccacucacucaccccagcucugccacucaccccagcucugccacucacuccccccagcuuugccacucaccccaggucugccacucacucaccccagcucugccacucacucaccccagcucugccacucaccccagcuuugccacucaugucugaaguggccggauggccagggcagcagccacuacgccgacaguucacuuccauuuaacccagcuuuguggagaugccgcgggucuggggcuuggcugguauucccaagccccgucuccccgucuuuggcaaggccacacacgugugguuucagcaagggguugcugugcuggaaccggcugugagcagaccugcagaaccucagccggaccccacccuucccaggcccucagucucaggcucaagccuguguuucugguuuuaauuaacaaaauguguuggucacugagaggcccuggcaaacaucuauguaugguguguccccugggggccaggauuccucccacagcccuaugcugaggcagaguaaggguggggguagggaugauucccucugggacaagggggaagggaagggaagucagcacugagcacaggagggaccaggccccaucucgcugggcugcugaccccaccccaggucagucccccgggagagugcccucggccgugcccaaggaaaccggaacgcuugcuccagggauggaauggaacuaccagaauguccuuccgaaggauggaaauccgugugauuuauguacauaaagcaaggaaaauguacaaggaauacagaaccacacagacaagaagagguugcagagggcggucaacuacuguuuuugcgacuucucugcgacucuaacacgaucagaaagaaggaugugagcggaagucaguggucacgugacaucugucugcauguguuuauggauccauccauauauaguaaagcccaaagcccgccugggagugugagccuggaaacccaggauggcggcucuggggaaagaaucgagcucuggggcccucccuacacgcaacuuguagcugcugaaagacgccuaaagcaaauacaagccaggugccaggaccuugacgacgcugggguugguucuguuauucugcaugguucccguguuuagaucuuucacaaucauucauuaugcauaagcguuuucauuaacgauauaggcgugauaggaggcggccccucccugcucugagagcccaugccacuuccacacaggccgagggccggcacccacggugagcuggcucaugcucccaccacgucccgaggcaccuccaggagacuggcccugcaauggcccauuucacagacgaggaaacuaaggccuggggcuuuaagacuugcccauggccccacacaggguggggauucccaccugcuuugccaaccgcuaagcccaugcuccaagcacugcaccccguccacaaggucagacgggccacuccucggggcccccaagggcagcaagcucccaguucgcacaggucagaacgugaaggaugccuuugcagggcggugcuuacggcccagggcaccuggcuucacgcacuaaugaucagagagccgcgugccuccgugcaaaacacccaggccaaacacaugggagcagacucacggcccacgagggaggaaagcaagcggugcuucccgagcacgugggaaaaagugggccuugcggggcccagaucuaagggagucagggccggcagcagagagacccugacccguaaaaggaugggaaggggcagauaaggaaggagccuggacuuacgagaggucacccugaugagacaggguuccaggagaaggugacguccccaggagacccggggaggccaagagggggccugggcaccaagcuagcuagccuagaugucuggugucccacugguacugaggcagcaccccgauggaggcaggcuuugcaggccugggaagggccugugccaagacagagaggggcaggagagccccagccagcuugacugggguggcuccacaggccagcccugugcucagcaggugggcgccacaaggccacuuccugccacccacaucacuuuagagugugagcacccagcagcccauggagcagagaugaaggcggccccgcccucggccggcuggggacugaguaacucguucuccucugcucacaacaaucagaugagcgagaaacuggcccagccugcugggcuugcagcagccggaagguucuucuggccguuggugggcaccugccagcagggagggucugggcaggaaagagccacauagcugcacuuggugcagggacgaggguggggauuccugacauccucgaccacggcagccguguguguucagcagcacacuggggccaagcacccuugggugccagucaccaacagagagcaccucugucccccucucucugugagccuucgugggagccuggcugccgggcuggggagaaugacccacucuggcacuguaaugggacaaacaaccaggcccugucccgaagcggccucagccucagguuuccagacggggcccacauccugacguuucuagguguucuucaugcuccaaacucucccagccuccuguggccaagcggccugccccggccugcccuuuggggacagcugugccguuccgaggcagaaucuaggucucggagcgagagaaaucugugcucuucugcaggagcugggcccaaaguggaaacccagcaugggcgcuggagugggcgaggguucccuucaaagcuggcugcucuuuuccucugccccaaggagaucagagggugccacgugggagcacgcgcuccuacaaagcacaaacggcucuuggugcccacacuggcaccugcuuuuccgaccugcagagagcucuuccuguccuggccccaggaugugcaagacagcaggguggagauuugugggaaaguggggcguccucggcagcaucaggccaguccaccgccccaggaccagccauggggacaccccacgugcagaagcuagacucacggagcaucagugacacaugagaccucuucugggcugcacacuggugcauggucagugacacaugaggccucuucugggcugcacacaguggugcaggagagagggagggaggaaggacgagaaagauuuccaaucacucagucucaaaccuuugaaaacuaguggaugcuucuuucugcauaaaaccuggggugcauccucaagauauaaaacagcucaaggagcaggagcagauggacagaagcccuuggagaagccagggccucgggagugaagagggagcucuggauguccaaguucccuucucgguuccugccgggguguugcccgugugcaggagccuuagccccgcagguguggggguugcgggcaaaugucagggaugggggugccuuaaagauggagaaacugaagcccagcgaggagcagcaccacgacccugccauucuuggggccccauuuccuccgucucagaggggagccugucagaugcugugagcccucgggccagccacccucugaacacaagggacagcagguugagggcacaggcgagagugugcacgcacccugaggccacagagaaugaaacaugagggucgguuucugcccaggagacagguauguucuugaggcgggcgcggggaagagguagaacucucaggugucccuggggcugggggaucucacuaccucuguagcucgucuuugagcauuaaugcuaagucccagcaccccguccacagcaccccagccucaggguaacgaggccugguaccuaacccacaaagugcucgcugguagggagugugcaggccagacacuaaggcauuccaguucucccuggcccugugccaggccacuaacuggauccgcugcacucagggacaccauguacuauggucccugcucuacaggugaggacagcagccucaaagagcccaggccaacugcuucccauggacucgcugccccuucacaggucaggaguccccugagacagcucagggcagccugggaccaaugccaaguucaggagcagaggagagggcuagagagguggagggucugccggcagagacagggugcaccuggggagggccagggccacggcugggugggguggcccaggacuaucugagucagggagaugguggcuggaggguggaaaccuuugacuggcagcccauaggggugggguagggggucaugccagucacccacacaauggcugaugcucacccagcgcuuguguacaaagaccaucuagggccagccaugagccucacuuuacagacgggguaaccaagguuuaggaggcaaauaaacucugcugacccuggcaccuggggugaagaauuccggcugcgucuuccucggcuaggccuucugaucagauccgaggcggugccugccaccaucaccaccaucaaucucuuaggcccagcccccucccugcccuggccccaccagcccuccagaacagggucacaugccccacccuggugccugcuggcucuggcuugaauuuugcuaaauuugggugacuuccuaaggcagcaggggguggggugggggugagguucauccuguaaggagggcaucuagcguuccugccccacgggccagcgucggggcuccucucccucuggccaauguggggagccucccuaaagugcuccccucccgcccaggaccaggagcugccccaaagcagcacaguccagcaagcaggacgccuggacccuuuaaacaacccgacugcugcgccguauucaccgcaauaggcgggcaggagcgggacgcacugcuuccagagucccggcccuuuaagcgacccacacuccccgcgucgcauucacccuaauaggcgggcauacaaaugccguugccuggagccgcagcccagcgaaugggacccacagcggcgcgcccuuuaguugacucugucuuauucgccgcaauagcugaucaggagaaaucccgcuggcugccaggaaaggggcgcggagaugcggaugcuccgccccaacaccacgccuuccucugcugaccauccccaaaguccccuuuaaaugacaacccuccccccccccaccccgcccccacaccgagcgccguauucaccccaauagcacaucaaucccuccgcaacgccgggauacugagcucucccuccccuggccgaggaaggcccuuccccgcgaggaagcagcugagaaugggccagcgagagaagggacaaaggcacgggcgacagagcucccucugugcugucccccagcgucuggaggcccguucccgccuugcucagaagcacagggcacuuaccaaggggccauccgugaccagcagucaggggcaugcugucuccaagcugggguggugcuucugcucugccagguacggcagcgcuuacugaagguuugccaucuccccuggccuuggaugaagggaaggcgaccccaggcuggucacaacaggcagccugaccagcugccugccgaggugggguaucccucaaaucuccucccuguuuuccacuuaaaaucccuaagaauguacauauuuagaaggaauacuguucaguuguugagccucaacuuuccccuucauccuugucuucgugucagcagggugagaggggaucuauggaccaguuaaguccaucugcauucaccaaacacacuauuaggcaucccgaggaggugagacacccuaagggcuccauuccuaaaucagagaugaugggacucugggaagagucacgcccucuuguccuucccauccuagagcauggaggaaaugagcuggucacgucccacaccagccgaugcuggugaaaccaggacauggugggugggacuugcuagaugggggcagccagucucaaucuacugaccucccugggaugagacaguaugacggcuuuccacaugugccucacuuaaccguagaacaccuacugugugccagccccugggaagagagcccggagcagacuugcaggcaaccgugcauggggacagacaccgcgcaccagcggcacccaccagggacagaugccacgcaccagcggcgcccaccaugaaccuggcuuggcccaaucgcuuucuccauaggaagccauucaauuaaacaaacaugaccauuucaguauaaauaaagagaaaacaaaacacagagcugagagcugcuuuggaauggguaacgggccaggaacagagacucucucagagaggcagcaucugagcugggaccugaauuagauggagcccaccaaaugcagauccaaggaggggccgaaagcagaggcacaggcagugcaaaggcccuggaguaagaagccggggcugacgccagaccccugugagcaaggaggggagagggaggggaggggagggggagaggagaacaagggaagggagacagaguggaggggcaucuagggccuguggggucuggaaaggggucaggacuuacugagacccauggcaaaucucaaagggcucuaaguggucaaauuacaugaagugguuuaucuuuuuaaacaccaugcuggcugcuggcuggagaagggcuaggaaggccacgaaaggggagccuacuagguagcugauguggagcuccaggcaagagcugguagggccaggaggggaguggaggccagcccuggagggaguagccggaugugaggugggcugggaggccgagcaaagcauuugcucucagccuggguggcucugagauuugcaacaaaggcccucuaggaauucuggaucccucuaagccagccaagaaggcucaugucccacccccuccccaucucccaccucaagcccugguccugaggacacagcuggugcccacuccgcuuaguguagaugccagcacaaggcaaucucacauccucguggacaugaucccagaggcccuggcucagaacaacugugaugcuaagagaacaacgcgguccuuaguccaaguccuuuguacucgaccgccaacccuaccacucuccggagcagcuucacuaucugcccauacaucuccacgggaaagguuacccagccguggccaagacccagccaccaaggccccaaaaccuuuaaaaaucuugaccagcccaggagccccauccucaggcugucaguugccuccucaagcugcaggcucgguaagucaucaagcaaagcuggcaucgagaacaauauucuuuuccuuugugccggucacaagcagcaugaggacauccagggcagcaugccugucccugucgggaggccaguggcccucacuuguaccccccaacaucuaccccccagcacacuggugcacucccugggcuccccugccaacccugcaaguggugggcacuucuacccaccuggcccuuggacuccacaaggggagcugcaccuaacggcucccuccccgacagcucccuuccugucaaaaugaccgggauccuuuuggcacugugcaacccugggccucggccccucuacaacccccugucccggaggucagagcuuccagcuccccaggccucuccgggagaacccugagcuggguccacaacauuucucagcugcggucacaggcucagauucaccugucccuugaacaauaaaugggaaugggggcggggggcaccuucugucaucuuggguaaguuuuccaccugcacacugugccuguaugugugcaaacgugugcaggcuuaaccacagaaucagcagagagcaccaguccccaaaacacagcuggcagagacacacacagcccuuccacccgccggcuugucacagaguguuucucccucccccaagcguuacaugucagauuacuaucagcgcucagagugaggccaggaucucaggagagaaacugauaccaggcauucucagcauaguaaauacaauccuggguagggguuggguggggggggcggucuugcguugguauucuguaaagagcugaaagcaguccuuugaagaacauggccuauucauggcccaaucuggacccagaaaggagccuccacuggacaugcaggauggcugcccgggguucgacaucugcagggcagccucucugagaccaggcccaggacugcaggucagaggcuccucauccggccuaucugcugugucaccuuucuuaaacacagccuggcaagacagacacacgcggugccugccuccuggcaccccaggccagccccacacgcgugcaggcagacaauaggaucugcaguucuggagccugagaccagaagggagcagcugggcacaugaugccaccccagguugccacaaaccugcccgaugccugcaaagcccccacucaccuggcagguucaaggaacagcaaggcccuguguaccaaggaggugggauaaaaacgugcagaggggccuuacuccugggguuggggagcagaguuucuguucagucugggaucuggaucagcccuggugcaggcagacccaagagcaucuaucuaggaucccaaaggcuggcccacuucuccaggcuuugggaggcuguaucagguggggugggacccuuacagaagucuuccuguaaaaggcaccuugaagagacuggggcagacacacagaggggagcaaguugcgaaacggcaagagaggaaauccacccagccgcuucggcggggcagacccgcucagcccaaggaugagggaggggcugggcucagcccagggacgagggaggggcagguaagcccacccugugaccccuccauacccccaggagucaccccaaacccuaacuccaguuggcuucugacaggaggcagcccagcggucuggguggggguugggggcggugccugggaagcccaggacgggccuguugcccggggggcugcagacuccagccuccuuccugccugccccacccuccugcaccccgcuccccgggaggaaucuucaagugcacaagacccucuugaggacucaggcaccucaacaaucccuaaggcuccacaucuucagggggucagugccccagagaugggggcugugggcaagguccuucccuagccuguaauccaggcagcccccugacucugcggacucagacacagcaguccucccaagcccgcagcugggacgccagacucagaucccagacccccugcagacccaucaagaccuggcuccuuggagcccgcgucggccgagcuggggggacagacccccugauuggccaggguuugugguggucagacccagccaccuucccuggcggucccggcuccuuuaagccccaccaaguggggagccgagcugggcgcgccgcuucccacucgcgggccccacccgccccaacccgccaggcgccgacccguccuggcccggggcgcccccaggcucccgcgcuccccagcuccccagcgcgcgaccggccccgcggcgugguuccccgcacuggcuacugccaggguccgcggggcugcggcgcgagcuccuggaucccuucggccggccccccgcggcccucgguucgcuccggcccugcccggcggggcccuccggauccuucccagcccgccauccccccgccgcccugccgccccccgggccgccgcgcuccuaccuccuaccgugccgcgagcucggugcuccgggccggccgggcgcgcgggggcuccacuggcggcgcgggccuggcugcaggaaaugccagcagaugguccccccgcgcgaggcggagcgagggcgcggcggagggag

SEQ ID NO: 192880 - RNA, 8948 nt, Homo sapiens
gugggaauugucgccuaagugguuccggguugguggaugaccuugagcccucaggaacgagauggcgguucucuggaggcugagugccguuugcggugcccuaggaggccgaggugaggggucuucccacccugaggugcuuagcguagccuccagccagggaaggggauggaagugaggacucaucugccgggugggagaucucuugaggagaagaaaauaccgaaaucacagcaaugaccacuguagucuagggguccagauguuuacccgaagguauauuucacuugcugugagcugacgaguugagggaauaaucagaaagagagcucccucuggaagucgcaguccugaugaggcuaauccacauagcaguucuguuuucuccccguucacugucccuagaaugcuccccacucgcucccacccugagucgggaaagaggguuaggagcuugcccauuucuucuggaguugguguguuuggaugugggaguggaggggggaucaguucgaaaaucauuuaaccugggcauuuguguuaccucagguacuguaguaaugcuaggauacaaaugugaagaaaacguaguucccgcccucaacgagcuuucauucugaugaggaaaacacugucauaguaguccgggcaagaugagguccugaacuaggaaaguagcacaaagaaaagaagauugucucaagaacuguuaaagagauacgccaauaggauuuggcgauugaauuuaggggaaaagucucucaugauuuccagauuacugaguuagguuaaagaaugccugaggugucauuaaauaaaguagggaacaugcagauguucccuggucuuaacuucacaguaaccccagugaaauagaugcuaucuucauuuuacaaauaagauguuauccccuauuuauuguuaaguagcuuaccuauggucauuuagaaaguuugucaguccuguuaaaggagagguucuuaugaucauccuaaugacucuuuccucagcucuguugcuucgaacuccaguggucagaccugcucauaucucagcauuucuucaggaccgaccuaucccagaaugguguggagugcagcacauacacuugucaccgagccaccauuguauguucucuccaucgcugcugcuuucugggcucuagccaucuuuaccuucacuaauggucaugccuuuagcaggacuuccuaccuguaggggggacucuuguguccaacuuugucaaaugaagaccuaguuuacaccuuugggcagacagugccauuaugguugaaugaugccauuuauaaucauagaagaccuucuagccuaagucuuuacaaauuuuuuucuuuuguuuucuuuuuuuuugagacagagucucgcucuguuaugcaggcuggagugcaguggugcgaucucggcucacugcaaccuccaccuucugaguucaagcaauucuccugccccugccucccgacuagcugggauuacaggcgcccaccaccaugcccagcuaaguuuuguacuuuuaguagagacggguuucaccguguuggccgggcuggucucaaacuccugaccuccucaaacuccugaccucaggugaucugcccaccucagccucccaaagugcugggauugcaggcgugagccaccacgccuggaccacuaacuuacauucauaaggugucuguucacuucacugaaccaagacuggcuuaauucuguagcaauacagcaauucuguuuuuuauccaucuucuuggaucugucuucuaaucaauauguaggcauugagauacccuugugcuaaaagacuucaaaaaacagagauaaagccuucaaaaaacagagauagcuucucucaacuacuauuuugauauuuuacuuccuuuguacucagaguuauauccuauauguacacugccugucaguuuggguuacuguguggcauauguugaacaugaaagauguguguuucucacaucaacuuuuaugaaucugguccuuuuuguagcuggcuccaaggcugcaucucuccacuggacuagcgagaggguugucaguguuuugcuccugggucugcuuccggcugcuuauuugaauccuugcucugcgauggacuauucccuggcugcagcccucacucuucauggucacuggcaaguauagcaauuccaaauauaguugucugcucaguuuguuugcugugagcuugucuuauguauuauauaugagggagaaguugauugaaaugcccuaaauuuguugaaaacuuuaaaauauauauaaaauauguauaugccuagauuuauauaucugccugccuauucaaugucuuucaauucgauuuccguaucuaauagcauuuugaauguagccugucaaacugaauuucugaucuccccuaaucuguuccuccugcacucuugccccaucugaauuaauggcauuuccaguuuucucuuuguucaagucuaaaccugguaagcuccaaacuuggucauuauccuugacucuaguaguagucuccuaacugguucccauuuguguucauucccaacacagcauacccagugauccuguuaaaauguuaauuagaauaagacauuccccuucucaaaacccuauuuugucucuucauguuacucaaagucagaauucuuaggguugucuguagacucuacaugauugaaccacccuguuucuucccucauuuuuagcugcucucucucucauucacacugccuuccuugagauuccuugaacaugccagggacauuccaggucucagggcuucucuuacugcuucugccugaaacucuuuuucuagcuauacacuuggcuuguuccuucaucuccuucaggucuugaaugccauucucucaacaaagccuucccuaaccacuuauucaaaauugcaguuucuguccugccauuccuuaucucucuugcuuguuuuauuuuucucaauaguacuuacugccuucuaauauacuacaucaucuguucauuauuuuauauaguaauugcuuccuugcauuuuaucacccaaauguauaucccuaaauaguauaguuuauucuugccucuuaaaaaaaaaaaagagauguauguggguggauuauuuuguuauuuuuacuguauuuguuugcuguugugccucuagagccuagaacuacucucugguacgugacauauagcacucaguaaauacuugcugaaugaaugagcauccagcgccuguuuguuuguuuguuuguuuguuuauuuuuugagacagagucucgcucuguugcccaggcuggagugcaauggugugaucucagcucaccacaaccuccgccucccagguacaagcgauucucccugccucagccucccaaguagcugggauuacaggcgugcaccaccacauccggcuaauuuuuuuguauuuuuaguagagacgggguuucgccauuuuggccaggcuggucuggaacuccugaccucaggugaucugcccgcuucagccuccuaaagugcugggauuacaggcgugagccaccauguccggcccagcuuuuguuuauuuuaucugguauaguuuguaugacuuucuacguaaugaaccuucuaaaaugaggguaaaugacagguuggguuccuugaguuguucuuuuuaaguuuugcaagggacaauauguugucauugugggggguagggagccacuuucggauuguugaaacuggaaguacuuuggagaguaucuuaaccaacucuuuuauuuuacagauuuggaaacuaagacccagggagguuaagugacuugucagaaucauuuucuagcuaguguuaaagauuuuuuuuuucuuuuuuuuuugggacggagucucacucucacccaggcuggagugcaguggugugaucuugguucacugcaaccucugccuccuggguucaagcaauucucaugccucagccucccaagcagcugggauuacaggcaugcgccagcacaccuggcucaguuuuguauuuuaaaucgagacgggguuucaccauguuguccaggcuggucuuggacuccugaccucaagugauccucccaccuuggccucccaaagugcugggauuauaggugugaaccaccgugcccagccuaaagggguuuuaauuaucugguuuuguaggacugguuaggagaaugaguuguuguuguugauguuguuuuuuaaccacacagaccuuuccaaauaaaagauuccaguugcauaugaaauauuagaucacaaguacaguaaguaauauuucucuaacaugucaucccucuugaaggagcugucuauaaugugcuccacuuccucaacacugagucucuuuuagccuguauuaauuggggucuuaucccaacuauauaacuuagguuauucuuaccaagggcacugaaggccuucaucuuuccaaauccgguugucuauuuucugcccuccacuugcuugaagucucagccgccuucaacucaauuaacaauucuccccauaagucacuuuucuuuggcuuuccagaugcauagaagucuccucugccagauccuucuccucuugucugaccucgagaugacaaaaucuccagggcugagucauggccuucuuaauuucuccaucuguacccuuuuuuaggugagcucagaucugaccuguuuuucugagcugcagacuuguuuaucuaauugucuaauugacauccacuuggaugucugauaguuaucccagaucuaacauuggccaaaucgcucuuuuuuccccccaaaucucccuugauuucuccuuuaaaacccccuucucaaagcuaugcucaaacuaaaauucuuaggagucauucuagauauuucuuuuuguucuuaccccacuuauuccaucaguucuguucuuucuuuaaaaaauagucugaaucggccaggcguggucucacgccuguaauccuagcacuuugggaggccgaggcgggcggaucaugaggucaggaguuugagaccagccuggccaauauggugaaaccuugucucuacuaauaauacaaaaauuaagcugggcgugguggcacacgccuuuagucccagcuacuugggagacugaggcagaagaaccgcuggaacccaggagguggagguuguagugagccaagaucgugccacugcacuccagccugggugacagagugagacucugucucaaaaaaacaaaacucugaaucggucgaggggaaggggagggagagcacuaggauaaauaccuaaugcacgcggagcuuaaacccuagaugacggguugauaggugcagcaaaccaccauggcacauguauaccuguguaacaaaccugcacguucagcacauguaucccagaacuuaaaguaaaagaagaaaaaaaaaaaggaaaauggacauuauuagaaaaaaaaauagucugaauugucacuuugcacccugucaccagccuagguuaagacaacagucucacguaggcuacuucgguugccuucuaacuaguuuccucuucaguuguugcucugucccccacccacucuguucauucaucacacuacagccauagugaccuuuuuaaaacguaaaauuauauuccuccaaaguagauauacaaauggccaauaagcacaucagaaauugcucagcaucauuugucauuagagaaaugcaaaucaacaccacaaugagaugccaccucacaccccauuaggauggcuguaauaaaagaugggcaguuuuaaguguugcugaggacuuggagaaauuggaacccucgugguucugcugggaauauaaaacguuucaaucacuuuggaaaacauucuggcaguuacaacaaaaaguuaaccuuagaguuaccaucugacucggcgaucuacuuuuagguguauacccaagagaacugaaaacguguccacgcaaaaaacuuguacaggaaugaucauagcagcauuauuuauaauagccaaagaguggaaacaauccaaauggcugucaguggaugaauagcuaaacaaaauaugguguauucauacaauagaauauuauucagccauacaaaggaaugauguauugauaaaugcuaugacauggaugaacauugaaaacauuaugcuaaguugacacaaaggccauauauuguauggcuuuuuuuuuuuuuuuuuuuuuuuugagacagaguuuugcucuugucgcucaggcuggagugcaauggugcgaucuuggcucggcacgaucucggcucagcacgaucucagcuuacugcaaccuccgccuuucggguucaagcgauucuccugccucagccucccaaguagcuggcauuacaggcaugugccaccacgccuggcuaauuuuguauuuuuuguagagaugggguuucuccuuguuggucaggcuggucuugaacucccaacaucaggugauccgcccacuucacccacccaaagugcugggauuacaggugugagccaccacgcccagugguguauggguucuuuuauaugaaaugucuagaacaggcaaagccauagagacagaaaguaaauuuguaguuggguagugggcuaagagguagaggguuucuuuuugggguaaugagaauguucuggaauuaaaugaugauugcacaacucaauauacuaaaaaccaguggauuauauacuaaaaagcgugaauuuuuucuggcguuugacuuacauugcaauaaaacuguuauaaaaauaguaaaauuaggucacuccuaaucucaggcacucccugcuuaaaauguaucagugguuuccuauuauauuucauauaaaauucagauuccuuaucaugaccuucaagacccuaugcaaccgaccccugccuuccucugaucucugcuucacccaugugcuccagccacacaaaucuuacuauucauuagagaugccacuuugguuuggauguucucauucaugucuuccuuucuaaaguguuucuucucaguacauauauauuuacuuuuuccuucucauucacuaguauauuccauaaggguagggaugcugucucacuuacuauacucccaacauuuaugacagauucuggcacaugauaucuacuuaauaaauucuuuuugaauuaauuaaaaauacuguagaguuuuaguuauuuuuaguuauuggggugaaaggaucacuugcagccaagaguucaagaccagccugggcaucauggugagaccgcaucuuuaaagaaauaaaaaacaggccaggcgcaguagcucacgccuguagucccaacacuuugggaggcugaggugggcggaucacaaggucaggaguucgagaccagccuggccaauauggugaaacccugucucuacuaaaaauacaaaaauuagcugggugugguggugggcgccuguagucccagcuacuugggaggcuggggcaggagaaucacuugaacccgggaggcggagguuguagugagccgagaucgugccacugcacuccagccugggcaaaagagcgagacucugucucaauaaauaaauaaauaaauaaauaaauagaaggaaauaaaaaacaauuagccgggcauggaggcaugcuccuauagucccagcuacuugggaggcugaggcaggaggaucacuugagcucaggaguucgaggcuguagugagcuaugaucaggccacugcacuccagcgugggcaacagaguaagacuuugucucuaaagaaaagucacuagaaauagacuuacugacauacacacgcaaaaggcuauacagaauccccuaaagaagcaaacagugacaguggaguggcaaauggagacauugcauuugaacuugacagauuguuuuuuugcagccaaguuaucuguauagucuucuaauuucacugugguuuuuuauugauguuaugauuuuuucuuuuucuuuaggggccuuggacaaguuguuacugacuauguucauggggaugccuugcagaaagcugccaaggcagggcuuuuggcacuuucagcuuuaaccuuugcugggcuuugcuauuucaacuaucacgaugugggcaucugcaaagcuguugccaugcuguggaagcucugaccuuuuugacuucauacuuugaagaauugauguaugccucuuugccucugcuuugucaugccauuaagcucacaauaaggaagaaauaacagauaaguccauugguggacagccuucuucucuuaaucacaagauuauuuucagaauuuaaucuuugaggaaaagguuugagaggaauuauaucuaaguugugagacugaguucuauauucuggugaguuaaugggguugccucccagcuucuuauaagacucacaguauaacuaaacaugauauaucagcuuuugccuuucaauuuaucaaucucuuaaagagaauccaacuuuauuacgauuaguauaugaucaaacuuccauauuugccuugggaauaauggacaaagggaaauacucuuaauucaugaauaaaaacuuugcagaaaauuagacaguguuuaauuuucgaaaacuucccucucuagacaguagauaccaccuacugaugguuacauauacuagggaaauuuuaaaauuaggaaaugcugauagcucauauuauaaauuucuaaauccuaggaagaaacgcuuggagugcuucugaauauacagaaguuccauuuaagggcaaguuucccuguagauguaucaaaauacuaccaacuguaaauugagauuuaauucccaaauguauucuacuuguucuaaaacaaucuguccacaaauauaaaacuauaaguaauaaauuguuauuuucgcacaaugggaaucucuaaugugaaaauguauucuaugaaaauaauuuuuuuaaauaaaauguuauauaauaaaagugucuucuaugcuuuua

SEQ ID NO: 192881 - RNA, 107021 nt, Homo sapiens
ggcacauguggcuggaaaugcaagaagagggaaacguguggcuuggaguuucaagaagagugacugucucagugccgagugccucagcagcuucuccacaugcucuucaguccccaaaguuggagaaucccaucaaggagaguagcccuguaaggaauucgaauuuccagcauguaagucucugauuuuauaccuacucagauuguaguaguggaaaacagcaacauguaccuugacucucuggccccauguuacugaacauuugcuuaaagguuaacucacuugagggagcuuguguggugcuuucucuucugcugcaggcuggcagggguuuuuguucagugggggcugugcacuugguggcucuccaugcacacacagucacuccagugacacauguuugauaggugcugggaaugauuucaugacuggcucaguagcaaaugcgggccagaugugauucuauuuuuuccaugcaccaccagggaugguguuggguauuuuauucccccagccucuguuucuucuguaaaugaggauuuucuuaguaucuaccuugugaggauuaaaucccaugauuuuauggaggugauuaguaaaugugaacucugcccuucccuuuauaacaucugaggcuccgucagggcucucuccuuuugguguauguuauaguuuacuuagaggucaauuuggugucuaccuaugcagugugauuugaggagaauuagaagaucuuucccaccaacuugccaugcugaguacaauucccaucugaaaacauaugcggauaggaauuucuauugggagaauuguucgguuaucgacuucaaggagucgaaguucuccugguuuuaagucuguugucggaaguauauaagaaucaaagcuuaaucgauggaaaucauugcucuccaucaugcgugaguuaaaaccauuacuucugaguggucaguuuacauugggcucugucuagaagguuugccuucuucaccuccagucacauccccauuucacaagugagcaaacagccagaggaggggaggaggauggcauaagaucuugcagcuggcagagacgaaaugugaauguagcccguuugcacuuggugcugucgggcagccaagcaauccaguguguagguccagggcgacaagcgcugcucccauggcugggguaagucccuccagcauucagccuugcucccugugcuuaucuggaugcgguguaggaugaagaugacccuauagaacucuacccuggaaguccuggcaaaguggauaugugacauuuuugaaaccagggacauguuggugcugcuuaauauuuaaaucauaauuuucagacucuuaaaaauuacuaaauaaguuugaagagacacagccaucugccuacagugccaccccugagcuucacgccacccuggucuccaggaaaggggagagucucaggaauauugaaugcagguaagauguggaagaagagcggaguuuucacauuuuaacaaggucaauugaguaaucaacucaauaaauaaauaaauuauuauauaaaaugagggcugggugcuguggcucacgccuguaaucccagcauuuggggaggcuaaggcgggcagaucacuugugcucaggaguuugagaccagccugggcaacauggugagaccucauuuccaauaaaaauacaaaaauuagccaggugugguggcaugcaccuguagucccagcuacuuacgaggcugaggcaggauaaucacuugagcgugggaggcggagguugcggugagccgagaucgagucacugcacuucagccugggugacagagugagacucugucucaagaaauaauaauaauaauaaaauaaaauuaugaaaguuuuacucugccaagaauauguugcaguuuuaaagauacauagagccuuaaauauauaaagaaaaucuugguucaacuauggagagaaaucaacaaauccaccaucuuuaccaauuauaguaaacuggaugauagauuuagcaaacaaaacauuaguaaacauuuagaaaauuucaaagacaaaaguaaucaucuugcuuuauuggacauauauggaaucaaauaccuaaaaauuagaaaauacacuuucuuaagugucuuaaguggcauuaugcaaaugucaacaucuaucagagaacugcucucacaccaacauguucucugacugcaauucaauccaauuaauuaaauuagaauucaauuaaaaaauaagcaaauauugcuauguaugucuggacuuuuuuuuuuuuuuuuuugagauggagucucacccugccacccaggcuggagugcaguggcacagucucagcucgcugcaacuuccaccucucaaguucaagcaguucuccugccucagccuccugaguagcuggaauuacaagugccugccacugugcccagcucauuuuuguauuuuuaguagaggugggauuucaucaugcuggccaggguggucucgaacuccugaccucaggugaugugcccaccuuggccucccaaaggcugggauuacaggcaugagccacugggcccggcagucuggacauuuuuuuaauagcuacugaauaacucauguaucaaagaaaaacaaaauagagauuaaauacuauuuauacauaaaugauaauaaaauaucagcaccuccucauaccugugucccccugguguguagcccaagccgugugcagggugaagggcacacauccagggagcagugcagccccagcuccgcccuguaggagcccugugcucagucacccacugcagcccccaagcuccuggccaguccucccugaccagggcucuuucucaugggugcauugccaggggcaagaaagugggagucuguguuccucaggacagaggaguuucagcucaagaagugccuggcuguccagcuugacacuguccccucccacagaccuccaaugcucacggcuggggccugccucuccucuguggucauggcugaacucacaguguuuggggggaugagccaccuugcugcuggcuucuggcucccccuggauggugacgcuugggcagcucccaucuugcccucugugcagauggggccuaaucuccuuacugccuccauuguccacauggcugcugccugcaggucccugcacggcugcuggagggagcugcuuaugcacaggcugagaccaggauccccucacuuguaccaccugccagguccccgcccugcagccccugcacucauggcauguucugcugccuggaaggccgcugccucugucccaguuccauggggaucucugcucuagagggguagcuucuuccuugaaaagaugcugcuuaaagucagaggauggauggcucuccuuggggcauuucuagcucuggacugugccacaagcccuggaugugguauguguauguguguguaugcaugcacuuagguaugugugugugugcaugugugugugguaugcaugcauauaugcaugugcuauuguacguguguaguguguauaaacaugcaugcauguaugcuuguguaugugugugcaugcauaagugugcauggugugugugcauguguguguggucggggcaggggcaccugcaggcugcucgucaucugaguggacccuguucuccacucuuccuccucugcaaagcccaggccccuuuccuagcuucacaugacucugcgugcaccuucaggagaaacggaguccugcuccuucuauugcacccaucaaccaggaguggggggaggggguggagguggggaagaugauccucccuguugcugccccauggugggaggagagacugagcccaaaccauguuuuagaugcugauaggcuuaaggguaacagcacaggaguuugagaugcaugcggcucaacaccuaaucuacaucucacuucacuuucucaucuggggaagugggcuugggacccugagccucccggguaucacaggguccuaauagucccucacagaaggagcagacccagagugagcacuccccaaaugccacgccgucccuuccucacccuuggaguggagccuggucguucucaaaguugcugggagagucccaggagcccuggccccaaaucugcauccuacacagugccugggaacacagggcccauuuuuuccuuggccucucgccagucccagcaggcccugaugcuccucuccauccugcuaggauggcucucucccccugggggcagagugggggcaggagguggugggaggguggagggaugcugcucaguaaauaaugcagagccggcagcucugauuggcuucggggaggcagacacucugucuacauaaauggcaaucacaucuucugugccucuuaacugucacuguggagaggagagagagaggacagagagcaagucacucccggcugccugugaguacugcucuuuguccucauggcucacgcguccagcucucuggauggccgugacccugggguuuggggugggagguuugccgguugauucuagcugugcugaauucuccuccugcaggaggaaggagguucggcugacagggacagcugagcauucagugugugcaggugacacaggguuuacaggaacuuuucaagaaaauaggcaccaaccuaggucggcuugcuuuuuugugcuaucugcaagcaacaggucaggcagagaaucugaaacuuuggauugcuuuuuaggccacauuccuagagccaugacagcaacauaacuaagugaguggaaauuauuuuccagacuggcucaugugcauguagagaccguggaggccacacgaugggugggaaagaaggaggcuaugcagccccacagacucagguuugcauucagaugcacaccucccuggccgccuuuccuuccucagacgugaaggagaggagcuaauuaacagcauccucccccagaucauaguaaaaaccagguuugauuuuauaaaggggcgggcacacaauaggugcucaauaaaugagagcucuauugugaauaagggaggaaagugugaggucacugaaaaugcugcugaguggucugcugcgcccuccacagccuguuuucuucaguuuccaagcgaaauucaggcaggugacauggguucuucccacaagcuuguuucucucuugaagacuccaagggcgaggcuccuugcgaaaauuucucauucagauaagcagaguuuccccuccaaaaggugacaaucacugcacaaaagcugguccucuguugguuugucaagggugccagagaaaaacacuccuuuugcugggggcaccggaguccugcuggcagcgugcggugaccccagacuagaacacaggcauccuggauggcugaccacagagcaaguuaaggggugucuggaugguucugaaggaaacaaaaucaagccauucucagcaguuucuuuucuuccugucuucugggcacacgcuaggugggcgucuacacacagccagugugaagaaaauaauuaaaauaaaucccccuuaacuccccuugccacaaauucaaagagauagccugggggaucuaauuacuuuuguuuucugcucuucaagauguugauuauucugaagguuuuacuuucagacacucaacuugagucagcaguuaaguuuagggaacggcucuaggaaaaccacacuaugcggguauuuuaaaagaaguguucugcggcugggcgcaguggcucacgccuguaaucccaacacuuugggaggcugaggcgaguggaucaccugaggucgggaguucaagaccagccuggccaacaugguggaaccguaucucuacuaaaaauacaaaaauuagacaggcgugguugugcgugccuauagucccaguuacucagggggcugaagcaggagaauugcuugaacccgggaggcggagguugcagugagcugagaucaugccauugcacugcagccugggcaacagagcgagacucugucuccaaaaaaaaaaaaaaaagaaauguucugauguuuuguguuuaucuggugcuuguuggcauuucuggaggaagacauucagggagcccagaggcaccucgugggcauaugggacagcgaugggcacaggaccucguagaaaagguuagaaucccacuguguugagagacagcagaggguccuggucuucugguuuguacagaggcaagugugaaagccauuucugagcugugcgggcugagaggagcuccgugccugcugcaugcuucccucagccucuucgcauugcuguaaaggggaucaggcugcuacuuugcagagcugaugugaaguuuaggaggauauagguaaagggcuuacacugcugcccuguauauggcaacuauucaacauuucuucugcuuuggaggagguagaggagaggcacuucucuuggggcauggagggcagcagaguuuguugagccucugccuguuucuguugggaucagcccagguggguggaggcagacgugugucugcgggcucagcacucccacccgaagccacauuccccuguucucucaugugcagugaaccaggcaggagcccuggaccacacucuggguugcaggcaccaccuuccccauccccagugagagcccuguuuagaguccuguggucucaucucuggccauggugaggacacaggcagcugacaguggagguguaaguggauucccaggccaaagguguguuaggaaaaugcuggcuucagaacaccagcacccacuccuucacuuacuggcuguguggcuguggucaaguuaaacagcaauaacucuacuggccuggcaguguugugagcguguucagugagauaauguauaccacgagcuuaucaggagcuugagcacugcugauuuguuugguuucuuggacaauaggauguggcaaccaaaguucaacagauucucaggauuuuuucuuggaggggggcaccucaagugcaggcuucuuagcaacaccaggccccaggccagcagcuguucaauaugaggaauagggaagcauucacugugaauguagaagucaauauuuaccaccaaauuggcucauaaggacuccccaaagaguguaccaaagcauacuaaauagauucacagugcagguguccuguguuuguaauagacgguaaaccaggacaugucaugggcacuggauauuaugacuaugaugaaaagaagcaaccaacuagaacauaauucgaauugucucaagccaauagcaaaggcagaugguuaugaucucuugugaacuauuaaugugacugcaagagaaagggggaaagaauugagaaaaaauaagggaaaaaauuuguaagggggggggugauuucugaaaaguuucuucugacauaacucuucaauaaaaugaaaacaaaggagaaaaguuaaaauuaccuaguaguuaucauauaaacuuucaaaauuagcaaccaugaaugaaaauaauaaaauuugaauguuuuaagguuuaaaguuaaaaugugaaugaaggagcaaagcuuacagagauggagugucuaugcucaaugccugauggugggugacauuucuguaucauuccaguuuuucaaaaagaaauugacaacacgcaaaaagaacuguacaacucacaugucucaauuccacuggggaauuaauaucuuugagagacagacccaauaggugcgaccuauauggugauggugggguggcaucuacucaugacggugcugcccauaacagcaaacagcuaacaggcaaaguggggauggauggugucauaggaacacggugaaauccccacucagcagcccuuaauaagugcaaauaggagcguuauguuaaggaaauucugcaccuuguaauuaggcauaaaggaaaaaugucaagugaaaaaaggauccccagucauacacacauccucauuccaacuauuugaauugucuacggucaggacuaaaauggaauaauaucaaucaguuucauguccuuggcauucuuuuuugucuuuggaaguugcucaaguuaugaauuuuuccagccagcauuaacuaaggucacagcaugguuacagagauaugaguggaaguagcaucuuuccaugggaggaaaacugaaaaccaagacaaacuucucuauggcuccuuuccacggauaauuguuggccaagaaucuacuuugacagagcauuguuuauuaaacagggaaugaauaagaaacagcugcacaaagcuccuuccuccuucaugucagcagaggagcaaggcuuuccccugaauuuugaucuuuguuuguuguagaaaauuucucccuuuucucuuaugcuaccucaggagaagaggcuucugccugucuuuuguagcaucaauaauaauaauugcuagacacagguuuacaguccaaagugcucucugccugcaugagcuugcggccccauuuuauaaguaaagaaacagacucagagacuccaagacgucagccagcagcugcaugccucuugccgcagagcuaugggcucaagcuguuuucucugaaugcaaauccaccauucuuucuauucuucaugaggaggaggaggaggaggacuguccuguggaauuguagugcugaaagcuuagcuccacuugauuguggcaguuccauuuuccaacgcagaccaaucucgccaaggaggccagcugggcggagugggacuuaggacccagugcaaagucccuuacaggaguuccuuucuggacagaaacucccuugagaugauggauuugauuccuccugaauuugcacagguguggagagugaaaugcuaugcuucgagcaucuacuuuguaauuaucuuguacucucuucaugguuuuguguggugccuaggaugauggccaugguacagauugcaaguggagcugcaauggaguggacguguguguuucucccaacauuccuauguugaaauccuugccugcaauguauuaggaaauaggaacuuugagagaugauuaggucaugaagucagagcccucaugaauggaaugaguaaccuuauaaaagagacccuagagagacccaucaccccuuucaccaugugaggacauagagagaaggcuaugucuaugagaaacaagccucaccagauaccaaaucugccggggccuuaaucuuggacuuccagccucagaacucuaagaaaucauugucuguuguuuauaagcugcccagucuauaguacuuuuuauaguagcccaaagggacuaagauagggggcuuggccacggucucaccuccagccaagagcugcccaaacccuuucucuuucugguuaccauuuguaacgaacaugaucuauaagcaaacaagcaccguggaagcugcggugccccugugguccucaguaggcauucgggaaaucauuccuugcagcccuaggagaaacugguauuacaaguuucuaauccugaaguuacuuaagccaugcucuuuucaucaacugauaugcaucuggcuacagcuguuagagaugcucuguaccuguguuugaguccaggacauucucucaggugccuucaggagccagacugcaggaauucaacuguggccucaucugacuacagcagguguggagucuugguucaguugugcagccucucugcgccucggucuucucaucuguuaaagggaguaauaguaguccugacaagguucuuaugaagauuaaauacgagaaccaggcaaagagcuuaacgugguucuuggcacauguaaguucauaucaauguuaacuauuuuuuagaccaaugagagagugccuauuuaaacaagaacacccggguuuacauaaaaauagugguacaaguguaagacagucgcaagugugugugcguauguguguguguggugcccuggcuuuauugugucaauuauaaguagagacacuuuggccuacaggaugaaggaaacagggguucugccuuggcuuugcugcaaccagcuucacaccugggacaguccuuuccuucucugggucccaggucccucccuuuuaaaaugagcauaguaauagcucucaccaauaaagcauuaaaggagcuaagaugucagccuguccugggucucguuuccaacagaucucuugucucccccacugacuccaaaccacacaagccaugcuucucaggaacccaggacacccggauugugguaggguucugccaaugggagguuuagugggaggcucgaaggcagagguaccaccauccccgugacacuggcucagccuccuccuccaugccugcugacccggcaagccugaccugguggcagcuuugcacggacagccuggauccugguuccaggagcacagucucucccaucucuccauccgagggaugggagugcaucauauuggccauagagguuaccugagcuuccucgguuaccuaaggucacccagcuaauaagccuuggagauaagacgcaagccgaguucucuggauccagaguccacccuucucccccgcagugccaugcugccucccagaacacuuuauguugcuuuuuacccaugugaggaagucugugauguuucucucucuguaguugagaaaacucaugugcuaagggccucagugacacagaaucuucaugacuuucugaagaaugcugcgggaaccuggggucaaucauguagaauaauuggcuuugaggaccacagucucugagaagagcaguuguauggaaaguaggccugagcacuaacucuggcucuagucccugacuguuaucucaucaaagaaucugacaaaucugucagcgcuaccuaagucuuguaagcuaaaaaaacccagcaguugcaaaacaguggauuuccaguuuguaaacagaugaguuugagagcuguggaagagaaauacaagugaagauaauguguccuagaaagggaggaaggaaggagcugaggaagccggccucaaaagccucaaaaugaggccacuucugcccaguuaauaauuuuauuuuuuacuuaaagaaaauuaauagacuuucacggcaguuucagguauaaaggaaaauuggacagaaaguagagaguccucauauuuccccucucccccugccccccacaguugcccuauuauuaaugaaaacauuuuacugaacacugacucugcagcaggcucucaccccaucaucucauucaucuucccagcagcacuggagggagguauuugcaugcauucuugcuuucacagaggcugagaaggagccucagaaagggguggagguuaaagguaacagaguaacugaaagcagugacucuugaccucaggucugccugacacuuggugguguagcuggaggccacuugugagcggauuuagauuauucacguaccuccuggccacugacaaaaaugcucacguaaagcuucuuaguggccuguuguguaaccagagucuuaaggguuaaagaaagaacuuagaggauguuuuuuugaggcaaguuuaucagauagccauucuccugugauuaaaaagcucucauggcuagaaacuucuuuauggucuugcuuggaagcauuucuccuacugaauauuuuuauggucuuugaacccacagagaaaauguccaucaagaaacaagucaggcuggguacggugguucacaccuguaaucccagcacuuugggaggccaaggcaggcagaucaugaggucaggaguucaagaccauccugaccaauaagguaaaaccccaucucuacuaaaaauacaaaaauuagccagguguggugacgcacaccuguagucccaccuacucaggaggcugaggcaggagaaucgcuugaaccugggaggcggagguugcagugagccaagaucguuccacugcauuccagccugggcgacagagcaagacuccaucucaaaaaaaaaaaaaaaaaaaagaaaagaaagaaaagaaaagaaaaaaagaaagcagcuaauccagggggaaaucagccaaauuaguguugugccuggauuuauaaguauaugcuugagggggauagugagccagagccucaggcccaaaagcuuacguguuuucugagacauaaacuauggcuccuuuuuacuggaauaguguaaaaaaugucaacccuauuuuuuucaucaggauggaaaaggaaagucaagagaggcugaacaaagucuccaguaucccgguguuugcagcaaaaucaugucuugcgugcaugaacaggcaguaccauggacagauccacagugcaugguugccauccccacuccgggcuugugaggaauccacuaccucacaugcacaguggcguggaugggcuugcccauggugcuaggggccugggcugcauucucuucaguggcuguggcagagaaguccuaagagugaaauugcagugcccagacugcaggacacuuagucaagugcugaacauggagggcuagauguugggcagggacugagacaggagauggcacagguggaaguggucaagacucaauggugggaggggcuguggcuccugagccauagugucuccugugacucuuccuuguggcaaauaugugaggggcuggugauuugaauugucucaaagguagagaguagaguccaauaggguauauuacagaaacaaaaugucuagaggaccaaauaucauucauucauucaucauucagcaaauaccuacagugcucucuguuguccagggccccugacugguccugcaaaugcaaaaauaaauaaguugaggacccugcuuggagaagcccaccauuagcaaaggguguuauugaaauguugcauuacaacaaaauaaccccacaggucaaucaggaggucugagggaguucaggggaguccaucucuucuugaagcguguggggcuggagaugagcucugacuguugcugaugcaaaaagacauugagccagaaguccagggaggcagccagcucaccgugcacaggcaaugcaccacaggggcugcauggagaauagcgcagcauggagaauagugugggguagagaauaguguggagaauagugucgugugcagcugcuggaacacugggcaguuuaugucaacagaagcuauuucaagggccuggagaggcauaagccacagccuuuaucauaggcuaagucuuccagcuaauauuuacacagcuugggggcauaaaauaucaaacagcuacaaaugagcacaagauucucuguggcuucaugcuaagagccuucuaaaaaggucuuugugggaaauaaucugugaauaaauaacagagaauaauuuaaaauauaagaaccaggucuuacuuuacacuuugacuaggaauauuucuuuugguguaugugguaugugucugcuuguuguguuuuuuuauuccagagccacaugcuuuggccuggugcugugacuuaaagcugauauccccagaagcugagcgucuuucugaaucuuucccagcuaccccuucugagucuucagcuugcugccucacauguguggccccccaggagggcaaauagauauagcuagaauauuugcuucaaaaggcauugcuaauagucacacaucagguacaaguccugaagaaaagauuaugagauuucacuacauaaaaauugacauucucauaggucagaauagaauuauaagcaaauuggguccaacaaaaaugaggaaaaugccugcaaaacauuuaacagacguaagaguagaauuauuaguauauuagaacucucacaauuaaauaggaaauaucuaacacccuaguggaaaagaaugcagugagcaagaaauucaguaaaaaaguaauccaaauggcaaagaaacacacgaaaaagcuauucaguuucauuagucaaaguacaauggggccgggcgcgguggcucacgccuguaauccuagcauuuugggaggcugaggcggguggaucacuugaggucaggaguuagagaccagccuggccaacauggugaaacccuguuucuacuaaaaauacaaaaaaaauagccgggcaugguggcaugcgccuguaaucccaccuacucaggaggucaaggcgggagaauugcuugaaccugggaggcagagguugcagugagcccagaucacaccacugcacuccagccuaggcgacagagugaggccccgucucaaaaaaaaaaaaaaaaaaaguacaacggaaucauuaaggcugguuaaacuuaaaauggauauucaagcccagugauuguaugguaaaaugagcauucuuauacauguuuuaggggaaaauuuggcaauauauuuucaagacacuaaaaauauuuaucucuagaagaauuuguucuaaauaaauuauaaaauaaguguucuccuuuuuauaaauuuuuaaugcaaaagaaagugugcagaaacguaaacaagagguugcacauuuuaggauuauuuggaaaagcuaauagcugacauuuauugagugcuaauuuguuaccauuuauuuauuuaguuguuacacaaaguucuucaagguauuacgggcauaccucuugugaaaggaaaauaucuuaggcccuuucaagcugggaaccacucagggaaaaucugucucccauucuauucaagucaucccuuugcucacagagauagaugcauauuuugauugccuucuuuagaaagacuuaucagaaacucaaaagaaugcaacuaacuguaucucaccuaccgugaccugggagcccacagcgggagggccuugcuuugcacugucucaccuuucuggauggaacuaauguacuucuuucaaauugauugaugucuccugucucccuaaaauguauaaaaccaagcuuggccacaugucauaaggacuuccugaggcugugucacggguguguccucaaccuuggcaaaauaaacuuucuaaauuaacugagaccugucucaaauuuucgguguucacaccucagaaauauugcaaauucaguuccaggugaccaccauaaagggagucgcaugaauuuuuucucuccagugcauacaaaaguucuguuuacacuauacuguagucuauuaagugugcaauaacauuauauauaaaaaguauauaccuuaauuuaaaaauaauguauugcuaaaaaugcuaacgaucaucugauccuucagcaaacauaaucuuuuugcuggugcagggucuugccuccaugucgauggcugcugacuggucagggugguaguaccugaaaguuaugguagcuguggcaauuccuuaaaacaaaguaacaaugaaguuugcugcaucgaucaacucuuccuuucaugaaggaugccucuguagcaugugaugcuguuugauagcauuuuacccccaguagaacuucuuucagaauuggagucaguucucuuaaaucuugcugcugcuuuagcaacucaguuuauguaauauucuaaauccuuugcuguuguuucaacaauacucacagccucuucaacaagaauagacucuaucucaagaugucuuugcucauccaugagaagcaacuaaucuguccaauuuuaucaugagauugcagcaauucagucauaucuucaggcuccauuuaaaauucuaguucucuauuuccaccauaucugcagugacuucuuccacugaaauuuugaaacuugaagucgucugugaggauuggaaucaacuucuuccaccuccuguuaauguugauauugugaccucuuuccaugaaucacaaauguucuuuuuuuuuuuuuuuugagacagagucuugcucugucgcccaggcuggagugcaguggugugaucuuggcuuacugcugcaagcuccgccucccagguucaugccauucuguugccucagccucccgaguagcugggacuacaggagcccgccaccacaccuggcuaauuuuuuuuguauuuuuaguacagaugggguuucaccguguuagccaggauggucucgaucuccugaccucgugauccacccgccuuggccucccaaagugcugggauuacaggagugagccacugcgcccggcccacaaauguucuuaauggcaucuagaauaguaaauucuuuccaaaagguuuuuaauuuacuuugcugaaguucaucagaggaaugacuaucuauggcagaugcagccuuaugaaaugcauuucuuaauaagacuugaaagucuaaauuacucuuugaucaauggacuguagaauggaugucgaguuagcaggaaugaaaacauuaauuuccuuguacaucuugcucuugagugaccaggugcauugucaaugagcaguaauauuuuugaaaggaaucuuuccuucugagaagucucucucaacaauagucuucaaauauucaguaaaccauacuguaaacagaugugcugucauccaggcuuuguuguuccauuuauaaagcacaggaagaguagauuuggcauaguuuuuaagggcccuaggauuuucagaauaauaaguaagcauaggcugcaacuuaaagucaccagcuguguuacccccuuugagagucagccuguacuuugaaguuuugaagccgggcauugacuucuccucucuggcuaugaaagcccuagagggcuucuuguuccaauagaaggcuaugaugucuauauugaaaaucuaugguuuaccguagccaccuucauggauuaucuuugcuggaucuucuggauaacuugcugcagcuucuccacuggcucuugcuguuucaccuugcacuucuauguaauggagacagcuucuuuccauaaaccucaugaacaaaacucugcuaacuucaggcauuuuuucugcaacuuucucaccucuuucagucuucauagaauugaagacaguuaagaccuuacucuggauuacgcuuuggcuuaaggaaauguuguggcugguuugaucuucaauucagaccauuaaaauacucuccauaucagaaauaaggcuauuuugcuuagcauucaugugcucacuggaguuauacuucuaauuuccuucaauaacuuuuccauugcuuucauagccuggauaacuguuuggcuucacuuuugaccuggcucaacuuuugacaugccuuccucacucagcugaaucauuucuagcuuuugauuuaaagugagagacauacuaccuacucuuccugucacuugaauacuuagaggccauugcaguguuacuaacugaccuaauuucaauuuugucacaucuuagagaacagggaggcccaaggaaaggaagaaagacaggcgaauaaugggucagugguucagucagacacaaauuuauuaaguugaccaucaugugggugugguccaugcugucccaaaacaauuacaauaguaacaucaaagauugccgaccauagaucacuauaacagauuaauaauaaugaaaugguuugaaauauuacaaaaguuucugaaauguaacacagagucauugagugagcacaugcuuuuggaaacauugugccuauagacuugcuggauucaggguugucacaaaccuucuauuuguaaaaaaugcaauaaaacgggguguaccuauacuauuauugucacgauuuuuguugccaguuaaagaaaaugagguuuagcauggcagcaauuuacgcuggguuguacagcuaauacaugcuguuauaauagcuaauacaugcgauuaugauagcuaauacauagaaucagggugugacucgcaguccuuucuuuggcucucggucucggaguguuggccacugggauacaccaaugcuucccacugugugggugaaaauuggaaauaauauaaaugcucaacaauagagguacauguugugaauauggcacauucacauugugaaauacuugugagaaaucacacaauagaaaaguauuuaucgggcaggugcgguggcucaugccugcaaucccagcacuuuggaaggccaaggcagacagaacacuugagaucaggaguucaagaccagccugaccaacauggcgaaauccugucucuacuaaaaauacaaaaaaaaaauuagccaggugucugccaccaugcccuguagucccagcuacucgggaggcugaggcaggagaaucacuugaaccugggaggcagagguugccgugagccaagaucgcaccacugcacucuagccugggugacagagcaagacuccgucucaaaaaaaaacaaaaaaaaaagaaaaagaaaaguauuuaucaacaugagaaauguacuuagaaauuaguaaagaaaaacaggcuagcaaaaagaucugcagugugauaccauuugaguuaaaaauuugagucauauuaauuugaaauacuuccacuugaggugaaaaccaaguuucacuguaugugcaaaauuaaaaaaaaacagucacuucaaacuaaaaacuaauuucaaagccugcaggccccaaggaauuguaagcuggcugcuuuagcacauggccuugauguuuugcuggugaacaggacacuccuuggucguuggcuuaagaagcacaaaggugcaacagaacuucagacagucauugugguuguucucaugcuuguuaguuuggcauuugcuguugcuauaaucuagagucuaaucuuacgucucaaucacugccacucaagcacucacuagcugagaaaugcauccucaaacaauagcuuuaacaugggggcuggaucuaauaagccuugaaaugacauaaaaacuucuguaacuguucauuuaacagagaacauggaaguaaaaauauuagagagaaugccaauggaaggaaaagcacauucuagcagguuuaccuuugucaaaguaccuugaccaaacaucagccaagcuccucuggcccaagggggaagagcuuagccaagucuccuccuuggccuucugagcacaacuuugauguccaaucaggcucaugugcuuccacuuuugguaucucauccagaguuccuuuuuccccuccacccuugauacuuacccaaguuccucuuaguaauuuuccacccagggacccucucaccugaccguuggcuguaagucccuaugugccccuguuguuuuuggaauugaguucagccccuccccuuuugcaacauucuaucccuauugcaguggucuugaguaaaaucugucuugucacuuuuaacaagugccuggugaacaauuuuucuuuaccaccuuuaaccucacaaaaauuguuaaaaaucccagcauggacaaugggaaaauagagaagugcuggaagcugauaguaaggucaucaccauugcuaauaacagugaauuuagaguauuccuaagcacuuaacucccaugggaaaauuuaucuuaaauuuguccuggagccagcuauaaauuugaauccuauuucugcaauuacuggucaugugaucuugggcaugucacauugccucucugagcuuccauuuccucaucuacaaaacuuuggaguaugaaaaagauuugaaaaugcaucccuaugcauuuuccuugugccauccuaugcacaagacgugccuuauggagaaaauacauguguuagagaagcuuccccagacaggaguuacagugcuguuggcugugaguccaucccuagcaugcaauugucucucauaaauagaaaauauucuagaggcugggagcgguggcucaugccuguaaucccagcacuuugagaggccgaggcugguggaucaccagaggucaggaguuugagaccagccuggccaauguggugaaaccccgccucuacuaaaaauacaaaaauuagcugggcauaguggugggugcuuauaaucccagcuacucaggagacugaggcaggagaaucacuugaacccgggaggcagagguugcagugagccgagaucgugccauugcacuucagccugggcgacaagagcaaaacuccguuucaaaaaaauaaacacauaaaauaaaguaaaauaaaaauucuagaaagacaugugccagaauuuuggguugugggauuuuaggcuuaucuuuuucuuuguguuguucacuguccuguuuugaaaauacaauugauucuuauucacauauuccaccuaugcaaauucuccuacuugcuaaaauucauuuguaacccccaaugucaauaaauaucaauacucauggugcuuuugagaccacucagggacguacauauguguagcguaguggagaaugugcuuguccgaugcguauguucccagcugaggcugaacaaagggacacacuaccuucuugcgucagcucucauaauguaaacauguccuucucucugucuauucagugccacauccuucacauuuuuauguuuuucuucuuggugauuuugcuguuuaaaaugacccccaaauguggugcagaagugcugucuagccauccuaugcacaagacgugccuuauggagaaaauauauguguuagagaagcuuccccagacaggaguuacagugcuguuggcugugaguccaauguuaaugaaucaauauauauuaaauaaagugucucuuaaaaacacaugaaaaguuuauguacugauuuguugacaaaaauguugggaucacgcuucaggaaauuguauuuccccuagaagaaaugguucaguauucacuaauucagaguuuauggccauggcaacuguuguagauagaacacagcuaccagcaauaaugagaauugccuguauauuacuuaugcaaggagggaggagagcauuaguuuuaaaaagcagauggugcguaaaggugcaguuccaucugugacagaaucaagaggagagaagaagacuaaguuugagggggugugcugccccaggcucugagcugaggcucgugugcauugugugacugugccuucaugcccuccugagaggucagcaucacagucuucauuucucagaugaggagaggggcucuaaggggcaagcuugucucuuucaaaggcagguaagggcagaggcaggacuuggaccaguguuugucauuaaaguuggaaucgaucaugaaaauaaacgugugcuucuagucuauugaaauaaagcgacguuguguuguucccaguugaauagcuggugaagaggagaagcagcuuuugccucagucccaaauccagugccauuucuaccuccuacagacauggagggaaagcgccccuuacuugggauccaaguggccuccagggcaugcagucacugcccaggugucccuacccacggcuugcuugguauccccgccuuccaguucagagguugcaaaauuugcucacugaaucauuuucuuucugcaguuuucaccucugacagagcccagacaccaugaacgcaagugaauuccgaaggagagggaaggagaugguggauuacauggccaacuacauggaaggcauugagggacgccaggucuacccugacguggagcccggguaccugcggccgcugaucccugccgcugccccucaggagccagacacguuugaggacaucaucaacgacguugagaagauaaucaugccugggguaaguguguauccaaggucagaaaacaggagggcuagaacucacauagcaccuacuuggcucugagcaauucacauacuuuguuucaaggaaucccuauggcagucagguuggagagaaauuuugucauuucuauuuuacaacugaggaaacugaggcucagagagguuaggugguccaccucaggucacacagguaguacacgaugaagucaggauuaaaauccaaauccaagggcagugaggcucuuucccccagguccccugagacucagucccugcccagagacacucgguacauagagcguguccucauauacauuaggaagcaagacacugguggcugcuuucaaauaagucaauugccccaaauaaagcacacuuccaccauccuuggguuuagcaauagguaauuagcauauguggaagaaacguuuucuuuaguuuauuugagagugggcaguguggugcugcccaccaaggcagcccuuuuucucugaagccaguaggccugggguacacagagggcagaaaucagcgggacuggcugcugucuccgauacucacucacagggcagcagaguuggagcucagagaaacuucccuucagcuuuacgcuuccacaguagauuuucucugccaaggaguucaccuaaaagccuguugguuaaaguggcucuggccuagucagggucugggugggaguugcagcccggccaguuucuagaucacgaauguuuaugaggauggccaaaccugcccuuccaugcaacaaugugcagaguccaggcagggaaaaucuccgugggcuccacugguugaucacugccgcgacccagcaugucugugguuguaaggccuaugagcaacgacaugugauuuucauagaagaggggucugggaccaucaagacccacucccucaauguagacagaaugccaaggcccugugaaggcauaaggucagacaagguuacaguccacugaucauggguugagacuaggccucaggcccuggaccucagggacugguuucucaguagcugagcgccucucucaccacacugcucacauuucuucuuccaggggauucucacuuggcauuuaugcuuugagcaaagaacaggauucagguucuucuagaaauugugcaaguacacuaagcuguucagcauaaaacccuuugggagagguguggcuaaaugucaggcaguggggaguacaggagaguaagggaggauuugaagucuuucugcuuccuucuaugggggcauucacugcgcagagcugagcugggaaaugcacaggcguugggcaaggucccugggugggagcugcagcccacgaacugcuggcugugugaucgcaggaaaccaggugagcucucgagccgugagcggagcaagugcaggcccagccaucucaaaaguugcugugaauaucagcggagagugaagcaaaagagcacacaucugucccuaaucaagaaucgcuucuguccuuuuccagcccaaaggccacaggaaggggagagagacaaaggcacaugggcccuccaggugcggaggggcuagucagccacagggcugcucuuaaacucuccugggccccgggcgcuuugucuuugucggcuccuuccucccuagaaauauggaaaauuaugcuuuacaaaugcauuggcauaaagaugaauauauuaacaucgauuuuuuuucuuuaaccugaaaguucacuguuuuuuccuccugauuacagaagaaauuuaagcauuuuuucagccccuaacagugucgugggccuggaccugcugugcugaaggcaucacagccugugcagcuccucucggccucucagccucaucaccaaccucccacaccugagcccccaagccuagacuguguuagcucccucucuccaccacuccccaagcccuggcagacuugggguggccgugguuguuaaauaaaccuuacugaacacuccuaguucuuggugagcucucucaguuggcugccuucacaaucagaggggguugcucaugcuacaucuuagacaacauauauuuaacgaugagugcuauugagaaauaaauguuugcaucucuucucagauuguaagagauaucuuacagauaucuuagcuuggacugcuauaucaaaggacguagacugggggcuuaaacaacauugauuucucacaguucuagagacaggaagucugagaucaagauauuagguucaggugagggcucucuuccugguuuacagacagccgucuucccaguguguacucacguaaccaagagguagccagcucucugccuuuucuuaugagggcacuaaucccacuguuggggggcacuaaucuuauuaaggggaccccacccucaugcccuaaucaccucccaaagacgcugucccuuaaugccaucacuuuggggguuaggauuucgacgcgaauggugugcagauacucacauucagagcagagcagccaagcccgauagagcauauccucugcugcugggauucugagccagaccuggaggaagcaucagagcacgugcuuucauuuuaucugaagggaugacagggcccagggaggugcagucaguugucugggguaacccagcaaaucaggguuccugcuggacuugcaguccaggggugcucccaacaccaugcuauucccacaggcaggauggacauggagcaccagcaggggacaaugcggaacagggcaaugucucucagaaaccagugcguggucacagccugagaggggucugaauggcaauuucuauaccuucuccaugcacaggggcugaggguuguccugagggcuuuaggacuuuauucuguuccuucagggcagguacugcauuggcaggaacaaauuaaagacccaaagacuaggcuacaccugcuccuucucuguccuccccugaucguccucccagacuccaagauguuugaggcuggccccuuguuaccauugcuaaauguucccugccuggguguccaccacaacccuugccuccuggauccugaaacccccuguccccaaguauaccaccuggagcugucacuaccccuuauggaucuccucccuggcccacaugagcuuuuccucugugccucacccagggaguggcagguguucaccuuaugggcuggagaaaggugggaugccccuagccagggcaaauggcaaggggcaguggccaggcugagggacagcagaggugagacaucuguggggugauccagcugcuuggcuggagggaaggccucagcuccucuagaagagccaggggcagcgggaagaccagaugcauguuuguggcuugacugaagaaaccucgaaaauccagagcuugguuuuuuuuuuuguuuguuuguuuguuuuuaauggagacuuuauuuuuuagaguaguuuuaggaaaacuaagcuuuuggcacaaagagaucagccuuggggcagcgccuucacugacgagagcaccggagcaagaacuugaagcacagugugguuuuuugagacuucuuuuguuauggaaaaugauaaggauuuuccacuuuauuuuggagauagaacuuuuccuucugagcuagcaaauacauuccagugucaaaaagggagcugguuuaaagggaguggggacaguaaggugauguguaaaugcuccgaaauaauggaggaagguaaugggauggcugacauuuggggaacugcacucaccuaacucugggucuggcugcaucuggcagcugggagccauggggguaccugggucccccgcucucuugaggccuggcuuuccucacuccucagcagcugcucuguccucccaugcaggugacgcacuggcacagccccuacuucuucgccuacuuccccacugccagcucguacccggccaugcuugcggacaugcugugcggggccauuggcugcaucggcuucuccugggugaggguccggaugcaccucgggaagggguccuggcuguggugggaucccgggguggggacacgguaccuaugcacaagggaccugagcagauggcggugcugucugugggcagacgggcuacuguugcagggaggagaaaggauucagcccagagagagugccucugagaaaguagcgauugagaacagagaaagucucaacaacucaaagcccauucugcacaggcuguguuggaagcacuugguaugaacuaacaucauggucuggggcccagaguuucugcagcucgaaccugggaaucugcauuucuccaagcagcucagagaauuucuauauccuccaaagcuugagaaccgcgacugccccugucucauuccuucuguucuccaccagggcugcugccuggggagaggcuccaaccagccuaucagauguguccagagccuuggagcaggggggucucuggaaaagggccuagcuccugccugcaaaccaccagucccacccuaucuggagguaaaaugccuaaaaaagucccuacucagaagaacgguaggcagggcuggcucugcccgugacucugugcuccaggcacagauuacaggaaagaugcauuccucccaaaugcagagagcuuggagguagagcugccugcugauggccaguguccgagggcugcugcacccuggggaguuccucaaaagccaggggcuguccuuggccuuugggguccagagcacucaccuugucuguggcuuggagccagguggacuugugggcaucggucuauguggcaugcugugauguguaaaggagcugucaauuaggaauuugcagcacugagccacagggcccagcugagccaccucugcuucaccagccuggcacuugcucuucucugggcuggggcacuggaaguugccgggugagcaggcaucaugggcccuacaggcagggcugaagagcccacagaugggcucuucagugucugugcugcuccucugccaggcacuggggccucccucucugcugggcagggcuggccugggcugagcauacccucuccuaaagagcauuuucuaucacuggauauugcagcagauuucauuuagcucugcugguccaaauccauucugucccacagagguacuuggcauccaucucuaucugcucauucugggacagucugauugcccucaggccuugaagggagugccucacuaucucucaggcugcguugccugauaccucaucccuagcagagagcauaggcuccugguagagcugggcuuggccaggcucagguagaacccagcaggauggggcugaccagaagggagaaugcacucuucucacuuagaucuuacuggugacgcaucgggauguugcugugcacaucuaggcacgagaacaucuuggaccccuuauguuggagacuuuuaugaagguggagacucaauccaccuuuggauggggcucaagaccagccuguucagagagaggggagaguucauagagaaaagucacugggaguuuaaaagacaagaucaauggcuucucgggaugcccagagggugacagcugcccagcgcccacuuucucauucccuucauuugugacuacggaggaaaguccaccagugggcuuucuggacccuucugugagugaacaaaugaauauccuagcaagcccgcagagcccaugcagugaggcucaguggaguaagguucauuaugguggcccguauguuccuucccaaccgcucuccuugcaugauucuaggucaaacagccuucaggccuuugaaucacaucugagauugggugauuuuaaucugggcuuuaguggaagguuaaauccccuuguuacugcugacccccaaauucugcaaugccuggcccucgguuaaucccuucccuucccccacgacaggcggcaagcccagcaugcacagagcuggagacugugaugauggacuggcucgggaagaugcuggaacuaccaaaggcauuuuugaaugagaaagcuggagaagggggaggagugauccagguaaggugggagcugugagggccacuuuugggaugcaugggcucugcacaggacuguagccgcagguggggaaagaggcacucaugcuucuuguuaguuccucaaauuucuccuggagaauaaacaaaaccgagcucuugggaaaaugcuggcuuugggauuggcaggaucuggauuaggaucccagugcugucuuucacucgcuuccccagggcagggcacucaguuccccaggccccuagcuaugguagguagcacagccgcuaucucacagcaggugcguggaaguaacaacuacagcaacuaucguuugugugggguuccccaucgccggccacugugccuaagcauuuuccaggcauuaacucauuuaauucucacaacaacacugugcauuuuaguaccccuuuuuacaagugaagaaacauuuuaauagcccuuuuuacaggagaggaaacuaggguccagaacauuagguagcuugccccauggcuuccagcuacagacucuguguggcucagagcccgugauauuccucggaggacagcacagguggcagaugugaccaggcuucagaggcuauaaauacuauuugucuuugaaccaaucauuuacuuaaagaugcugcugcuucuaugcagcaacugaauucauuuucuucauguaacauguaucuauugagagugacugugugucagagcuuacaccagggaacaagauagacaaaagacaaucaugauggaauuucuauuccacugggguugcaggacaaauggcacugggaugacuuggacuugaugcauuaaaaaaaaaaaaaaaaaacaacuuccuagcauggaauaugaacuauauugaacccaguacucucccuuaaucauuuuucucaugucaaguagaugauagucucauuaggaaagcauuguuaacuuugggaaaaaggggcuuccuuuucagauauugucuuucacaaggcucugagaauuggugaaggcccauucaguggaugaggacagugaggcacacacuggagaacaccuuugugcagagcacauggccaguguggccacgcgaaacuagcaagcaagucucuccacuuccaguccugagaaugagcaacaagacugauaauuuuauguauuuguuucuauugauguugugacaaauuuuguggcucaaaauaagacaaacugauuaucuuacaguucuguacaucagaagucugaccugggucuuacugggcuaaaaccaaaguugacaccuuggaggcuccaggggugaaucugcuuccuugccucuucugacuucuagaggcuuccaaaauuccuuggcucacagccccauuuccauuuucaaagccagcugugucccaucuuucugaccuuucuuuuguaaaccccaaauaucugagaugggucucagucaacuuaguuuauuuugccaaaguuaaggaugcgugccugugauacagccucaagagauccugacuacaugugcccaaggugguugggcacagcuugguuguauacauuuuagggggacaugagauguaagauguacauugguuuggucuggaaaggugggacaauucaaagcagggagggggcuuucaggucauagguagauaagagacaauugguugcauucuuuugaguuucugauuagccuuuccaaaggaggccaucagaugugcagcuaucucagugggcagaggggugacuuugaguucugucuguccuucauccaaaaggaaauuccuuaugagggaggcauguagcuuuuuaucuuaguagcuaucucuuuuaggaauagaaugggaggcagguuuggccuaagcaguucccagcuugacuuuucccuuuggcuuagugauuugggggucccaagauuuauuuuccuuucacacuuuccuggucgcaucuccuugugaccacauauaagaucggaaagugggucuccacuuuuaaggacacauaugauuggauuggguccauccaggcaaucugagauaaucucucaagucaaguuucuuaacuuaaucacaucagcaaagucaccuuuucccuggaagggaaacagucacagauucuggggaccaagaccugaaaucucugggaaugagggugcauuaaugugccuaccacauccagugugcuucagagucauggagggaacuugcuuguaaugccuauuccuagacucugggccaaaaaaugugaacgcuaauucauccggaugacacccagauuccugaauaggccacaugccgggacugaugacugccuucuccaugacccacaggcccuguggccaggcucagagucaucccuccacgugcuccuccuucgcauucuuugguuaucucuuuuuccaucagacauaagugauauuaaauggggagcugaggaaaaugaaaugucaggcauaguggcucacgccuguaaucccagcacuuugugaggccaaggcaggcagaucaccugaggucaggagucugagaccagccuggccaacauggugaaacccugucucuacuaaaaauacaaaaauuauccaggugugguggcgggcaccuauaaucccagcuacuugggaggagaauugcuugaaccugggaggcagagguugccgugagccaagaccuugccauugcacuccagccugguugacgagagggaaacuccaucaagaaaaaaaaaaaagaaagaaaagaaaacgucagcuauguuguaagcaaagcuucaauacguugcugugaaccauaccauucuacguagcagcaacaaugacucagcaaugauucagcaaaugaaucaugcuucagucccagcacaauuuucuucuggucagugaguaugcagcuggagaagccuccuuggccaagaucacagcaaggauaggcugucacaggugcccuuccagcgaggggagggagcuacugcacacuguccgcagccagugcucugucagcugcacuuugccuuggugagggccagauggcuuucuggccucuggaacaucaguccugauucuccaggggacagagggcagcagcacucagcgacccagugggacagcugcgugccugcagagggcgugguuuugauuccaggcaagggcaugcauggucuaacccuuuacaagaggccucgauguugguggccgacuuacuuuuucuuuuaguuuuauacacgggacaaggucuacuuuuccauuucuuuuccauuuguuccucucauuuuuuuuuuuuauuuugucuuguuuuuagacgaagucucauucuugucgcccaggcuggagugcaguggcacgaucucagcucacugcaaccacugccucccgguucaagccauucuccugccucagcuucccaagaagcugggauuacaaggcacccaucaccaugccuggauaauuuuuguauuuguaguagagacaggguuuugccauuuugcccaggcuggucucaaacuccugaccucaggugauccacccaccucggccucccaaagugcuaggauuacaggugugagcuguaggagaucggucagaguggugggagaaacuauagggaaaaggagcaggccuucugaaaggucagaaggcucugcaaagcuccauggcagaauagcugaaggcagcuguucuauaacccugaggcagaggauaaggaguagguacaagggaguguaggggaauuuaucuuggucaagcuuguuuguuagaaguuguccaggaacugaccucggaacauccuugcacgugacauucccugaaaggggaacaauaaauguuaauuaucuacagguuguguuugcuccagguuuucagcauugugcuugcacucaauaaaagcaagcugcuccagcuucucagggcugcucucuggccacuagagccaggcagucacuuagcugcucuuacacugcauaccugugucugagcacucauuuccuccaucggccagggucugcaggacagauccagcagugagccacugcacccagacuguuccccucauuuugacccucccuagcauuuggugagcccugcugauucaagacucagcucugugcaguguggagauuuuucuucuacuguauguuaguuauugugggccacgucacucuuuuucagggacuucaauuuuccacagauuggguaccucuuccaugauuucucucuuccuuucgauauuucccuuuuuuguuaucuucuauauuuuaggaagcuuuucaugguuuucuccacaugauuaugugauuauggaccuggugugguggcucacgccuguaaucccaacacuuugggaggccaaggcggguggaucauuugagguaggaguuuaagaccagccuggccaacauggugaaaucccaucucuacuaaaaauacaaaacuuagcuggacaugguggcaugugccuguaaucccagcuacucaggagguugaggcaggagaaucauuugaacccaggagguggauguugaggugagcugagaucaugccacugcacuccagucggggugacagagugagacccugucucaaaaaaaaaaaaaaaaguccccuuuccaccuagauacuggacauucaugguaaaaaugaaaagacacaggagcuuucuugucauauucccuguguuauuucaguaucuacaugugaauauauguauacagacaaaauugaaaugauacuacgcauauggauuuucugcauggugcuuuccuuaucauuuuauugugagcauuucccacuauuuaaauauuguuugaaaaaaguauuacuccaugauuuucuaugaugcaucacaaucuauauaaauauauaaauaauaccuaagauauuuguguugcaucaaauuuuccauucuuauaaaaaaaauuuuggaggacacccuuuaggaugaagugcaacaaucuuccaagaugaucaccuuccuccuaggacucuccuggcuguauucauguuuaacauucaugcuccccacuaaauccaaauggaacaaaacaaaaauugaagcauuucuaggucauugcaucuuauaacaaaaacaauuucauauucaauuuuuucagcagaugauuccucuaauuauauacuccucaaaaaaaucuuaucaaucccucauaauauaagcugugucuauuauaauaagagcuacuuuucauugaauagcaauuaugagcuuggcuauguuuuagccuaugucuugugcuuuguguuauugucuucauccucaaaguauuuaugaagauugauuggauuauggacaaucuuuuucauggaugaggauauugagucccagaaaguuaguagaacaugcauagcagcaaaagugaauuaaagccaaggcuaguaggaaagacaaccagaguuaugacuguuacaccagcucaucccugaccauaggcuuggguugguguccagagaugugcaugcuacuaugggcugcauuuucguuucauuaaagacaaccucauuuuugagagaccauacaagucuuuagcauuuggguaggaauauuccuggcaucucucagcccccgcuuuaacacaaucuuccugugagcccaauccacucaguuuuuuucuggaugaaaggaagaaaugggaucuguguuugccaccggaagcucacccuucucagcagacaaggcugauugucuguaauuggugaggccccaaagagcacaggagccuggugacagccugugagccagccugcauuauugauccccucagagcuguaaucacagcugugggcgucagcgcagugaugcgugucugagucaaauggcaaacuguuguugugaggcuggacaaauguggucugggaaaauggucucuuaauuggguuuuaaaguucuuguggaagaaaagacaauuuuuugcuucgaaaaaaacugaagaugaaaggacauuucugcucacggcaucagcagccagaagcgucagaccuuaccagcauccccuccuaccuccugagcaggcuugccauggcaaccuuugucugcugcuaucgcacagagccaucguuccugcucuguaccacaugucacccuccccgugcuucucuccgcgaagaucugcugccagcaaagugcagagagcuccaccugacaucaugcuugaggccaccaggccacccugguggcaucgggguggugugguucuagaugugcuacugacgauuugcuccuucaggcuuuuaaaacaucauuuuguugacuuaagaaggugaauuuucucuuaggacaugaacuaagcucccccauccccccccagagaaaagccauaaugaguugucauggugauucaggugauucauggugacucauuucauuagaauguucagagaaugaacaccugcguuccaacgcuucaagcagaggguagaauuuagccggggaagcugcagucacgccugcuugucaagcaucagaacagggaauugugccuuccaccaggcuuuucauguuacauuuccaaugagaaugggugggacaugacaaacaaaaugugugugggggcagauagggggacaggaggaaaucagggacaggaaugaugggguacauaggagaaguguaaguaagguacaaugccugcucucagggagccuggguuuccugggauggcugauuuagcuuugccagccaaaauugguuucuccccuucucucuccucuggccaagguuuguaaaccuggccuaaaacaaugucuaaaaucauugcucaugaaaauauagccugaaggaaauaaaguacccauuuuagaugcugaauuaagagacgcauauaucuguauauuugaacccauccauuagugcuacagaaacaugaauaaauguauuuaucuuucaauauuacugucccaccaaaggauguggguuggcucaaaagaauaaguaaaaguagugucaaggcaaagucaaaaugagaaaucagggucaaugaagagagcaucaaauguuaagaagagagguuagcauuucuacuuaauuauuuuauuauauauuucucuguaaaaaccuaucauguuauaaacuuuuucagagucaacaagaaccuaccuucuuuuauuugcccuuucuaauguccuuucauacuggucgguagauggguuucuucuacgacuuacuuaagagggaaggugcucgcugccccuaccuuucuaggcccauggcacccuaaaaagcgcaggcgugggcucacuccuaaccgugcccuaccuagcugcugauuuggggcaaguuagugaaccucucugcacaucuguuuccccaccugaagaugauaaaacacaaaaaugggauuauuuuuacaacuuaaaugggauaacauagcaggcccugaauccauuaguuugccagggguucccuaacaaaauaccacugacuggguggaucgaagaagaauuucuuuucucacagucccgaaggcugcaaguccaaaaucaaaguguccacaggguugguucuccuggggccucucuccugggcuugcagauggccaccuucucccuguguccucacauggucuucccucugugcacccacaugucugggggccacauuuccccuucuuuuuauuuauuuauuuuuuugagacugggucucacucugucgcccaggcuggagugcaguguuguaauugcggcucacugcaaccuccgccucccaggcucaagucauccucccaccucagccucucgaguagcugggacuaccaggcacgccaccaugccuggcuaauuuuuguauuuuuauagauacaggguuucgguauguugcccaggcuggucucgaacuccggggcucaagugaucgacccuccucugccucccaaagugcugggauuauaggcaaauuucauauuaucagaaacaugucagauuggauuagagcccagccaugugaccccauuuucuuuuaauuaccucucuaaaaagccuaucuccaaauauggucacaucugagguccuggggguuagggcuucaacacaugaauuuuuggggacacaauucagcccgugucauuaggaaucaaaagaaacccuuuaaggcaucucuuagucucaaggaaaaugcaccccuauuuuauaaacaaaugcaaaucgcucuguccgagugaauaugaacgcagagucaggcuugcaugcuggugcccugggccguucuccucugauagagacaggagcagucguccuaggccaggcugggggcaguccaugaggagaagcucucacaauaccuggcgcagggaaguggucagaaauguuagcugcugcuguuacacaaaauagacccaccaauggcaaacucauaccaacagcugaagugguggucucaggugucaaaaauauuaguuuucuccuaagcaaaggagagugaauuuugccauuucagacucauauuuuaagaaaacuauggacacaaaacaauaugucuuccaauaguguagguaccaaugccuucgcuauguuugggauuucauuuggaccuucucuugaauuuagggaagugccagugaagccacccugguggcccugcuggccgcucggaccaaagugauccaucggcugcaggcagcguccccagagcucacacaggccgcuaucauggagaagcugguggcuuacucauccgaucaggugaguguguuguggggguaucagccaagacuucaagacccgaauguuugguuuuaugucaaauucaaaccaaaccaaacagcauccuuccaaaucuaagaacaguuccucagguaucacuaaauagagaccugaacuacagggaagggguggauucuugggugggaacuggauagaucaaguuaagaaggaaauaaauguguggagacaucaccgcgacuggcucugucaccuuuucuaccagugcggacuucuguugugauuaucuggccuuccgagcaccauugcagagaaacuagauauggggaucaaaguccucggcccuaacugcagcuuuguuauucugugaucucaggccccuggguagcgucaagcaggagacaguggcggugggggcugcagggcaaaagguggccggcuuucaugagaauugccuuuccugagaaucucugagacaggauggaucugccacaguggugaugccuccuggcugguuucuuuccuccagguacuguuuacugagccuggccaccaagcuccccaaggcuccacagucaggggcagggcacagauuugagccuaggauuucuaaguccaccucugggaucuacuuuccagggucucgccacuuauccuugaguucaaacaaaugaaaaacuucauaaauauugacccagcacuuuacccuuguuagugccugauacuuuaaacuuaaaagcaagauuccacaggaacagaaacaacuccaggaaaaaaggggucucaugaaggugcaggggagagggagcagucaggagcaguucugccuccugugccguuaagagggaccuuguguuugcaauguuggcugcucucugccgauccagggccugguaauaacugcaugcacacaccuguacaaauccaacucugcugucuucuuuccaggcacacuccucaguggaaagagcuggguuaauugguggagugaaauuaaaagccauccccucagauggcaacuucgccaugcgugcgucugcccugcaggaagcccuggagagagacaaagcggcuggccugauuccuuucuuuguaaguucggcagcacuuguggcuccuggccaauaaggugaaacuccgucucuacuaaaaauacaaaaaaaaauuagccgggcaugguggcgcauucuuguaaucccagcuacucgggaagcugaggcaggagaauggcgugaacccgggaggcggagguugcagugagccgagaucgcgccgcugcacuccagccugugugacagagcaagacucugucucaaaaaaaauuaaucuuugagaaacgcuuuuuaccuccauuuuuuuuuuuguuuugucaauucaagucaauuccacaguguaauguggaagaacugacauggcucaaaguuagcacgcagagcaaggugacagccaagacauuuugaaggaugcaaaaagagucugccaguggaucaagguguaccugccaucuuaucccaaaagucuuaucuuucuccguugcguucaucuccacaggccauacagguuuguuccuauauguguuuacugcuuccuucuucccaacagaaugugcggggagguaagguccauuugaaucccugccuuaucccuagcuccugaaacagugccuggcacugaacagaagcucgauaaauauuugucaaacaaauaaagauuuggaagaaagaucauucagguagaaagaaagaucucccuuaaaauucccacaaacaauuucaguacaauuugaauagauucuauuuaaauaaggugaauuucuuugaaccuauagugucaauauuaagacucagaauacucugucuagggaaaaauaaaucugucaaaacacacucuuuuagguuucaagaaugaaaacaaugcaggaaacaucacugaaaauguuaagauuguauuuuacaaaaauuucaaaacucaugaaauaaaaagacaaaugcuggcaagaaccacuuauagcguaugucguaaaguaaaucuuaaaaagaaggcuuacauaucaguaagcaaaaaggcaacauuccagugggaaaacaugcgaaauauaugaagucaguuucauauauaaccacaaaaaacuaagaacacaaaaccgauucugauccucuaauaaccaaagaaaugcaaauuaguugccaagagagguauguuaaaaaucucacacuaugaguguagauaugucuauuuccacuuuuauaucuguuaaauuguguacauauuuugaagcauauuaauuuggugcauacacauuuagaauugucauaucucccuggugaaugaucguuuaucacuaggagaugcccuuuauaucucuaguaaugcauuuuguccugcagccuacuuugucugacauugcuauaauugcauauguuuucuauuggcuaauguuugcaugauauagacauuuuccauucuacuuucaaccucccuguucauuuauauuuaagauguauccugugaaagcagcauugauuguugcuauuuuaaaaauuuguuuuuaaaauccagugugacgauugauauuuauuuuguucauuuacacucaagguaguuauugauacauuuaaauguuaucugcugucuauuuguuuuuuauuuggcucaacuauuauaugauugcuuuucucuauguucuugccucuucuuggauuaauuauuucauauuauuccauuuucuuaucucugcauuuucuuauuuccauucggcaucuuuucuuuuagucuguagaauucccuuuagaaauuuuuagugugaauuugauauaaugaauuaucucaguuuuguuaaucugaaagugucuuuacugugccuucacuuuuggaagauauuuuuucuggguauagaauucuagaguguuugguagcuaguuuuauuuuugguacuuuguauaaguccauugaauucuuucuuccaugauuucuguugagaugucaguuguaauuuuaauguugugaugaugaagaacauacaaaaauaugacauuuccuucugugccgccaauggaggugcugcuugcuuuuugucuuuguuuuacugugauacaaggauaauuuucuuuuuauuuacucuucuuggauuucacagaacuuccugaaucuguaauuuggugucucuccucgguuuuggaaaauucuaaccuauuaucuucccaaaguuugccucuccucauuuccucucuccucccauucugggacucugauuauguauauguuaaaucuuucugcagacugccauauaucucuuaugcccuuuuacaugucucacuuucuuuuuuuuuuuaaucuccaugcuucaucaacuuauuuacaauuuaccaauuaaucucuuuagcuaugccuagcugauaaauaugucaugcucauaauucuaaacauuaaaaaauuuuaacuuauuuuauuuuauuuuauuuuuuugagacagagucucacucuaucacccagguuggagugcagugaugcaaucuuggcucacugcaacaucugccucccagguucaaguaagucuccuaccucagccucccaaguagcugggauuacagguguguaccaccacgccuggcuaauuuuuguauuucuaguggagacggggucucaucauguuggccaagcuggucucgaaccccugacugcaggugaucugccugccucggccuuccaaagugcugggauuacaggagugagccacugugccuggccaacuuuuuauuuugaaauaaucguagauucauagaaaauuacaaaguuagcacaaagaaauucugcguacuaacccuucacccaauuuccccuaauuguuccaacuuuuauaacuauaguaccauaucaaagacaggagacugacacugguucauuguguguguauaggucuaugucauuuaucacaaguguugauucaugcagccaccaugccaaugagaauacugaaauccucuagcaccacaaaggucugccucugcuacucccugauagucacucucaccuuccugaucuccuaccaucaucaacccuuggcaaucacugauauguuuucuaccucuacacucuugucauuuugagaauguuauauaaauggaauuauacaauaugugacauuucaagaucagcuuuucucacucagcauaauggccuugagauccauccaaguuguugcauguaucaauaguauguuccuuuucguugcugcaccacagagauuugguaccauguuaucuauacuacaguuuguuuacccauucaccuguugaggggcauuguaguuguuuccauauuuuggcuauuacaaauaaugcauccaggaacauuaauguauagguguuuggguggacauauacuuucauuucucugggauaaaugccuaagagugcaauuaaggguccuaugguaguuguuacauuuaauuuuuuuaacaaagaaacugacaagguauuuuccagagugacuguauuauuuuacauuuccauuaucaaugcuugagaaaaucaggcucuuuauacauccuuaccagcauuugguauugucacuauuuuuuauuuuauccauuuugauagauaugcauuaauauguuaucaugguccuaauuugcaguucccugauaacuaaugaacaucuuuucaugugcuuauucacuaucuauauguccucgucaaugacaugugucuuuaugucuuuugcccauuuucuaauuggaugauggauugauuuuuuaaaugaauaagcuuaauuuuguuagaguuguuuuaggcuuacagaaaaauaaguaggaagaacauauaccuucuuauaucccaaccuucauuucccccauuauuagcauccugcaguagugugauacauuuauuaaaauugauucaccaauacauaacauccauaauuuaccuuaggggucacuauuucuauugaauuuucuauauguuuuaacaaguguauaaugacaaguaucuaccauuucaguguuacacagaauaguuucacugccauaaaaauccccugugcuccaccuguuuaucccucucucccuccacuugaaccacuggcagccacuaaucuuuuuggcugucuccaucauuuguucuuuuuuagaaugucauacagauagaaucauacaauauguagccuuuucagauugacuuauuucacuaacauguauuuaaguuuccuccaugucuuuuuguacuaguuuauuucuuuuuauuguugaaugcuguuuucugauaugaacacgccacaauucauuuaugcauuuaucuauugaaggacaucuuguuugcuuccaaguuuugacaguuauuaaugaagugcuauaagcauuugugugcagguuuuuguguguacauaaguuuucaacucauuuggguaaauaccaaggaucacaauugcuggaucguaugguaagagugugcuuaaaguuuuauaaggaaaggcugaacuguguuucaaagagacuguaccauuuugcauucccacaaugaauguuaguguagguuuuccaauaucuuugucagcuguuaauuuuuuucaguguuuuuuauuuuauccauucuaauagauguguagugguaucuuauuguuauuuuacuugaaaauucuguaauaacauaugauguugagcauuauuucaugugcuuauuugcuacaugaacaucuucuuugguaagaugucuguucaggucuuuugcccacuuuuuaauuggauuguuucauuauuauugaguuuuaagaguucuuuguguauuuuggguagcaaaccuuuaucaagauauauguuuugccaauguuuucugccagucuuuagcuugucauuucauccuuuaaacaaugucuuuugcagagcagaaguuuuaauuacaaugaaguccagauuaucaauuacuucuuucauggaucauguuuuugguguggucuccaaaaauucaucaucaauccuaaggucaucuagguuuucuccuauauuaucuucucggaaauuuauaguuuuguacuuuaaaacauuaaaauagauguaggucuaugaucuauuuucaguuaauuuuugugaaagguguaaggucuaugucuagauucauuuuuugcauguagauguugauaugguuuggcucugugucccaacccgaauccauguggaauuguaauccucaguguuaggggaaggaccugguggaaggugauuggaucauggggauggauuucucccuugcuguucucaugauagugagugaauucucaugagauccggcuguuuaaacaguguguagcaccucucccuuugcucucucuugcuggcaauaugaagaugugcuugcuuccccuucaccuucugccaugauuguaaguuuccggaggcccccccagccaugcuuccuguauagccaguggaacuaugaaccaauaguuccuuucuuuguaauggaacaauaaaccuccuuucuuuauaaauuacccagucucaggaaguucuuuauagcaaugugagaauggacuaaugcagauguucaguuguuccagcaccuuuuguugaauacuacacuuccuccauugaauugcuuuuguuccuuugucaaagaucaguugacuucauuugugcggaucuauuucuguucaacucauuuauuugucucuuccuuugccaauaccauauugucuugauuuauagcuuucuacuaagucuugaauuuggguagugucaugucagaucucaaacacuguuguuuaauauuauguugacuauucuagguccuuugccucuucauauaagcauuagaaucaguuuagcaaaaugcacaaaauaacuuucugggacuuuauauaggauugcauugaauuuacgcauuuuguugaaauaacugacaucuugaugauauugagacuuccuauccauguaugugaaauaugccuacauuuauuuagaucuuuuaaaaaauuuucuucauuagaguauuguaguuuuccucauauaaagcucauucuuuuuuuuuucuuuuuacuuuuuuuggugcuaaugggaaugguuuuuauuuuauuuucaaauuucauuuuuuuaauugcuggaugauaagaaaacaauuaacuuuuaucuaauauuaucauuuuauccuacagcuugccauaauuguuuacuuaguucugggagaguuuuguuuuuguuuauucuuugggauuucuacacagauaaccaugucaucugcaaagauacuuuuuuucuuuccuuccaaucuguauaucucuuauuuccucuucuugucuuauugcauuagcugaaacucucaguacaauguugauaggaguaguaagaacagacauccuugccucauuccugaucuucguaggaaaacaucuaguuuuucaucaucaaguaugauguuaagaguagguuuuucauucaucaaguaugauguuaagaguagaugucauucaucaaguugaggauguucugcucgaauccuaguuugcuaggaguuuuuauuaugaacaaguguugaauuuugucaaacacuuuucuguaucuauuuacauaaucaugagauucuuguccuucagccuguugaaaugauagauuauauuaauuuauuuuucuauguugaaucagccuuccauccuggaauagaucucacuugguucugauauauaauuuuuuuuacauuguuggauucaauuugcuaauauuuuguugagaauuuuugcaucucuauuuaugagagauauuguucuauaguuuuccuucuugcaaugucuuuguaauacuggucucauagaaugagucagaaaguauuccuuuugcuucuauuuucuguaaguaauccuuacuuccuuaaauguuuggcagaacucagcagugaauucaauuggcaugguuucuuuguuuuagaagguuuuuaauuauugaucuaauuuuaaaauagauguagcaccauugagguuaucucuuucucuuugucugaguuuuggcaaauuguauccuucaaaaaguuggucuauuuuauuuagguuuuugaauuuguggccuuggaauccauuuuguuucuuuauuaucuuuuuaauguccauaggauuaguaaugaugguucuacuuuccuuucugauauuagcaaugugugucuuuuuucuuaaccuguauaaauguuugaaaauuuauuuaucauuucaaagagucagcuuuuuucuuuauuuccuauuuccaauuucauugauuucugcucuaauucuuauuauuucuuuucuuuucuucugcuuacauugcauuuauuuauuuauuuauuuauuuauuuauuuauuuauuuauuuucugagacagagucuuacucuguugccuaggcuggaaugcaguggcacaaccuccaccucccagguucaagcaauucuccugccucagccucuugaguaucugggacuacaggcaugcaucaccauacccagcuaauuuuuguauuuuuaguagagaugggauuucaccauguuggucaggcuggccuugaacuccugaccucaggugauccgccugccucggccucccaaagugcugggauuacaggcaugagccacugcaccuggccacauugcauuuaaauugccuuuuuuucuagguuauuaagguggaagcuuagauuauagauuuuagauuucccuucuuuucuaauguacucauucaguucuguaaauuucccuuuaaguacuguuucacugcaucccacaaauuuugaugaguuuuauugucauuuucauugaaguacuuuuaaauuuuucuugagacuucuccuuugaccuuaaaauguguuguuugaucucuaagaguuuucgggucuuccagcuaucuuuuuauuauugauuucuaauuuaauuccaaugcagucugagagcauacuuuguauaauguccauuauuuuaaauuuguugagauguauuuuauggcuuggaaugugguauaucuuggugaauguugauugugagcgugagaaagaaaauauauucugcugucauuggaugaaauauuuuacaaauauugauuugauccaguuaauugaugguacuuuuccauucaauuauauccuuaccuauuuucugacugcuggaccuguccauuucugacaaaggggugacaaagucuccaacuauaagagugaguuuaucuguuucuccuuagaguucuaucacuaauaauauaguaacugugaaaaguagauucucgcccaucuucaggauuuacugguuuuuguuuguuuguuuguuuguuuugguuuugauuguuguagacuaccucugugcugaaaauuggccuuagguguaaacuuuuuuucccccauaaguuauuaggguacaggugguauuugguuacaugaguaaauuccuuuaguggugauuugugagauuuuggugcacccauaaacugagcaguauacacugcaccacauuuguagucuuuuauuccucacccccgcucccacucuuccccccaaguccccaaagcccauuguaucauucucaugccuuugugucuucauagcuuagcucccacauaucagugagaaccuacaauguuugguuuuccauuccugagcuacuucacuuagaauguguccaaucuuauccaggucacugcgaaugcuguuaauucauuacuuuuuauggcugaguaguauuccauuguauguauauauaccacaguuucuuuauuuauucguugauugaugggcauuugguugguuccacgauuuugcaauugugaauugugcugcuuuaaacaugcaugugcaaguaucucuuucuaauaaugacuuauuuuccucuggguagauacccaguagugggauugcuggaucaaaugguaguucuacuuuuaguucuuuuaggaaucuccacacagauuuccauaguggcuauacuaguuuacauuccuaccagcaguguagaaguguuccuggaucaccacauccaugccaacaucuaauguuuuugauuuuuugauuauggcuauucuugcaggaguaaggugguauugcauugugguuuugauuugcauuucccugauuauuagugauguugagcauuuuuuuuauauguuuguuggccauuuguauaucuucuuuugagaauugucuauucauguccuuagcccaguuuuugaugggauuguuuguuuaucguguuacugauuuguuugaguucauuguagauucuagauauuaguccuuugucagauguauagauugugaagauuuccucccacucuguggguugucuguuuacccugcugacuguuccuuuugccaugcaaaugcucuuuaguuuaauuaggucccagccauuuaucucuguuuuuauugcauuugcuuuuggguucuuguucaugaaauccuugccuaagccaaugucuacaaggguuuuuccaauguuaucuucuagaauuuuuauaguuucaggucuuagguuuaaguccucaauccaucuugaguugauuuuuguauaaggugagagaugaggaugcgguuucauucuccuacauguggcuagccaauuaucccagcaacauuaguugaaaaggguguccuuucccccacuuuauguuuuuguuugcuuuguugaagaucaguugguuguaaguauuggauuuauuucuggguucucuauucuguuccauuggucuaugugccuauuuuuauaccaguaccaugcuguucuggugacuauggccuuauaguauaguuugaaaucagguagugugaugccuccagauuuguucuuuuugcuuagucuugcuuugacuaugcuggcucuuuuuugguuucauaugaauuuuagaauuguuuuuuucuauuucugugaagaaugauggugguauuuugauggggauugcauugcauuuguagauugcuuuugguaguauggucauuuucacaauauugauucuacccauuaaugagcauggaauguguuuccauuuguuugugucaucuaugauuucuuuuuuuuuuuuuuugagauggagucucgcucugucacccaggguggagugcaguggcaugaucuuggcucacugcaaccuucacauuuccagguucaugccauucuccugccucagccuccugaguagcugggacuacaggcacuugccaccacgccuggcuaauuuuuuuguauuuuuuaguagagaugggguuucaccauguucgccagcaucuucuugaucuccugaacuugugauccgcccaucucagccucccaaagugcugggauuacaagugugagccaccaggcccggccccaucuaugauuucuuucagcaauguuuuguaguucuccugguagaggucuucaacuccuugguuagguauauuccuaagguuuuuuuuuuuuuuuuuuuuuagcuauuauaaaaguguucuugauuugauucucaguuugguugcuguugguguauagaagagcuacugacuuguguacauuaaucuuguauccagaaacuuugcugaauucuuuuaucaguuuuaggagcuuucuggaggagucuuuaggauuuucaaggcaagcaaucauauuggcagcaaacagugacaaucugacuuccucuuuacugauuuggaugcccuuuauuucuuucucuugucugauugcuguggcuaggauuuccaguacuauguuguaaagaaguggugagaguggguaaccuugucauguuccaguucucagagggaaugcuuucaacuuuuccccauucaguauuauguuggcuguggguuugcuguagauggauuuuauuauauuaagguaugucccuuuaugccaauuuugcugaaaguuuuaaucauaaaggaauacuggguuuugucagaugcuuuuucugcaucugcaucuauugagaugaucaugugauuuuuguuuuuaauucucuuucugugguguaucacauuuauuuacuuguauacauuaaaccaucccugcaucccugguaugaaacccacuugaucaugguggauuaucuuuaugauauauuuuuggauuugguuagcuauuauuuuguuaaggauuuuagcauuuauguucaucaaggauaucugucuguaguuuucuuuuuugguuauguccuuuccugguuuugguguuagggugauucugacuucauagaaugaauuagggaggguuuuucuuuaucuucuguaauagugucaaaaggauugguaccaauucuuugaaugucugguagaauucugcugugaaucugucucgucuuggacuuuuuuuguugguaauuuuuaaauuaccacuucaaucucacugcuuguuguuggucuguugaggguaucuaauucuuccugauuuaagcuaggaggguuguauuuuuccaggaauuucuccaugucuuaaggguuuucuaguuuaugugcauaaaugugcucauaguagccuugaaugaucuuuuguauuucagugguguuacuuguaauaucuccuguuucguuucuuagugagguuauuuggauucucugucuucuuuucuugguuaaucuugcuaauggucuaucaauuuuauuuaacuuuucaaagaaaucagcuuuuuguuucauuuaucuuuuguauuuuuuuuuuguuucaauuucauuuaguucugcucugaucuugguuauuuccuuucuucugcugaguuuggguuucauuuuuuucuuguuucucuaguuccuugagguguguccuuagaaugucaguuugugcucuuucagucuuuucaaugagguguuuagggcuauaaauuuuccucuuagcauccccuuugcuguaucccagagguuuugguagguugugucguuacuguuguucuguuugaagaauuuuuaaauuuccaucuugauuuuguuuuugagccagugcucauucaggugcaguuuauuuaauuuccauguauuugcaugguuuugaaaguuccucuuggagauaauuuccaguuuuauuccacuguggucugagagagugccugauauaauuucaguuuucuuaaguuuauugauguuuguuuuauggccuauuauauggucuaucuuggagaaaguuccaugcgcuguugaacggaauguguauucugugguuguuggaugaaauauucuguauauaccuguuaaguccauuuguuccaggauauaguuuaaauccauuguuucuuuguugacuuucugucuugaugaccugucuagugcugucaguggaguacuaaagucucccacuauuauuguguugcugucuaucucauuucuuaggucuaguaguaauuguuugaucaauuugggaacucuaguaauaggcacauauauauguaggauuacaauauuuuccuguuggacaaugccuuuuaccauuauauaacgucccucuuugucucuuacaacugcuguugccuuaaaguuuguuuugucugauauaagaauagcuaccccugcuuacuuuugguguccauuugcaugaaaugccuuuuuccaccccuuaaguuuaugugaguccuuaugcguuaggugaaucuccugaaggcagcagaugguuggugaguuauuauccauucuguggaucuguaucuuuuagguggagcauuuaggucauuuacauucaauuuugguauugaaauaugagguacccuugcauucaucaugcucuuuguugccuguguacuuuuuuuguuuguuuguuuuuuguuuuugcuuuuuaacuuguauuuuugcuuuauagguccugugucauuuaugcuuuaaagagguucuauuuugauguguuuccaggauuuguuuuaagauuuagagcuccuuuuagcaguucuuguagugguggcuugguaauggugaauucucucagcauuuguuugucugaaaaggacuguaucuuuccuucauauaugaugcuuaguucagcuggauacaaaauucuuggcugacaauuguuuuguuugaggaggcugaagauagggucccaaucccuucuggcuuguaggguuucugcugagaaaucugcuguuaaucugauagguuuucuuuguagguaaccuggugcuucugucucacagcuuuuaagauucuuucuuucaucuuaacuuuggauagucugaugugccuaggugaagaucuuuuugccaugaauuuccuaaggguuguuugugcuucuuguauuuggauggcugggucucuagccaggucggggaaauuuuccucaauuacucccccaaauauguuuuccaaccuuuuagaauucucuucuuccucgggaacacugauuauucuuagguucaacauaaucccagacuucuuggaggcuuuguucauauuuucuuauucuuuuuucuuuaucuuuguuggauugcguuaauucaaagaccuugucuucgagcucugaauuucuuucuucuacuuguucaauucuauugcugagacuuuccagagcauuucacauuucuaaaaguguguccaaaguuucaagcucugaauuucuuucuucuacuuguucaauucuauugcugagacuuuccagagcauuccacauuucuaaaaguguguccaaaguuuccugaaguuuugauugcuuuuucuuuaugcaucuauuuccuugaauauuucuccucuuacuucuuguauuguuuuguggauuuucuugcauugggcucugccuuucucuggugcuuccccgauuagcuuaauaacuaaccuucugaauuauuuuucagguaaaucagggauuuuuucuugguuuggauccauugcuggugaacuagugugauuuuuuugggggguguugaaaagccauguguugucauauuaccgggguugguuuccugguucuuucucauuuguguaggcucugucagggggaauaucuagggcugaagacuguuguucagauucuuuugucccacaggguguucccuugauguaguacucuccccuuuuuccuauggauguggcuuccugugagcugaacugcagugauuguugucucuuuucugggucuggccacccaggcagucuacccagcucugggcugguaccagggguuaucugcacagaguccuucagugugaacuauuuaugggucucucagccauggauaccagcaccuguucugguggaggugaguuggggagggggugcaauggacuccgugaggguucuuagcguuggugguuuaaugcucugauuuugugcugguuggccuucugcaggagguagugcuuuccagagagcaucagcuguaguaguauggagagggcccaguggugggcagggcccuacaacucccaagauuauaugcccuuugucuuucgcuacuaggguggguagggaccgaccaccaggcggggguggggcuaggcaugucugggcucaggcuuuccuugggugggucuugcugcggcugcugugggggaugggggugagaguccuaggucacuggaguuguguaccuaggaggauuauggcugccucugcugagucaugcagguugucagagaaguagggaaagccagcagucacagcccucacccagcucccacacaaaccgaagggccugucucccucccaccgugccccugccaagagccccaagucuguuucugggcaugggcgagaggggcuuaaaaacuugccccaggcuaccuacuucccagcuaugaaagaaaagggcuugguuuuuccccucccucuggagccugcacaccggauuugcaccguccccgaguucuggccaggaggcuucucauccguucgaacuguuacaauguucagcuggagauuuccuucucccugugaaguuuuacccacugcuccucuggcugccuucccaauggaucccuguggugccagcaggaaugaccugcuugggaacccagugaguucccagugccuuucugcugcuuccucuaccccuguauuuugcucgacugucuaaauugacucagauccagguaaagucggaaacuucucccgcaacagaccuucacuuucucuaguggggguguguguucaggagaggagggucucccuuucccgcuucugcagcuggggcacucacaguacuuagggugccuccugagaccugcaggagcauuucacuuccuucacagagucuguggguccucucgggauugcugguuuguucuugcagucaaccuggagcuaaaauucacaaaugugagccuccacacgcugcucuguccagugcugcaaucucaaucuaguccugccucccauaugccaugaugauuggccuuagguauaaauguaagguucuuucaguuauuuucugagccugugucuuuucuggguaugugugaugacuuucuaauuuccccuacauagguguuagucuuugaauauccaagucuucacacugucuguauccuuaaaaagggaaaagaggaaaauaaggggggaaaaaggcacuggcccuuuuuaucccccagaagucacuucaguuggauaaggugggucuugcagcaaugggcaggguguacaacaauggccaccaccucuuugcaccugugacugggaucaguaaucaacaaucaacaaucaaagugcagacucccaauauuuggaggacaguucccuuuuucucacuuuggcucuugcaagcucugugcaagcugcuccagggacacaugcucagcuaugugccaugggccugggggugguggauggguagguacuacuguacuagagcuaaaauugaccaaaauuaacuguauuuuccuguccaacccuuauauugaaguugcaagccuucaauagaccccagaguuucaaaauaauugcaucaaacagauucugccaguagguaaaaguuuuguuuagcugggagacagauuuccuggugcuuccuacuccuucaucuccucuuuacccuauaucuguaaugcucuuuuuuaucccugacaauuuucuuuaacaauuuucuugauccacuuugucuaaaauuaauauagcuauuccagcuuuauuuucauugguguuagcaugguauauuuuucuacaucgcuauaccuuuaaucuguaucuugacauuuaaagugcauuucuuauacagaaaauauaguugggucuuguuuucuuacccauucugacagucugugugcuuuauuuuauuuuuaauuauuuuaauuuuaauuuuuuauuucaauaggcuuuuguggaauaggugguguuugguuuuguggauaaguuuuuuaguggugauuuaugagauuuuggugcacccauuacccuuuucaauuagugcauuuagaccauugauauuuaaaauaauuauugauguaguuggauaaauaucuacaauauuuauuaccuuuuccuauuugcugcucuuauucuuuguuucauuuuuggucuucuauucuuugccuucucuuguuuuaacugagcauuuuauagaauuccaucuuuucuucucucuuaguaugugaaucaauuuuuuuucuuuuucuuuuuuucuuuuugagauggagucucgcucugucgcccaggcuggagugcaguggcgcgaucuuggcucacugcaaccucugccucccagauucaagcaauucuccugccccagccucccaaguagcugggacuacaggcgugugccaccaugccuggcuaauuuuuuuguauuuuuaguagagacacgguuucaccguguuagccgggauggccucaaucuccugaccuugugaucugccugccucggccucccaaaguguuggccaggcuagucucgaaauccugaccucaagugauccaucugccuuggccucccaaaguguugggguuacaagcaugagccaccaugccuagucagauuuucuuucuuuacaucaaauauuacaagcauuuuuuucaggucauuauauauauuauauaaaaguauaauuuuguuaaaaaaagucgcauaguacucuauuauaucucuaucuuucccagcuaucucucucauauauacauauauguacacacauacauauaacauaaauaaauauaaauguaauuuauuuaauaggaauucacauauauguacauauauguauguauuuguauuuuauguauucauaaaauucauauuuuaugaacuccuauuaaauaaauuauauauuauuuuguguguguguguguguguguguguguguguguauagauauauccuaauauccuagcaauaagcuaguguuaaacaguugaguuuuuuuuuuuuuuuuuuuuuuugagacagagucucgcucuuucgcccaggccggagugcaguggcgcuaucucggcucacugcaaacuccaccucccagguucaugccauccuccugccucagccuccugaguagcugggacuacaggcgcccaccaccgcgcccagcuaauuuuuuguauuuuuaguagagacgggguuuuaccguguuagccaggauggucucgaucuccugaccucgugauccgcccgccuuggccucccaaagugcugugauuacaggcgugagccaccgugcccugccaucuuacuuacauuuuuuuuuuuuuuuuuuugagauggagucucacucugucacccaggcuggagugcagugaugugaucucagcucacugcaaccacugcuacuuagguucaagugauucuccugccucagccucccaaauagcuagaauuacagaugugcaccaccacaccuggcuaauuuuuguauuuuugguagagaugagguuucaccauguuggucagacuggucuuaaacuccugaccucaagugaucugccagccuuggccucccaaagugcugggauuauaggcauaagccacagcacccggccuacuuacauucuuucuuguaguaauuggugcacuuaaaaauuuuauucauuuacuuauuuacuuaucuauaauagcuuauguaaacaaaguaaauaaguaagauacauaaguggccaggugcgguggcucacaccuguaaucucagcacuuugggaggccaaggugggcggaucaugaggucaggagaucgagaccauccuggcuaacacggugaaaccccuucucuacugaaaauacaaaaacaaaauuagccgggcaugguggcagucaccuguagucccagcuacuugggaagcugagaugagagaauggccugaaccccgggaggcggagcuugcagugagcugagauggcaccacuucacuccagccugggcagcagagugagacuccgucucaaaaaaaaaaagauacguaaguaucuuauauaaguaagauaaguaaaugagaaaauuuacuuaucagaauuucuugggaaugauuuauagcccugaaauuacuuaaugaaagagauggguuuuuuuuccccaagacuuugauacauacucucacauucuacuucaaaaacauuguaccaauuuauaccaaaaguuucuuuauaaagaguuauuaaacauaaaagucauguuaaaauagugacuucuacugaaagaaauguaauggugaaauugcuggaagugccaaguaauacaggcacuaagaaaugacucauucauucauucauucauucauuugcuaagaggaaguaauuuacgauuuucuuaggaguuuauuuacuagagugucugugggugaaauucagauuccacugggcaaaugaggaaaugaaaaaugugggaauggauuccuuuauaaagaaguuugccugugaaggaaagaagaguaaauagugccauugcuggagcaaguugggccgagggagaugugcugagagagagauuuaucugugcaugugaaggagcugguggaggaggcagaagcacgaaagagaagacuacacauuucauuaagagaaacaaaaucaaauuuuauuuucuuugaggaagauggaaggaccaaauuaauaugccucuguuggaauuuugcccuaaagaccaaaauuccagaacauucugcugauagaagccacagaugugggccaauuguagguaucggaucagagaggagaaucacuuuuuugccguagacugccccaugcaccggcaccguaccagcccuggagguguguggcgagccauggucccuuuccucauggcaugguucuugguggggaagacagguauguucccaucuccacgccauuugaugagaacaaugcauauauacauggguagagggcgcaaauaaacuuccuagaggggauuuggaaagccuguugcugagagagaacacaggagcugugucaggggauauccaggcagguacuucugggcauggugccuuucuuguuggagggaagagggcugcagcguacagagaucagaaaagcacaggacauuccaggaaaugcaccuuguuuguugucuuuaacuggcagccaaaggauuguaaagcuggagagagucugggcccucauaggagagggguuggagccugagccuugucucacugcccagcugugcccuugugguuauaacugggcaugugcauaaugacuauaugcguccuucugggauguagccacauggucuucauuauauucucaaaggggcuguagaucccuuaaaauugaagacuugcugcugagggcaaggggcacauuuggcaggguuugaaccagaaaagcugaaucauugcccuuccaugaacaggcuuggggcuuguaauaaaguuuccccuuguuucucaggacagcuugcuucccuaaugagccagcuugauaaggucgggccacagagggcgaugccugcgaggcacuuacgugagcacagagggcuagucgaaggggcaaggaugcagaagagaagguugugcugggcucugccacugcaggaagacugugggcucuuugagauggaggccugaacuguccccuaccccuccuucccccugcacaaaugugauuaugccucugcagagcgccuggaaucagguuagcgucauugagcaaugcugagcuggaguaaucagagccuggagcggagcaggugcuggcuuuaaaguggcuucugagaauuaggacaggcugacuuguagcucagccccacguagacaagccacuuagaacacuguccuugcagcccccaggccuccuccuuaccacagcaaagugcuuggguuuguuggaggggccucuggcauggcccaggugcugagcucguuaacugauguucagggacuggugucccagggguccuguuugcccagcauguggcaggacaacaagagcuaaccaagccuggggucacauuuggucugcuccugccuaucuggguguccugggacaauuacccaccucuuggagccucacauaagucaacuguaaagugggaaucacgagcauaucuaacucauaaggugguggcaauuaaauaucauauaggaaaggcugucagcauuaggccugcugcagaguuagccgcaaagaacaucaccccuauucucaaccuaggccacugccaggacaaggccggguuuuauuguuucugcaaagauguuucauacucagaacaaaaaaaaucaguaauuacauaagaaucuaagaauaaagguuuauguuaaccaaaaucuuaagagaaaugcaguauuacuguuuggugaacaucacucuagauacucuucuaugcacacauuaauagagagaaaauaauuuuaauaagggcacauuuaauaaauuuuuaauaauagaaguuauuggcugggcaugguggcucuccccaguaaucccaacacuuugggagaccgaggugggugaaucaccugaggucagaaguuagagaccagccuagccaacauggugaaaccccgucucuacuaaaaauacaaaaaauuagcuggauguggugccuguaaucccagcuacucgggagacugaggcaggagaaucacuugaacccaggagguggagguugcagugagcugagaucgcaccacugcacuccagccucgacaaaaagagugaaacuccaucucaaaaaaaaaaaguuauugcauuuaguuuaguguuuaacugaagaaagucagaugaaacagaaggaauugcuaaacuagagauaugucauuucuaagauaugacucugggaguugagaaaauaaguuucaagcaauauuaauauuguuaagucauucuuuuucgcuauucucuuaaggauaaagauaaggcauucuaagacucucaugcucuacaaacugaguagccaggugucuuagacaaagugcuuuaacauucaauuauaugucaagaugaaauugcaaauagcagagaaaaacaacacacugacuucaauucccacuaaaugacuuaucuugccaaaaugaaacaaaugcggagaauuauugaugcuugacaugaggaggggacauccagagguuaagaaaggaugcugacagcaccaggagaaacauugagguaugcaagauguuagcccguuggcaccugauagaccgggcaggucuguaagugcaauacguugcuuuguagguaagaaaaauaaagcccagccaggugccaaugugacauggaguugggccuccagcccaggucucugugccccacauacaugguuuaacuaucuguauucacugugccuuuuuacuaucugugcuucugaugcugugacaccuuugggucuugcugacccuggagggacugcccuucucagggagagggguuuccuagagcucuuaaaggacucacuugcaaguucaccuuucuuuucuuuucuuuuuuauuauaaguucuaggguacaugugcacaacgugcagguuuguacauauguauacaugugccagguuggugugcugcacccauuaacucgucauuuacauuagguguaucuccuaaugcuaucccuccccacuccugccaccccaugacaggccccgguguguggaacucaaacaaauuuguaaaaaaaaagcaaauucaccuuugaaaugcaaaaucaucaguacagagcuccuaccccagcaucuccucuguggggcucucacacucugggcuacuauccuccugcccugaccacucaagggcuagguaccagacaucuagggacagccacugcuccaaaugugaccuggagcagaccaaaugcgaccccagagcccacugaaauuauucaaaccagccgauccuaauccugcucacccuugcccugccugguucuuccuguggaaaccacaacacaggcccuugccgcuguuuuucccccaccccucugcugcccaacugauccucgugcuuccccaugucccccuccccuuggggacugugaggaacaagcuguuuuuaauggcagucaucuccugacuuguugggcucaccauccugaacaagaagaaagccuacauuuaaacagacugccccuccugcgccugaggguagccccuugggggacugacucccuugggcauagcucagugacacagagagcccuuccagaguccagccaggaccuguuuugggcccacgccccgggguuuggcauggaaaacucuggucccugagcaggcaucgcucugucugagaaguaccuuguccagcccagccaccugugagaggagcagggcaaagcuggugagacgaaccuucugcaggcugacucugugcuaccugggcaugaacacuuugucucucucuaaaaggaaaaguugguuuccaggugaaaugcgaggcagucauaggugaaauggagccacaaaggucucgaacugggguucucacauacgaguuucugaccucucuaucuuuauccucaggacacauggcauugcuaagacuuuacagggggcucaauaaaggucacacaaauuuaauucuauuccacacucuugucgcaucugcaaagaaauuucauuaucuagacugcaugacauccauaaaucaauuaggcccuuugguuuuguaaacauaaugugcguuuugauccuuuggagagagcuguuucaauucagcaauagguuucagcaucuaugcaauguccagcaaagugcaaaugcucagcccaacacaaaacaaugagacagggucccuggcuuugggagcaucaugggucuggagggagagacagacauguguguggggacaacacagucaggcugugccagugcgaucguggcaccacaagguccucagagcucgggagaggccgcagugacucccagcccguauuuucuggguugugugacugacagcacucaaugcuuucucagaacaucccuuuuaaaauuauuuucaaugucagcaguguuuucucaugaccuccugaggauuuaauuaaucuuugggaacaguaucauucagaaagagaaaggcagcggauuaaagcugguaaaugauacucuugcucaaaauccuagugugacucuuaacugaugccaaagucuguucugaaagaagcauuccaugagugccuugggcagucugggcccugcuggagggagacucaucucuacugcgcuugcucugcucugugcauugcacauggguguaugcacacacacacgugcacacacacagacacacacacacccccccaaacuaggaaaaaaucccaggcuucugcuccauaguaguaacuauguucuuacauucucuauauauguauauauauacacacacauauauauauagaaaauaaaauauauacacuuguguauauuuuaauuauaacuuaauuauaaauuuaauuagauuauaauuaaauuaaaauguauauauggaauauaagaacauaguuacacuaauguuacauagaacguuaauuaaaauuuaacaaaaauauacacacauacauauauauguauauuuaauaaaguagaauauaguauauguauauuuacuaaaguagaauauagguaucauuguccaggugguagauugcuucaugucugccccaaggcacccuggaaaaucuuuugcaacuucccgguuucuaaccucagagcuuaguuuucugucugcaaaucuguuucucuuaaccuguuaugaugcuuucacccaaagauucaaugugcauccaugggcuuacguuuccauguagcagacauucauugggaucucggcucauggccccagguuggaccauggggcagcaguugcuuguguggagguuacagcggugacuggcaccuggggaauaaaaggcugucugcuuuuuacccucuagaugguugccacccuggggaccacaacaugcugcuccuuugacaaucucuuagaagucgguccuaucuguaaguauccgauuccauuuucuuuuuggaaaauguucucuguacacggggaauuuagcaaaccuuccucguugaucucuuucuugucguuaacuucauauugugaugguuugcccagcucuucucguauuugcaauaacacaaaccucauuagcuugaacuccacaaacucagaauuugggcuaauuggaaaagaacugagcuuaguucuaccaacacacuauuuguaagaaaaaaaauccgagcaauauagaaguuauguaaaauugcagguuauguuggcccuguugaggagaauaaacucuucaaaaucuuagaguaaccaccuucauaugugggucgugcauacaccugauaugagaauuguccacacuugaauuuaauucuuugguauaucccuuuuucaccuuuuuuuggaauuacugaaugcaguuaagaaaauugcugaagguaguuuagcaaaucaacacaaugaaacuggauuucgccaaggaauaaucugugcuucagauguuuuccuggucacucucaccuccucccuuccucauucagagauccuagguuuucucauugagacuaggaugcuguguuuucaaaaggugaaugugaaugagcagcucuguuucuagaguuucaccuuugacauguagcucugggaacucagcaggucuugaagcugcuucuguggacagaagaacccucguagggcagggacacuggcucagggggcucccccuuucucugucccucuaggaugggaauguucugaccgcucggcugugaguggagcugcccaaguggggccuucagaucacauaccuguggccugugccagaucccacaacagcuaccagggaauuggcuuccuccuuagucugcacaagccaagcacaguucucaccucuccuaacccaagagucacccauaguccauacucagaggaguggacccuccucuccugggcguuggccucccuucuuggggucagcagcuggggaaggccggugcugaaggugcaggugccuuugugugagcuagacaugaaauuggugacaaggaagcuagggugcagcccaggauccaccccugaaucuuacauucugagcuucauuuaugcugucuguaaagugaagagaaaaaccccacuugugcucauaaaauaacaagauuuccccacacgauuauucagaggauaaauuaaugcagggaaaaugcaccaucccaaagguagagugcauugcugcacagcaaggaaugcagugcugggaacuacugggagguggguggcauagacuuacccgcucucacaggguuuaugcuccaccguuuaugcucuguggcacacagcuguaagaacaacuggcgggaaguggucgugcacagccccgggcuggggagaagggauagaacuggcugacucaggacugcagccacagcauuggccucaucagcugcaaaccuucaucagcucagccaagcaacuuggaguccucugacucagaugucaggcuaagaacugaauguccuggccaguagcuggcugauguaauucccuagggcuaucggauuuaaagggccgaggucuucugcuggauagagcccacauggccugcuguccccugggccaagugugggcugcccgcuggaccauggagaugacagccagcgugugucaccugccagucacaguccccuggauggauccagcucaggccuuccugcuaucuggggcccccucuucuuuguagaggcuggaggcugugcacagagcuugauuuaugauuuguuugguuugaaacacugagguugcuuuugggguugugcagaaggagcugacaugggugaaugccaaaacccuuucauccauuggcagaaugcauaggggaggucaguuuugacaauuccuuuuuuuuucuuuauuuuugagauggagucuugcucuguggcccaggcuggaguggcacaaucucagcucacugcaacaucugccuccuggguucaagugauucuccugccucagcuuucugaguagcugggaucacaggcacaugccaucaugccuggcuaauuuuuguauuuuuauuagagaugggguuucaccauauuggccaggcuggucucagacuccugaccucagaugauaugcccgccucagccucccagugugauggaauuacaggcguaacccacuguguccggccaacauuuccauuuuuauugaugguguuauauuacuaacuguuggugguaccuuaacaauuaagucagcacccuuuuaccuacuuucccucuccugcuaccauuuuccuaucaccagauauuuagcauucuccaacuccaagcgggacuguucugagauccugagcugaccuuauucuauauaugauuagaauaaucuaacauaauucagauaaguuauucacccaccaucauuugacaaagaaaacaaaucagaagaugguuuucuuccaauugcugccuuaggaaagacauuuucuuuuuauugcauuugaaaugauuugccagugaggguauucagauuggucugcuuggauggaucaguugucuggcagguuuuacugagaagauggaauacaaaaaguggauaguugaagucaguuagguugccgauggggaaguggggaaacugaggacgaggguaugggcugaguuggggaggccaucucaaggugugaggaagggaauagcacagggcaggcagccaaagcugcauccugaggugccagcauaacugagagaggacgugcagcuggaggggcagccaggccugccgcaaguuccugggaagucucagaaggaaagagucacugacagcaggaagcuggaggggugugagccugucccaucccuccccacugaggcagccuugccucagggcuaggugugccccuggugcaugcaacuucucaagcucuggccgagggucucugugucugccugguuccuagaugggccgugcuaugcagugugugcuguuaguggaucacauaugagaugcagaaugcagaaugcagaggcaugcccacagcuccaugcauccccauggaaaccagagaagcccuucagaguccacuuccuuuaggggucuguaaguucccuucugcaggaguuguaggccaacugcaagcuuagagagaacacaguccuccacaaagcugauaaaagacauaaggcguuucaaagcuuugacucaguuuaaucaucaggaugaaagcccucaguuggauuaaggucaaguguguccugcggacacggauauccaccccagggcaugggaggccaaaggucacagagcaguguggaccugaaccgaggcuuaggggcucaucacuucccccagaaucagucucaccuggugcuugcauaaccccagauggaugcagcagugagccaggaagagcacaaggccuuaggauuugcagaguuucucccugaggagucacucaguaaucaugggauguccaugccuguagcucagaucagcgguaagguugagaaaaaccucagaucacaucauaagauagguguaaauuugaagcuugcuguagucugaacguuugugucccccgcaaagcccauuugcugaaauucuaaccuaaggugaugguauuggagguggggccuuccagugguaaugaggucagcacaguggagcccuccugauuggaacugugacuaauuagugccccugagagucucacgccucauugcacaaugagcaccauggauggugagugaacggugaauccauggaucccuacaaaugcauaugcugacccugacaccuaccccacgguacccugacacugguauccacccugugaggugaggguggcucgcgcccucucugugguccuucacccuucaacucuuacucuccugggugccuagggcugagaggcagcaaccauggaagccacauuuauuucuccccuacucagugcugggguccuggcaagcacauuguaaauauucccuugcucaucccuugggccuauggguacuauuucaucuccaucuuccugggaggagagugaggcuuggagaaguagauagggccccuuggcuggggagcaacuggaagcaggaguugagcccagaucugucaaaauugagggagcaugcuacaucuguggcucucccagcuccugaaugaggcagccccugcccacaaggcugcuaugcaugguuggaaaacagaacccuguucaugaagaaagcaggggauggucuaagaugguguaaaguaaagaacuucaccuggugguggggauggaguggggcagguagaggucagcguggacugugugcagaccuccccuuggaugauguuugggggaggacuugagaauggauuagcaaagggaaccaggaagggaauuccagguggguggaaaggguggugucacuggagagaaaugcaggugaguaacaugaggcugucacacgauggucccuuggaguuacacuuagccgccagggucaggagagaaaaccaaguggugcaguggcuuccauuuucccuggugugucuggggccagcagcacacacacugcccucagcuuuagacccuuugaaugagggggccuuuuggggauucagccauuaguucagcaaauacuguuggcaugcucuacccaagaaggugcucagacagggcgaggucagcuggcaggcuccguggugaggcauccaucuggggacucacaaguugauucugaacuuuaggcaacaaggaagacauauggcugcacguugaugcagccuacgcaggcagugcauucaucugcccugaguuccggcaccuucugaauggaguggagguaggugcacccuucgcucucccuaaggcuguuuucacagugcucuguuauugaccucucccuucaugaggagcugacguccagucucuugcuauugagguuuguuucagccaauuauguuugaaccaauuccgacuuccucagaauaggggcugagagccuuccccagccauacagccuguccuccugaaauacuccugacacuuacaguuccauuucaaucuacacaaaucccaaacagaaagaauaaauguuagcuuauaaaacugugggaaaguaggaacaaaauaaaaucuuaaugaacuuaaacucaaaagaguaauuuaaaauaccaacccgcaauuccauacaaucugguucaauaugacagucauguucugcccauacaucugaacaugauauucacuuuaaccaauauugaacgagaagcuaccaaugcauuuaaaugccccuaggcagucuucuggaaauuguaaagcaugaucuuuaaugcuaagugaaaugccugcuucuuuugagaaguagcaaucaaaauuauugaccagcacuccgcuucuccaaaaagcaacagaauguaaauugguacagacuuaacacaaaaaaaugaccuuauugauauacugugguguguuauuucagacucaagcgggauuucauuguuggugguggcucauaggguaggaagucucuucuccccaagaacucagcuuugaaugccauagaggguccugagaggcagucuuuggcaguguuuccaagagaaggagguagcaaagcaggggagcuguggcacuggccaagaaagaaaugcuuucugccaaggggcaggaggugucgugagaccucacccaugugugauggcagaugaagggcacaguccucugcauuagacuccuugguuugaauccuagauuuauccuuaagacuagcuguguacccuugggcgaguuagauauccucccuauccuccagaaaauagauuucauaagaauacauccggugugggauugucgccaggaguagaugaguuaaucauguuuuaagggcuuaaaaacagugccuggcagacaguaaauacugaaauugcauuaggugcuuuugugauuuucuacuacgucuuagaaaaacuuucccuugacagcuuccucugcuugcaugucagguuugcuaaucacuauucuaauuacaacuuugaauucucauaaugcuguaauaccagaaaagaggguaccagagguauagaauacaaauguccccaucuuuggaaagaauaauccucuuacuacuaaucaaugaaguaguauucugguuuaugucugcaucacaaucauucacucauucauucaauaauuacuuguugaguacuuaauacaaccuaggacuuacaugauggauccuuggggguaaauggagcuuccaaagaccuauguacgcacuggagagaggguauaguauaugagaaguucucauaaugugaugccaguacccagcugauauaguucauugccgguagcuaguuuggugcguguuuggugcugggaaacgaagaguaaaucucuguaucauauaaaugcauggcaugauggagauaaucuccauuauuugaaacaucuguccugggacaguuucaagggaggaagggcuaagcaguccucugggauuuaugugcccuccccacggcuggccugagcuugaugcucuuuucuaacucuggguaucagguuuaggguucgugaucuuuuccuaccacugcucuucuuuuccccaagaacugacaacuugagguuucaucuuucauagaagggugccucauugucagaccaccacagcaaugggcuuuccagccagauccuaucagcaacagacaggauuucaugcuguacaaugagucacugccauuuuucuugcauuauugcucccgacucuuuccaugcccagcugagggcugugcgucucaguggggcagauaaggaggcugcaauauccuguuguggcccugcccuuggagauaagagccuuucucuccgguuggcaggaggaaaauaucacugcuggguaaugagagaaguuuaaacagaucagccccauaggagggaacucauaagacuccuagcaaacagagcuccucuuuaaccuuuugucuccuuuuaucaacaaaugaaacuugcuguaauuuccuguccuuuucucaaaauuacuuuuauuaaaaccuagaaggaaaugaaccugggucuccagagcaguggaaaguugucauccaccaaccaaaugccucccaggacgccccccaggucccucaagcuucugcugccuccucggugcacaucccugaaaccaaguagacaggaggugcccuagggccuugggaagacugaaaaguuucccaguaggagagucggccagacuggcgccucacugcaacagccaccuuuauuucgguaucaauuaugaauccagccgcauggccaaaucccuggccauuaagguggacccuguuccuguucaccagucaggugauaaaccaggacaugcauuugaaaaagaaagcaccauuuaugacagcucagggaaaaugcagaguguccuccucugccacucuuggugguuuaaaccucuuauuuucuccuugaaaauaagguagccccuaacacugaugcaugcagccagagccgguuguucacaguuuuuacccaggaucuuccagcuacgggagccuguagcuguuaggaauacaaugaacuuuaaaaauaaaggagcuggucggggugcaguggcucacaccuguaaucccaguacuuugggaggcugaggcaagaggacggcuuaagcccaagaguucgagaucagccugggcaacguaaugagacacacugucucuacaaacaaaauuuuaaaaauuagcugugugugguggcacacgccuguagucccagcuacuuaggaagcuaaggcaggaggaucacuugagcuugggagguugaggcugcagugagcuguguucauguccagccugggcaacaaaguaagacccugucgcucaaaaaaaaaaaaagagagagaagcauuuagguaaaugaggagaauuguugauauguuacagcaaugcuggcaaaagaacccaucaauuaaaugaaaacuggguuuaccccuaucuacuguagauuaguaauaaaauuuccucuuucccacuguuuaucaugacacguguagucugagaacuuugcuagcucagcaaguggaaggaacuucaagcaugaaguauuccacaggccaaaucaguacaauuccuguacguugugcuugugaaggacaauucugauuuuuccaaauauuccaguaauuuaaaauauaauauggauacauuuuaugucacauuagauuauguaaauuugaaaaugcuuuucauuugggaauauaaacuuuuaauuuuaaaauucuuguuccauuuuaugagaguauaaucuagauauagcaaaacauacaaaucaacucuaaauacauauacccacccccauguacuuaccacccagaucaagaguagaacaauuccagcacuccagaagacuccccuacccacuacaaguuacuacuccccugggcaacccuaccuggccccuaccacuguggauuaguugugccauaaacuuuuauuaucauguauggggucuucuuuauaauuaaacauuuauaaagaaaauguuuucuuuuucuuacucuuguucuuuggcaguuugcagauucauucaacuuuaauccccacaaauggcuauuggugaauuuugacuguucugccaugugguaaguuucccugcucacagaugucaguugccuguccgaggugacagugaaagaagcuggcagggaagaugccagagccaaaggggugcaauagucacuuagcucacugcuugcugccuuuucugaacccuugauggaauuauugcuaauucuuagccucacuggaaacuuuuaucuagggaauaucauugcaacauacuggcauaagaaaugagaagccuaaaaaggacaauuuuuuauuugauuuauccagcauugacagaaaacaaaugcaaguacacacuucuaauucaguagcuuguguuuucauucuuagauucguaaccagucuuaguguaaugcuaaguuuaagcaaucugaguccaaaugcuuaaaaguauuugcuaaggccgggcacaguggcucacaccuguaaucccagcccuuugggaggccgaggcggguggaucaccugagguccggaguucaagaccagccuggccaacaugguaaaaccccgugucuacuaaaaauacaaaaaauuagcugggugugguagugcaugccuguaaucccagcuacucaggaggcugaggcaggagaaucgcuugaaccugggaggcagagguugcagugagccgagaucaugccacugcaauccagccuuggcgacaagacucugucucaaaaaaaaaaguauucgcgaaagaaaaauaauaguaaccauguuuccuaagaauuucccuggaaauucuuuucuuccucucuuuuuuuuuuuucgagacagugucucacucugucgcccggguuggagugcaguggugcgaucuuggcucaaaaucuuuucuuucuuucuuucuuuuuuuugagacagugucucauucugucgcccaggcuggagugcaguggugcaaucuuggcucacugcaagcuccgcuucccagguucaugccauucucgugccucagccucccgaguagcugggacaacaggcgccuaccacgcccggcuaauuuuuuguauuuuuaguagagacgagguuucaccguguuaggcaggauggucucgaucuccugaccucaugauccacccuccucggccucccaaaaugcugggauuacaggcguaagccacggugccuggccggaaauucuuaauaacagcaugauaauaccuuggugauauuuagaauaagaaaaagaacuaaagcauuaaagugggugauauuacaccaccuacacaauguuuaaagaaauaaugaugaugggcagugauacagggacacuagaaacuaguuucucuaaaguuuuaaaguaagaaguugauugauugaucauagggccaggaggauuugcaugaauuuuguacaguaugcaaaacugcaaaauuuuccaaauauucagaaggcuuugcaaaauuguucaguauguaauuaagugaauaacuuuucacuuuccuccuaagcaugaggaaagcagcuuuuauacaaaacaacuaaugucagcucucaagguuaccaaaauacccguuugaccuuuuccuguuuuuuuuuuuaaggcuaaccacauuucuaguccuuuacuuguauacaaaucaaauuauuuuuugucagucuuuuuccccaaacuucugcuauauaauuuuaaaaccaguugguaugugggcauuucagacuuaauuuugucugaaauaaguauuuaugaaagacauggccguuaugaaugugaguauucuuuuguauucuugugguuguguuuuucuguuucacccaagguggaacacagugaggacaguuugcaccgugugccagaggucccuuuauucgagggguaauuuugauugaaauguaaauccgcucugcugagguuuuuggucaguggggaaaauccucuaagguggcuggaguucggaaggaccaggcagagcauccacaggcucuggcgggaacaaguggcucucccuacaugcuuuuguuuugcaaggggcaggcguccucagaugccuuccacaaaggaagcccuagaaccacccuugagcagggcagggcugaugggcuguccggaggagggguucucgugcgcccugaggccguccucaaugccuggauagaacagugauaucagcaaggcuguuuagugacugcggauagguacauccaggcucccuucuaagucccuaaccucucguagcucucuggacccccacgacagcccuguguugagggacacagacauugccacgcucucuuuacagaugaggaaacugaagcggucagggaccagaaauauuuugggucccuaaucuuggaggcaaauauugacacacgauaagaaggaguguaaugaaugcggcguccugcccucagguccagacaaccagugcguauguuaaggcugaagaaaaccugcuuagucagugcgguggugagaaggaguugagccuuucgggacguggagugccugccgcagagcugaugccccgaggcugccgcagacgcugcagagcugaugccagcaaguuggcggcugugcgcucaucucucccggacaacucuuccccggcgcucgggguucaguucagccaccagccugugaggggaaauuugacaaaguggaggugauguagggaagagacacaggacacacagggaugaggccaggccauuuggaaaaggccauuuggaaaauuuccuuguagaaggaauuaaacguaagcccuaagacacaagagaggccugcggugucuggaagucugccacaagagaagggugaugggguuaguucccauccucuggagugggcgacagugguggggcagggugguugcaauacuugaggaaccucuuaccuuccuaugggcuugaaaggcuacaaaauauguuuuuaaauugcaauagagaaugugcucuuucucuccugagccggugcguucucgacagaacaagagucaaagaauuuggugagaugcuguguaccuggaaaaaucagaucucuccaaaacccaagguuuugucccaugacacuauaaaaauggcaugaauguugauagaugaaaucugaucuuugaaagauuuguguuuuaacacagaaauugcugaucuuuacuguuugggggcacugugccugcauuaguuggcuagggcuggcuuaacaaagugccauggacaagcggcuuaaacaagagaugauuuaucucaguccuagaggccagaggucugagauaaagccaucagcaggcugguuucuucugaggcuucucuccugggcuugcagauggcugucuucucccuguccucacauggucuuccuucuguuuaccuguguccaaauuuucucuucuuauaaggacaccagucacauuggauuagggccuguuaaccaaaaaguaucugagacaggucucaaucaauucagauguuuuauuuugcuaagcuuagggacauuccuggaagaauaaacauggaaucacagaaacagggugugcuuugugccuuuccccaaagaugauuuugaggccggcaguauuuaaaggggagggcaagcuggaggggaaagagggagggaauggucacauuacugaauccacguguugugagagaaaaggagcagguagaggaauagucaaugauauauuugucucacgcccaguaaaucagcucuuuauauaagauaaggugagcauagaguagcuaccuguagagauauuuaaccuuuuaucuguagcuuucugcuuaggaacaaaaggaaggguaucuucuugcaugaaagcauccagcuuauuuuuuuuccuuuggcauaguaaauugaggcaccaaguuuuuauuuuccguucacauuucuuccccuccccuuuuaaaaaaagucuucagaaaaugcauuuuagaagaaaaugcgucucuagucuugggguuuugucuggucucuugugacuaagacaguuuauuucuagacaggucccacgugguuaggaaagcucauuuuuagcagguuguaaagucucaugacccaugaaggaaaaaaauagguggaggaagagagagagaaacaaacaaacaaacaaacaaaaauaaagggagaacaauccuggaaaacugacauaaaccguauuacucugaagucccuaugucaguaggcagguaugaaagugauuuacguauauaaauagguuccuguuauuuucuuccaaaguugacguugucuagcuucaguuuacagggcuuuaagaaaagcauagcuuaauauuuagugauuucaaaucacgauuaaaaaggaaaagaaagaaggaaaaaaaacugacaacauuauuuuccagaauuguagccaggaaaaauuuuagaauucagcccaaauuguagaaaauaauaaaaacagacaaacauuaggcaaggcuagacucuaauuacagauguacuauaguuuauuuugaaacauaauuuuucucuuuccaguuccccaauuguauuaaauacaagauuauaauagggccaauuuauuuguaaaauaaguuuuaguucuauuaugauuggcuugauuauuuggauaaagugcagcaagaauaaucauuugccauauagguuugcucucucgcucuuuuuguuguuguuguuuuuaaauugguuuuguuggaaccuuuucauaaagaaucuaagauuuagagcuuuuguuguuguuguuguuguuguugagacagagccuugcucuguuguccaggcuggagugcaguggcaugaucucggcucaguggcaugaucucagcucacugcaaccuccaccucccagguucaagcgagucuccugccucagccuccugagcagcugggacuacaggagcgugccaccacgccugccuaauuuuuuguauuuuuaguagagauggaguuucaccauguuagccaggaugaucucgaucuccugaccucaugauccacccaccucagccucccaaagugcugaaauuacaggcaugggccacugugcccggcugauuuagaccuuuuuaaaagccucagucccagucaaggauuuuucugugccuauagauaccuguaugaauugguugaauuuuucuauuuucaaggucccaagagaacuugagguuccuagcccuguuagaaagugacauuuuuuacuuaccauaggucaggacccuguaaaggacaagguauggggccaguuuuucuaagaggcuuuuacuagcucuguaggucacccuuauuuucucaaggcaaucugaaaaugucauuccaaucaaagccuugguaaaauaaccaaugacagaacaggaucacacagaggccauuguaaaaucagucauucauuuagccaaagcgauaacucaaagauuucacaaccuuuauucuuugagagaagagacuuacuuuucuaaacaauaaacucuaauaaagacaguaugaggccaauuaaaucucucucaaauuuuauaaacaaaucuauuaaauuuuaaucaucuugaccaaaauauauaauuuccauaaaucauuuuauaaccuuuuauaauuuuuuaauuaaagaauggguuaaugucccaagaaaaccuuguuaaacuggcauagggacacagaugcuggucuugcaucaguguaccuuugauauuaguguuuaauuuauagagaaacuaagcuaauuuuaucugucaauauuagcucuuccaaucuauguguccaccucuucugugauacucugauagucccugggccuagagggguugaauaguuuuaauuucuggcccugugucucuugaacacaguuuauuuugauugucaucuucuccugggucugaagaugaggcuuuuaacugcugucaguguuuaagauuuagcuggacuugguaucuuuuuuagacccaggagucaaaguccuguaauaguacaaugacuuuagaagcaauacagaaaguuauauggauauaauaaccuuaauuuuuuaaaucucaguuuucguaggacuuuaauuaguuagacauaggaagagugcauccuguguuauaaguuuucuauuucauagaagaauuuagagaauaauauaggaagaaagcauuugcuuuaggcugcgugugguggcucaugccuguaaucccagcacuuugggaggccgaggugggaggauugcuugaggucaggacuucgagaccagccuggccaacauggugagaccuuaucucuacuacaaauacaaaaauuagccaggugugguggcacgugucuguaaucccagcuauccuggaggcugaggcacaagaauugcuggaaccugggaggcagaggcugcagugagcugagauggugccacugcacuccagccugggugacagagcaagacuccaucucaaaaacaaacaaacaaacaagcaaacaaagaaaaccauucaguuuagaucuuuaaguuaagauauauuuuuuaauuaggccacaacaucagucagaaccagaggggaaaaaguuaaaggagcugauaaaaaguugaaagaguuacuaucucgggcccucuugaaggggagagaaagcugaaaacagcgagaugaaauuaaaguugaaauuuugguuuaugaaaauuaaaaugucuuguaauuuuauuaagaauaaaccaguaccuuaagaaaauuuaguuguucuaacaauuuuuuuaguuuauuaguguauuuuuaauaucaaagcccaauuucuagaaagacuauuauaaauaauuuucuuuuaauuauggccaacuugaucacauaaauauuuuuucauaaauucucuuuuuauaaaccuuauuaugacuuacacaaaccauuuacugaauacuuggaguuucuguuuuaucccaaacauccucuuuuuuaaauaaccagugauuuuauuuuaggacaaaaaauauaucacacaacauuuuugucauguaaaauuguuuuccuuuuaaucuuucuuaccaaaaauaccacuuaauauuuauaacuuuuuuugcaucucuuuuauuuacuguuuccuuuuaccuuguuuuagaaacgaccuuuaaguaaucuuugaauuagacaaaaauuauuucuuuuuaauaagaaaacauuguuuuucagaaaaacauuuuccuauauuuuuuuuuaaauuggaaaugacccagacauuuaagcaauaucuauuauuuuguuuaauguuacuuuagauucuaaauuauaugucguuuuuuaacaagcauuuauucuauuauauuuaucuaauuaauuuuuuaauagauuacuuauaaaaacugauggucaucauuuaaaguuauuucccugcuaaccaauuuuauagccugcgaauuucagguguuuaccuauguaaaaaacuuaagguuaaauaaauguauuuguuuuuucuuuuugccaaauaauucaguauuaacuguuugcuauuaaaccaacaauauuaaaugccuuacuuaccaaaaguuacacaaagauaauucucuuuugggcugcauuuauggcuuuauaacccucauuccaaauauugacaccuuauaauauuuagcaaacauaaauauaaaacuacuugaccaauaaaucuaaacaauaauauguguugacaguacuuaagacuuucuaauuuuauuuggccaauaauuuuaaagccagcuuauuuauuaaaaguuaagucaugugaacuugaaaagcauuuggauuauuuacuaaauuuaugaguacuccuuuauuuuuaagccaauuugguaccuuguggccacaacacauaacaaaaugcauguauguauacauaaacacaccuaagcacacauaaacagucaugcaaauaaagauccuauagcuuuuacuucagaacucuagccaugauauaucaauacagacucaucaguuuacaaaaaaaaagauuaaauagaaacagugguuuuuaucucaacaccaguagaaagguccucuaaacuagaaaaauacauuuucuuaagcaaaaaacacauccucgcguguuuuauaaacuuuaccaaaaacacauccuacgauacacuacuaacccuaauucucccugaaaaaucaaggauuacuuaauuuaauauaauaugacuuuaaguguucaaauuacuggggacaguuuugagacuaacuuuaccaaauuaaucuuaccaaagauuacuaaaacuauaugaacugaaaagccucugagcuaguuucuauuagucugauaaaaacuuacuuuucuuuaggccaauuaauuagaacucuuucauauaauugguagcaaaauauuauuuccacaugacauaucugaacauauagacauaacagacccaggcagaggcagaucuuauauauuuaaaauuuuucauuugccuguuuucaaaaauguucuuuuuccuacuuaaacuauuaaaguugucuggagggaaagagggaggguaugguaauccacguguugcaagagaaaaggagcaggcaggggaauagucaauuauguauucaucucccacucaguaaaauagcacuuuacaacagauaagaugaacuuagaguaguuaccaguggagauauuuaaccuuuuagcuguagcucucuacuuaggaacaaaaggaaaggcaacuccuugcaugacuuagcuuuaagcuuaauuuuuccuuuuggcagagugaauuggggugucagguuuuuauuugccuuucaaaguccccaccauaugaccucauuuuacuaaaucaccucuuaaaggccuuaucuucaaauacagucagucauauucugagguccugggagguggagcuucaacaugugaaugaggaggaagggggacauaauuugguccauaacagcgcucacaagaaaucacuaguuaaagccauaagccucauaucuaaggauuuaaaccaggucagcuuauuuuaaacuccauaaucuuaaugaucaucuacuuacugauuuguuuauuugauagcuaugaaacuuauauuuucauuugaucucacuauacccaaacacccacaucccuguuuuuuccucauuuucuuaccaccaaaaacuuauuuucuucauuccacaguggauagucuucacauugccuugcugacacaguggccugugcuguaucugauaguaugcaaaccaagagugcaugcacgcaaagcaacauacguuuuacaaauacaaauacaaacaaaaagaugcacauagaacccacugggaucacuucuuauggauauagaagcuggagaaugagagcuguuuuuugguguaaaugagccaaaaucagggucacuuuuguucaagcuguuauugacuugguuuucacuguaaacacuggaaguagucucgaauuuuagcccaggauguacagccucagagcaaaagacaaguagguggaacacagcaucccuuccucuagacaccguuacauuaaaauggcaaucauuacaaguacagcaaguauacuucauaaugaauucauuauucuguucauaagcuuuuuagggacuauauuauuaucccaucuaagaggcaggauccacugaucaugcuuggucgagguuggcuuccccugccuguuugcgaauggugccuuguaacguggagacagggaguggggagagugagggcugagaaucucuacucagaggcuuuuucacacuguccagauaucaugaaauaaaaauaaauauuuugacagucuaagagaagauuacaguaacgugaucuaccuuaacacaauagaacacagauaauaaggacacuuguaagaaccagaauucacaaaaggacaaauauuccucuagauuccuaagaguuuaaacuaagcaaaaaaauccuaaguggugaauuuuuaaagugucuuuuaaaauuucacuaauucaguaaacaacauauaaauggauuuuuuauugcuuucacugguuucuuuguauucuuuaaaauuagaaguguuucucuuuuguuuaaugaaauuuuacuaaugguuaguccauaauuuaacauaaacacuuugguuguacucuuuaaauacugaaauagacaaaauaauugaaguuucugaaacuggcaaucauuauaagcacaguaaauacauuuuauaaugaaauaauuauucuguucauaagcuucuuauuguucauuugauauucugaaucuuuuaucuguaaaugugagccauucuguccagagcuuauugccucuuuaauaucagaucuccaaagaaagacucaaauuccauacacacgaaaggcauauauuauccacauuuaaaagauggccuguuuuuuuuucccaaaauguuaaauuuugccacaaauuauuuuauaguguuuguacacuucuguugcauugggagguuuuuaaaaauucuauuucucugaaacaguuuuaaucauucuaguaaucguugagacuugauucuagaacuuguuuuaaaagucuuaguggauaguuuucuauuuaucuauuuggauucuuugcacuuagaucugggaacccuuuauuaucuugaauuuuuuauggauguuauugggaccaggaggucaugugagugcucauucagugagcacuauguaguguuguagauuuuuuaaaaaagaaaacguaaggagccaggcuuucaacccaacacaaggguccuuuuccugauccccuaggaaugugucugguuacagagagaggcuuuccucaccaaaagucucaugcaggugaggucaccaugugaggugacuuuggugccacaaaagcauguuucucugugugugugugugcccauguauguccucaaguacacauacacaucuguuuccauaaaauucuuucucuuuauaauauccauuaaaucuuaacaagaaaugcaaauuuaguaccuaaauauugaagaggcgacuaccacaggcccauuagaaacaugggccaaugaauaaaguauaaugggaagcugcaaauacugagaauugaacaaaaagaaacaugcaaccaaacuugccacacacagcuaaagcagcaccuacaaaacagacaucaauugaaaagaggaaagccagaaaaucauaagcuaaguaucaaaauuaagcuagaaagcagcaacaaaauaaaccuccaaaaaguaaaaggaagaaagcaauaagaauuaagaaauguaacaaaauacacaaaaaagacccaacagagaggaucgacaaagccagauguugguaguuggccugccuaauuacauaaacgaucucuggaaagauaggucaaaaauaaagaaaacacagauuaacuuguaguagaaaauacaauggcacaauuacagauacuucagagauuuccgaaaauaguaagggagcauuaugaguaacaucaugccaagaauugcccauaaacacauauauucaauaacuacaacaaaacaugauaccaaaacugacucaagaguaaauagaaaaccugaaaaaucuuauuguuaauacaacaugucaauaguaaaauuuucuuacagcagaaauacccaaauuauuauucuuuuuuuuuuuuugagauggaaucuugcucugucgcccaggcuggagugcaguagcgcgaucuuggcucacugcaagcuccaccucccagguucacaccauucuccugccucagccuccccagcagcugggacuacaggugcccgccgccaugcccagcuaauuuuuuuuguauuuuuaguagagacgggguuucacugugcuagccaggauggucucgaucuccugaccucgugauccucccgccucggccucccaaagugcugggauuacaggugugagccacugcacauggccagaaauacccaaauucuuaaauaaugaguauccuaaacugcaggaaacuuaucaguccaauccuaaguauaauucacagagagcagcaaaagaggccacacugccucuuauaucuugaagccagucuaaauuugauucuaaaaccagaugagaagcugagacagaaaagcuauaaacaaucucacaaacuuaaauguaaaaauucuaugucaaacauuagcaaauaaaauccaaugagauuuuaaaaaauauaguauaccauguccaaacuguguuuaaucuggauauggcaggaugguuuaauaguagaagauuuuuaaagugcuagucaccauguuaacagagaaggagaaaaaaaguuaucauauuagaugcagaaaaagcauuagauaaaagucaacaacauuucaggacaaaaugucuuaguaaaaucggaacagcagagaacuucuuaaucugauaaaagguaacuaccaaaaaacauagugaaccuuuacuuaauggugaaauauuagaagcacucccuuuaaaaucagaaaaaaaugaggauucccauaaucugcacuucuauucaacacuggacuuuccuaaccuccauaauaauuuaaaaaaaaaaagauaaagaaguaaacauguaaggaucaguauggaagacauaaaacucucauugucagaugauguaaccucaauaaaaagagaauccucaaaguauuauuaauaaaagaacccagcaagaugucuagauacacuaacauuuuuaagguugcauuuuuuuacaucuacauuaaacaguauguguaauuuuuacaaagguaacacucuuuauaauagcaagaaaagauauguuuacuaugaacaaacauauccaaaccuguucagauuuauauggagaaaauucuauaauuuuuuggaagucauuaaagaaguccuaaguaggaugauauguucauaaagaagacucgauauuagaccucagcacaauucuaauaaauauccuggcauaauauuuauaugggccaagaauagccaagauaauugugaaaaaaaauauagugaggaaguugccuccuuaaauaucaacguguguguguaaaguaaccacgacugaacucauguagcaccagcgcgggcacagauggguagagcacauuagaagagagagccagaaacagacuccacauauuccaauuagggcuucuaauguuuacagaauuguugcaauccaauaugacaagauaagcaaucuaacagaaaaaugaacaaaaaauucuuuaucaaggaggaaacagauaugcuuaauaaauacaaaguuacucacccuccuuaguaaucagaaauguaaauugaaaucccaguaaaacacuauagguuguuuacaauagucucuucauacuaaacguugaccaggauauggaagaggagcucgcagacugcagaacuguuguggagacugauuuggagcuauugaauacggccguagauagaugcuuuccuccaaccuuaacauagcucaccuugugcuauuccauuggcagaugcauggccgacgggcgcugccacuaggggcuccaggaguaugcacagggauggucccauguccacaucaguguaguuugucuaucaauaaaugggaaaugauagaaugaauggauugggauaugugcaugcacuaaaaucccaggaggucauacaaaugagugagcaagagcccugcgcaugaaugaaugugaaacucauaggucuauuuugggguaagaaagcaaauuauagaaacaugcauggaauuauaaaauuuaagauaauacaucuuaaguuuaugguacaguauguuuagcagugugcaaaauaauauagauugcuuagggauuuggagagaaaauuuuguagaacuauguaagaguaggaacacaaauucagccuuguggccucuugugugggacagggagaggaaguaggugagggacaggaauauuuaacuuuuauuaauacuuauaauuuaaguuuuauuucauaagcaggggguggugauuuauucuuuacaucuuuuguauggcuuuaauuagugcaaaauuuuuuaaauuaaaaaacagcuggaaggccccugcugagaaugagaagggaaagugugaucuuuguggacaaagggcagaguucuacugauagccauaaauauucacaucccucuugguccccucuuuuuaagucuaggcacagagcuuucucuaaugcagagagacccaaaggaccuccccccacaaccaguggcuccccauaaaaugccuaugaugcaagaaaauuccuauacacacaaaaaauuaggugcaauuuucuuccacaagucaaagaaagaauauacacuagacagcuuauuauuccuacugacuuugucugucuuuaaccuuaaaacaaaaauaaaggcucaaugaccauuuauagauaaauccagccucucucucaccuccuugguaagccacaucucagcauccuauuuugugcucacuggguucugucuuucagggacucucacguuuuauuuguuuucaagccuaagcuacugucagauuaacauuucuucucuaguuugcccuuaggauacuuuauuugcuacaaaauugcuuugugauggugucaccacacugccaaugaagcagagcaauggcaauuaccguaaagcacaggcccuucaaaggccagcccagugagaguuugcguccgaguucugcagaaugacuaccagugugagugcucugugugcagacaggugaaagaggaccccugucugcagcccagggcauccuggccuucucacucauuagcccuugggauuuucaccccacacacacuuacugaugccagcagggccagucacugugcugucccuggaaagagagagaggagcaaaugcuaaccucugugguuuucccucuugacaccaauucuccaacucugcagacaccagcuggguguccuaaacucacuccuauucugacuguaacuaccuagagguagcgucagacuccacaggguuaagggcucagucccaucagccggcccccacuucaaaugccaguuacaguguugggucuccagguuacccacaguucuguccaccguggcuacaaacucagggggguucccauaacccuugccccagguucaguaacuuacuagaacaacucacagaauucaaaaaagcauuuuacuuagguuuacagguuauaaagaguacaaacaaagaaaugcaauggcaaaguacaaguggggugguaggucacguggcuuccaugcccucucuguguaugccaccaucccagcaucaugaagcauuuaccaacccagagcucuccaauccugccacuuaggaguuuuuaacggaguuucauucaguagggaugauugcuuaaaucacuggccaacucaucuccagcccccuacccucccuggagauuggaagccaucgaggagaccccagcugccagcuaucuuauuaacaugcaaaaugaacccuuaucacuaggagaucucaaggguuuuaggagcugugugccaggaacugguaacaaagaccaaauauuuauuuuuuauucuaagacgcccuccccagguacuuggagcagagacagggccgugcaggcagagugguguucagggcagggcugggagcaggugccugagcugaggcagguggggagaggggagaggugguccagucuaggguacuugguuaucagcccuuucauuuguucucuaaaaccagggugaaaaagagaacagacuuaacgggagccuuuagacuggaccccacuuaccugaagcacagccaucaggauucagguaagcugugagccugcuuucuguggacuguuucuggucuuguuccccucagagcugcccuggaggucccugggaguuaggggaagaccauccauauccaaggaggcuuucacagagaagacggggugcugugcauuccuggauuugcccuuguagcccacucccuguggguugguuaagaggcuuggggaggcucccugggggaggcuccugcucuagaagcacugagaaccugcugggcucauugcaggagcaggggcaggugggcacagccaugggauuuuaauaugggcaugcauaccaccugcagauaaggaaacgucuuuaacauaaugacagccauaaugucuacaaaaaggcuuugcaucaccuuccaccaauaccaugagggggcaaaguaaaugaagaagguugaguaggguuggugagggaagagaaaauaagaugaagccaaggcucagaucagcacacaaaggugcaccuaagucauuuggucaguaggccugcucucugugccuggcgcuggugacagccaaggaggcucagcacccaccugcaacgucuagcagggaggggaugagugggcaguuaucgaguggcaucaggggacacaggcugcucuggggccacagcacggaaugcacaauucuuggcuuuugcacuucaccuaugucgucucauuugacuugggccaguguaucuggcuaauuaaugguaggcguugaacuagaaccaaaauaaauagaauuuuuuugauaacugaaaauucugucacaacgcuggugaggagguaaagugguuacacuagucauguaggcuuugaagauguauuccuuauuauuaaagauguacauuuggaaaauagagucaacgcugggccagaaaauuccuguaaucccaccacucaaaugcaaauauugcuaauauauugcuguauuucuuaccagucuuguucaaugcauuguucgcuuuaacucugcaccacuuaccaauuaccaauauacaagcugcccuucccacauguaccucaugaaguuuuacaucuuaugaggcacauaagaccuauuaaguaguccacaguucaaguaaaaccauugucagaggaaacuacuggcuaagagguuugucauuucuuuauguuaacaguaaagaauugugcaaggaagcuucuaacugggccaguucuuuacucguccauaaggaagcagauucacggagaagcagauaggaacuugcacuaauuagacaccguaucugaauucuucuacugaaagccuccaguuuuucuuuccuguagaaguuucugcaaugagggaaauuuauaauucugcaccacccaauauggcagccaccaguccgcauguggcuacugagugcuugaaacguggcucaucuguugaagaacuaaaguuuaauuuccuuuaguuuuaauuaacuuaaauuuaaacgucaacagccacauguggcuacuagcuaccguaucagauggugcgguaauagaaacuaaaaaggugggccauucccucauuuucauucaugacaaucaucugguucuuugacaauuuuuuuuuuuugagacaggguuuggcucugucacccaagcuggaaugcaguggugcaaccuuggcucucugcagccuccaccucccaggcucaagugauccucccacuucagccuuccaaguagcugggaccacagacguacagcacaaggcccagauaauuuuuuguauuuuuuuuuuuuuuugguagagacgggguuucaccauguugccaaagcuagucuugaacuccugagcucaagcgauuugccugccuuggccucucaaagugcugggauuacaggugugagccaccacgccuggcgucgacaauuucuuacugagugcuuucugcaugcacucuguugaguguuguuguuucauuugcagugguuucugugaaucauugccagaugcugcuauugauguuauguuuguuuaacaagcucccuuacuaaugagaggccaugugucguaaaggagaguacuguguauggguugagauaggcuguaugacuuugggcuuccaucucagggucacucauaaaacaggggguggaggucuugcaucuccucccagcacugccauuuuuuaugcuaguggagaaaauaacuauuagggaaugauaccaaguggugacuucagauguucuuguaaauacaauguaggcacuccugugcaguggaugaagugcaggguggggcguggguuguauuagguggacagcuugucccagcugagcauggucagggccugcuauggcccugccacagccccuguugacugcggaaguaggggacacugaugugccugguccagcccacauucguggaucuacucccagagcacaagacucccuuuuccaccgaucugugcagcaggacugcagcauguugucauaauccucaccugaugucuugugcaggaucacuuguauuaauagaaacucccgucucugagccugcauucaggguuccuucuccuuuauuguccugggguuugcugcuuuaggcaugaggggaggcucaaaagcaaaucauccauuuuucauaaccaauguggagccaaugauuccuggauguuaaaacugacucagcagauauucacugagugucugcucugucccagauacugaacuaagaucugcuaagauccacggauacagagaugaauaaucccaccaagaguuucauucuccuuuuuaaaauauucuaaucacuccguauaucacaaauucaccuucccaugcaugaaugaaugaaugaugaacgauuuacgugaucugaaugcuaacucucuacugggcacuagaugaaaccucagauguucaugcuauguaacugcagaaagcaaaacuaaugggggucuauugagaguguaacauuuccaauuuguguuuugggcauccuguucucgggacacacccuuagaauauguuacccugggaagugccgcaaagaacacccagacccagccuuugggcaguuuuauuucuggcuuagaagacacaagaaauuuaccuggaaaaugaaaaggauuagcgugugaucaacaaaccugucuaacgauuucuuuuuucuuuuucuuucucuuuucuccagggcuuaucacugacuaccggguaagugggagauuccacuguaaucucaaaugcuaguggagugcuggggggcuacgccacagcugucacacaucuccucccccacucucaugaucagcacgcacuggugggcaccuucuaacuggguccuaacugacaaauuagggggguccugccagguggcgggcagcucugcugaaccccucagucagaggucucagguuaggagggggaaaccuggacccuggacuuugcuccuggggaggagaaaggagcuucugccccucauuccucuggaaggaaaaggcccuucugcccugggcugcugugugccuggggcugcacuggugguggcagugggagagugagggaggagucagggaacagaaaaagcucccagguggggccagucaucucagcagccuagucucaaaugcauugguccucucucguuuuuauuugaaacaaguguugaaugaggcauacuuugaaaaugccagguuguucuaguguuagucuggaaaggaauuugggaccaaaggcaguacugcgaagcuuaucaaaagaauagaacccaagggggagggugaaacucagggggaacagagguguggccacugagcuggcugucuucugccaucaagagaugaccuguggccaggugcuguggcucacuccuguaaucccagcacuuugagaggcugagguggguggaucaucugaggucaggucuucgagaccagccuggccaacauggugaaaccccaucugugcuaaaaauacaaaaauuagcugggugugguggcaggcaccuguaaucccagcuaccccggaggcugaggcaggagaaucauuggaaccugggaggcagagguugcagugagccgagaucaugccacugcacuccagccugggugacagagugaaacucugucucaaaaaaaaaaaaaaugaccuguguccacguguggugggcaccagacaucaucaaagcagaggcugccauuucccgacagaggugugugucuaagugcguuuggagcaaacauugucagcagccggugugauaaugacccagcaggggcuuccccucaaaggcauggguagcuugccuucuuccugugacagcugugagccaggaggcaggggggcagcaguaaaccuucccaagccaucaaggcugguccuaggacaguuuuggcaaaguuugccugggaccacccagcucuacacccagggagaaaggccagggugugugcacauaagggcacacugggaagauccauggaugaugccauuuaaaacuuucauauaaucccauugucaaucugacuuaucuuuuggaaaguuauuauugaagggaaaauaugacaauaauauuaaaaauaaccugaggaccagcucacccugaccuuucauccucgcgccucuguggccuguguuucugucuccuccucugguucguggccuuucucagacuucauguugcaugagggccacgugcuguacaaacgacauugcagcugguucucauggcacugaaacuaaaauugcaauaccuucuccacuccuccacagccuuaguaaguacagaaaaucuacacagaaucccauguuauaugguauaauuauuucccuguuauuuaacuacuucccugggaaagucccuugcuuuccuaaaugacuaugcagugggcaucuggcacauccagcuuucugcugaggaugagcugcuuccugcagcaugagacugaaaaugggguaacaggcacgaacacuucaugccuuuuauuuuauuauuuuuuaauuuugcucuuucccagcuuagauaucauuagaaaaaaaggcacaacaccaucucugguucacauaaaauaacauaggcuuugcuaaaaacuccguauugacuaacaaguccucugggaaccaaaguccuuuuagauaaacuuggcacugucuuucaaaggccuggggcacaauccccagcaaugcuggcuuauguuacauugcccaagacaaaaaccagcccagcucugcccgcaucuagcagcucagggaacaugaucuccucagacaguuucuaccguucaccaagaaucacagaucuguacuggcacccgccugcaggaccacgaagguggcagggcuugccugaggcuuccccagccuguucuucugcuccauccagggccuuccaguccucagggcucacuccuucuucccaacccuagguucuucauccuacucccuccaccaccagucccugacccucauggggucuuucuguccccuucugucuuuagugcugagccucacucuccucagcaccucaggcccuuuccgcacugcuaauccagaagacuugagcccaccauucacccugccuugauaggccaagcauucuuugaaaagcguuuguccuucuguuacuucaacuaguuaucucuacuaguuaucucuacuagcuuaaugaaaggcauuggccucgguuaaggaaaggucaagcaucagcaaccugugcuccagcccuacuuucaaagcauccuuugaucagccccuguacuccccacccuguugguccugcugugagaccugggucucuuucaccccaucucaaggcagccccuugacuggcacucccuuuccaaccaggagcuaugagcugcuccugcagcuacucagaggugagugaggcccaaagccaccuccaagacucccaggccacugagggagacagaggcgcagaccacgcaggcccugaugccuguucugaaacacaccugagacaccucgauccuccagccugcccuuuguggcccaagaggacaugccccaaguccuuagcuaguccucugccugccagcucuccucuugccgcuuguggcaggcaaugaugcugagaucccuggcacuauggcuggcagugcaugagucaggagccauguggggacaguccuuguuuggcugccuguugcuucuaaaggaacccaggcagaugggaagcaccacagcagcccagucccacuggcauccauccaccaggcuugggaggcucucuggggugauuggccuucugugcugcuguguuccuagagagggcuggagauggcacaucauguguucacagccaauguuucauggcugaugaggggacaaacgcaugaaccuuaugaaagauggaaugcagaaggugaaagcuguucuggagcagaggggcuucuaaaugcgaagcacaggcauuaggccucagcauaccagccccaggaagcaggaguggccauguggggacagccccgggcagccaccgggaaagcacacacaaguuggccgggugugaguaugggagcagccucagggcccuggugugcagagcccccagggcaccucucagcccagcuuugcucuuucuaucccuugggugcaggcacaagugucacugccucuuacugaacccucuccaucugccacaacccagggaugucccuggccguauuucccggcaucuucucuuugcugcuauuuuagcuacaaugcagugaccucuuucccucucugugcucacaugcaccucucaggcuccucuaugauucccaccuugaaugugaauuccaggcaaauguccccagagcauuugcuuugcugggcucagcagggaaugggaaggaauaucauagacauucucauuuuguucaaagaggcuggaaacccaaaccuaaggcggucuggggagaagauccaucagucuggggagaagaucccuggauggugggcugccuacugggccagugagaaaguguggggugaaaaggaugagcagacccugguaguucuaucccccgucaguagaugagggcacgaggacagaguguuagucccaggaggaggcuguucaggacgcgagguauggcaagagagcucuguguucuuucugauggugaacggcacacugaagauguaagacagcaccauuugccuccaguuugcacgguccuggguaaagugggcaucauuaugccuguuucauaggggaggagacagagguucagaaaaguuugcugaaccuauugaaagacaggaccacggaccuaggucacaagccacugagccaugcagcccugcaugcuauuuggaugaggaaacugcaucuucuggaagauguugauggcuuaucaaaaaugggacaaaauacagguuuaaaaaugaucaauuguggaggaaaaaguaccaggaaauagaucauuugauguccgggaagcaucaaauaugaauugacuucuacauaaagaauccuuucagaugacccaugaaugagggucaaauggguuuuacuccugauuuauuuaaguacguccaucaacaaucuuccacaaaaugugggcuggccgcgccaugccaagccaggugcugggcuuggggcugggacuaaaaaggcaaaugagacagagucccuuuccucugggaacuuagucuggcaggaggugaggcuggguacacaggggucacagcugucuacugcaggcacccaggagcauauugggggaggggacagugcaucgaauucagucucuggagagaacaugacaacauuuggagccacauuugagugagcauucaauuagauugugugcauuuucacuccgggaccacagaaauuaaguuuaccuugguauucuuccaaauguuagacugaaaucuaacauuuuaauuuguaggaaguugaccagucgaggaaugauuuuggaacacagcgcccaugcugaaccauggcagggaagcgucguuuuacugacuguuagauagucagucagcuaguggugggauaagggguucuucuuuuagauuucccaaaagacaaguuagcuuaguucuugagcagcccaacagcuugcaaacagugcugaccagcagacaacugugugugcagguucggcucaggcucugcugcaugcuggcuuggugacauugggcaagucacucuccauaccugcuuuugcuccaagaaaguggggauccgaacccuuguuuacagugcugcuaggaagcucaaaggagauaaugugucaacacaccgggcagggccuggugugcaacuggggggaaccacacugaaugccugagucagagguugggucccuguuucccuuuugacuugagaagcuccugcagaaccauggcucugggcccuugagcuacuucucuuguguucagaagcaguugccaccuguucauuccacccacacuuuauuuuauuuauuuauuuauuuugagauggagucuuacucuauugcccaggcuugagugcaauagcgccaucuuggcucacugcaaccuccgccuccuggguccugccucagcuucccaaguagaugggauuacaggcaugugccaccauaccaggcuaauuuuuguauuuuuaguagagagaggguuucaucauguuggucaggcuggucucaaacucccgaccucaggugauccaccugccuuggccucccaaagugcugggguuacaggcgugagccaccgcauccggccuucacccacacuuuaaaaaacaccugcaagcccuccuacuggggagcagugcgggacucaggacuccggcuaagcagucccacccggcagauggcccagcugcgcuagagugucgcgccuggcugcacugugucacccaggcccaguagggagcuggcucagcucuccucagugucuccuuuauagcugaaauagaauaugacuguuaagaugaccacacagugcugcuaugcucacuucccagcagucuccucgucccaguccuuccuuacucacuucaccacaucuccaucccucagugugugggggccggucaacugacugggucugggaaaaccagaggaaggacagggaaagcuucuggagcaccagcauggagacacacauugugucuucugaugaggggucuuggggucacuccauggugaucaguaggaccaagagggaaccaguauugcucuagaaaacagugccagaacaucuggggcagaaguggcagacaagagcagguucuggcucccuccuuccucguaggcaaggacaucaaugaaaauuacccccuuauccccacuggauggugagcucacugggggcagggccgugucuucccuguuugcucaccacggaacccuaggggacagcccaaggucuggcccugcugugcaugccgcaaacaccuguugagugaaaacaaugaacaucacuggcucccaggucaacaguccccaucuguguuccuuucucuuggagauuugcaaagaaagccucugcccacaucaccgagggcccugccauccaagacaggccauggcaaugggagcagguuggccaccagggaaucggcugccuccaagagaaauaggcgagccggugagccgaaaaggaagccagcuuuuaauaucuuccucacugauggucuguuucauguuucauuucagcauuggcagauaccacugggcagaagauuucgcucuuugaaaaugugguuuguauuuaggauguauggagucaaaggacugcaggcuuauauccgcaaggugacuuuguuuuuauuauuuaucacgguaaaauugcggaggucuuucgggacuuuagaaauaaauucaaauuuuuuuucuuuuuuuuuuuuugagacagaguuucacucuugucccccaggcuggagugcaauggcacaaucucagcucacugcaaccucugccuccuggguucaagcgaaucuccugccuuagccuccugaguagcuaggauuacaggcaugcgccaucaugcccagcuaauuuuuguauuuuaaguagagauuggguuucaccauguuggucaggcugaucuugaacuccuggcuucaggugauccacccaccucagccucucaaagugcugggauuacaggugugagccacugcaccuggccuucaaaugucuuaauaagcaaauacauggcaagagaaccagacuguaguuuggguuguugagaugagguuauuuauaagaucuguuaagucacuuucguuaagauugcagguuaucagguccaggaagauggucacaguagaaacaucacauagguugugcuuuagccacaucuagccaagaaugaaguucauugagcaauggcaauuaugagaacauaaggacuguguuuuucucccccaaaauugccagaauaagauagauauucccuaguccagugguucucagacaugcuuccagaccagcagugccggccugcaguggggcccagcaaccucuguuuuaacaagcaaaccagacaccuucucuaugcacuaaaauuugagaaccacuuaucagcuccaagccccacuccccugcuuuuuuuuuuuuuuuuuuuuuuaaaauaacaauuggcugggugugguggcucacgcauguaaucccggcacuuugggaggccgaggugggcagaucaugaagucaggaguucuagaccagccuggccaacauagugaaaccuugucucuacuaaaaaaaaaauacaaaaaauuagccaggcaugguggcaggcaccuguaaucccagcuacucgggaggcugaggcagaagaaucacuugaaccugggaggcagagguugcaaugagcagagauugugccacugcacuaaagccugagugacaaagcaagacuccgucucaccaaaaaaaaaaaaaaaaaaaaaaaugaggaaacugaguccugaauaugagccuggaucugccuagagccacccguuuagccagcugcagaaggccugcugcuguucugcuggcucucucugauccugguguccuuccuaagcuguggccucaucuugauggacagagguccccaggcuucaugggaacaagcacacuuaugauauucagccuuagugaugguaacagcccuccauuuuaaguccuguugccacuucacaaccaggugugcaggggcagguguccccagccaccuccucuguggcacagcauauauaaacacauccaucugcaagcuucauagaaugccuaggaugugccaugaacugccuacucccaaagcuucggugaggacaguuccaggagcugccgagcacuaugaggaccuguuugggggcgagaacugggaaaggaguauguauaugaauuccuggguaggaaaucccccucuacccauuugagacgaauucagcuuuuuuggggaaagaaagccaaaaaauaagggauuuaucuccccacaaugaugacgucuuuaagcucaaggacaacuaguuaugaucaugcuggcuccuguuuaaaacacacuccacuucuuucuuaaaggggacccaauccugccuuaggagcagaguccagcgaugcucaaagccugucuccuugggcgggaaccggcuuucgggaucgcccaugaggccgaggucuuuggcgcucucugguggcaugacgaggaaccacucguaugacacguguuuuugucccagccacccccugcccgcgaggcgccgcguuuccgcagguccuccccagcaccugcaacaugggggcccugcuguauccgcgggcuuagaaugagcaaggcacgggccuacgccacggagggcuccuucuccuaggaucacaugcugucugaauagcuucugaguucuauaacuauuuggaagugaaauaaggucagugugauauucaaugagaggaaggccguuucugaaugugacagagcggacaggaugcccagcucuagguggcaaacgcggaggaggagcaacagcuguggcagccacagagcugcagcuccaucaggcugccuuagaauccuagcucagccaaggccuccgggugcaccuugggcaugucgcucacccucucccagccuguuuucuuaucuccaaaauggggauaaucaugauaucuucuguguugugggcuguccugaggaugccgcaguggugagcgcuggcaccucaagcacagaggagcaacucgaugggcauuagccauugucucuuccagaaugaucaaauaccuccucacgguguuuauucuaacauuauaaaagacaguuugggugggauaagaauagucccaugaacagaagaaaaugacaauugguguucugaggacacuagaccugugcuaauguagggaaugaguuucuuagccugccuggaaacagcuggucagugaacgguaaaagcacuugaggaaaauugccaagagcgucuaaaugaauuauacaugggcagucuaauaagguuuucuagguaguuaaguucugaauuaaauggccaugagaaaaacagauuuucccuuuccucuuugaagcauguccagcugucccaugaguuugagucacuggugcgccaggauccccgcuuugaaaucuguguggaagucauucuggggcuugucugcuuucggcuaaagguuugucuacaucuauuccauucuucauuuucugugaaugugacagaggggaaaguguuguucauuaccuccaugcucaaacacuggcacuggcucuccagagauggcagagcaaagccugcauucuuuggcccaccggccugcccugccccaugcuacacagccuuguuuccacgcacagcggcuguucccgcuuccucaagccugccaugagacuucuaacuuacauagcuuauuggccgcagaaucuuuaccauuuuuccuuccucaaggcuccaucccacaccucugccacuggcccuccuuggaggacagcggccuguccauagccucacuaaucugagugucuucuguggaucaacagcaucagcaucaucagcauugucugggagcuccuuagaaaagccagucuugggccccacccuagagcugcuggcugcgcaccuuuacaagaugcccacacaggagucuguuugacacuguguuguggcgugcuguuauuuugcugccugaugcugugcauucaccaggugagggcaggcuggcccacacggguuggggcauaagccaucucuacugagaaucaugauacaguucucaaaaaggcucuaagaugcacugcacacaugccccuugguaaucucccuuguguacacagagccaggugagaccaaaugcucuguuugguuuauaagguuuuuuuuuuuuuuuuuuuuuuuucuuuuuggagacagagucucccacucuguugcccaggcuggagugcagugguguaaucucggcucacugcaaccucugccucccggguucaagugauucuccugcuucagccuuuugaguagcugggauuacaggugugcgccaccacgcccagcuaauuuuuguauuuuuagagaugggguuucaccauguuggucaggcuggucucgaacuucugaccucgugauccacccgccucagccucucaaagugcugggauuacaggcgugagccacugcgcccggcugagguagcuuuuaauucacaaucauuucaagccuuuccaggaggcuuccuuguucaaauuaaagacagcacucaggagaaggagcaggcuggggucagugucauugucaaggggcugccagucagaguguggcacugccacuccaccuacuauguccuuuugccucaccugacucuuggagcucugaggcgaggaggagcugcagccgugggaaagccugcagguagcagagcaggagaggagacuugagcccuuggaagagcacaaagugaugagaccugggaggugcacagaggaccgagagggcaagacacgcucuggauguuugugggaggagccucaguccauccauguccaggauguguccagucaaccaaccuuaguguuggcaucgugcuuauuagacucaucugcugucaagcaguuguuuucauucuuguuuuuguugacaguuuucuucuaggacuuuuauauucuauuuuuuuaacaguucuauugagauauaauucacuuuguucauuuaaaguuaacauuugggcugggcgugguggcucacgccuguaaucccagcauuuugggaggccgaggaggccagaucacuugaggucaggaguucgagaacagccugaccaacauggugaaaccucgucucuacuacaaauacaaaaauuagucaggagugguggcacaugcuuguaaucccagcuacucgggaggcugaggcaggagaaccacauugaaccugggaggcggagguugcagugagcugagauugugcuacugcgcuccagccugggcgacagagcaagacucugucucaaaaaaaaaggcuacguuugaguauuuuuaguauaucuacagaauugugcagccaucaccacaaucuaauucuagaacauuuucaucccccuaaaagaaaccccacacccagucaugccacuuuccccauccucagggcuacuaaucuguuuucugucucuguagguuugucuauucuggacauuuguauaaaugaaaacauacaacauauugccuuuuaugacuguuuucuucacuuagcauaaugucgucaagguuauggcuuuuauuuuauuugcauaauuuguagaugccaccaaacccaucuguguacugguuucuguccauucuucucucaugccauauagugaguccucucaugaaggaaguccaaggcauuuuucagcugacaaauguuuccuuuuguaaaacuuugcuugugccuccagucugcaaauccaguuucuggaggaagcgcguuagucaaacacuguggcucacuuuucugccuccauaucugccaucuuggccucacucucuccuggucuaauccucucuaaucugaauuucagguccucucaugcugaaugcuucagugugucauguggcucuuuacuaaagcagaagugauguugcuauggcaucacggucccucucccuccauccucauuauggccagaacuugcuuggucuccaucugugugcacucagccuacuuuguucauuguaauugucccaccucugcuaggcuucuugccucuacuucauggaaguacugcccuauccagucuguuugaaaauggcaagcacauuuuuccuaaauaauuugcuuccauuuucugugcucuauacuuugcagauguuugcucucauacugagucuuuuugguaaaauuccauucccuugguaugauaauuucuuuuuuucucuauccucauccuugaguccucauccagauucacccagccuugguguucacccacgguuuccaaauuuccucuggcccaucacugucuaccugggcacaacaggagcagggcacucaggcccauagcuagaggccaggggauuugcacagcucuauggccaggugccaacauccagcaggugcucgucugaggugguuccaugcaguggauagaacucucuccuucccacucauccucccugcuucuccacucugaagacagggccacgaagugcaguccugugagguuugggugacuaggaugcagugucccacauucaguuccuucuauuuaagacuccauggcuuagaagacauggagucacugccugcaaacagaagaaggacagaggagcaaagggagauggaggugaagugucagaagaccggcugcuauggaagcagggcccaggcaggacagcaagggcuucccauuggcuuauugauaccaggcuuccaacucuaguguagugggagggguggggccucugcgccuaccccaggcuggugggccgugcuugucuggagaggcaccagugguugcucgguccugugguucauggacauucuucucagauucuagcacuagcuugaccguuaugcuucauuuucuagguugcugagacucuucuauguuuccgugagaauuuagagacuccuccccuggugccaucagaaaccccaauucugcuguuuaagcucauauauuuguagauuacauauccagggauccuuauuuuccuuaaaaaaacuuagaccauggaagggucaucuuuugauggcacaucagaauauagagaaauugucuguggggagaagaugcaugcagucuuuuagggugcauuacuauuauuuuguugaauuuuguaacaucguaaacgcaagggggaugguuagucggcuucuuccugauguacgguaggguugccaagcacugucuuuccuacaugaccaguugauuuuugaguccucagagaccugagcacaguuccucucuuucaaucccuccaggguuccaacaaagugaaugaagcucuucugcaaagaauaaacagugccaaaaaaauccacuugguuccaugucaccucagggacaaguuuguccugcgcuuugccaucuguucucgcacgguggaaucugcccaugugcagcgggccugggaacacaucaaagagcuggcggccgacgugcugcgagcagagagggaguaggagugaagccagcugcagguaggcugcccugggcucauuuucugccugucuccuugucccguggcaagaguguccuccuggaguccagacccagcuacaggcccagcccggccacucaaugcugccagagugcauuucccucaccuuaaaauaaggaagagaaggccgggugcgguggcucacgccuguaaucccagcacuuugggaggccagggugggcagaucaugaggucaagagauugagaccauccuggccaaaguggugaaacccugucucuacuaaaaauacaaaaauuagcugggcgugguggcaugcaccuguaaucccagcuauuccagaggcugaggcaggagaaucgcaugaaccugggaggcggagguugccgugagccgagaucgcgccacugcguuacagccuggcgauaaugcaggacucaguccaaaaaaaaaaaaaaaaaaaaacaagaagaagagaaaaccauguuaauucuggagaaguagaaggaaugauacauuguaauaauucuuuuaaaacuuagauuuuuacuuuuuauucuuacaucaaucucuauaauacuucagguuucuucaaacagcauuuguugagauaacuuacuaucauaacaagcucauauaagaaacuggugaccuuuagagaacuaaugaaaacaauaaaaagggaauuuauuaugacucacgacuugccguccaaauucuugaugguuugaagaaaggauauguuucgacuaccgggcuucuugcaguugugagggguuuaccccucauaguuaaacccuggagacagcaugcaguuaauuuguaaaaacaaagcacacauuuuaaauaaaugcaguguuggcaacauggaggguauuuaaaauuauguuugugggaaccuagacaaccuuagaaagccucuucauuagguuaucuuaagaaugucauccuguugggguaugucuaccuuuuucuguuuauuuucuuuuuuuuuuuuuuuuuuuuuugucuuuuugucccauuugguggaagaaucugugaucccuccuuagggucugcuucucuuucucucucucccuauccuuuuugcaauggcucguucauuauaacccgugggggauuuagaaucuguggaucauguaaugcauuuccugauugccuacaauuuuuaucuucuuugcuguugauuuuaauugugaauaucugaaaaaguauagugcucaacaagucagaaguugaaaaucauguuugguauaugugauagaccuguccauggcuccugaaaguugaagccaaagggcuaccuucugagucaaaaugugcccugagaaccagguccuuucccuggugcaaccagggccuuccccuacucauaagcugagaaagaccuggggucugaggaagaacugcugacccagagcaacuccaaagugguaucucaagcaucucuggaagguaguggggagaggcuuauauguugaaguuauuccauugcucucagcauaagacuaugugaggggagggaaaguaccgcuguaagcucuguaugaaacaaaucccuaucaggcaaacgcucccgacucgcauuucugcaaccccacguuugcaucugucucauaagcauguaucauaucaggaucuuauugacauacgcccagaagaacauauguggagaguguagcucugaaaauuuaucagcaaagguguguuuccgauaggagucucaguuccucuggagucauuauauuugcuguagauucaaaagguaaaaaugaaauucaauuuuuaaaaagauaugugauacaauaguaaguccuaaugcauguauguuguuuuggacagauuagaacaauaaaaaucuuaauaucuugauuuuacuuguacuuauuugaguuuauuacacauauucauguggucauagcucugagagaaaguaggaacuauucuuauuuuacagaggguagaaaauuaggcagagauucuaguugacacuaauacaguuuucaucagagaagccagauuggcaauaaaaauuccuuuauuuaaguucaaacucuuuggcauugcacaauugucucuguuucauuggagaaauuauacguucguucuuuauauucaaauaagaaguacaugcaauucuuauucuuuauuuuuuuaauuuuuauuuauuuauuuauuuuuuuuuuuauugaucauucuuggguguuucucacagagggggauuuggcagggucauaggacaauaguggagggagggucagcagauaaacaagugaacaaaggucucugguuuuccuaugcagaggacccugcggccuuccgcaguguuugugucccuggguacuugagauuagggaguggugaugacucuuaacgagcaugcugccuucaagcaucuguuuaacaaagcacaucuugcaccacccuuaauccauuuaacccugaguggacacagcacauguuucagagagcacaggguuggggguagggucacugaucaacaggaucacgaggcagaagaauuuuucuuaguacagaacaaaaugaaaagucuccugugucuaccucuuucuacacagacauggcaaccauccgauuucucaauccuuuccccgccuuuccccccuuucuguuccacaaaaccgccauugucaucauggcccguucucaaugagcuguuggguacaccucccagacggggugguggcugggcagaggggcuccucacuucccaguaggggcggccgggcagaggcgccccucaccuccuggaccggguggcuggccggacggggcggcuggccgggcagggggcugacccccccaccuuccucccggauggggcggcuggccgggcggggggcugacccucccaccuccuuccuggacggggcggcuggccgggcagaggggcuccucacuucccaguaggggcggccgggcagaggcgccccucaccucccggacggggcggcaggcugggccaggggcugaccccccaccucccucccggacggggcggcuggccgggccaggggcugacccccccaccuccuucccggacggggcggcuggccaggcagaggggcuccucacuucccaguaggggcggccgggcagaggugccccucaccucccggauggggcggcuggccgggcggggggcugaccccccccaccuccuucccggacggggcagcuggccgggcagaggggauccucacuucccaguaggggcagccgggcagaggcgccccucaccucccagauggggcggcuggccgggcagggggcugacccccccaccucccuccuggauggggcggcuggccgggcggggggcugacccccccaccucccucccggacggggcggcuggccgggccgggggcugauucccccaccucccucccggacggggcggcuggccuggcgggggcugacccccaccucccucccggaugggguggcugccgggcagagacgcuccucacuucccagacggggugguugccaggcggagggucuccucacuucucagacggggcagcugggcagagacgcuccucaccucccagacggggucgcggccggguagaggcgcuccucacaucccagacggggcggcggggcagaggcgcuccccacaucucagacaaugggcggccgggcagagacgcuccucacuuccuagaugggauggcggccgggaagaggcgcuccucacuuccuagauaggauggcggccgggcagagacgcuccucacuuuccagacuggguagccaggcagaggggcuccucacgucccagacgaugggcggccaggcagagacgcuccgcacuucccaaccgggguggcggccgggcagaggcuguaaucucggcacuuugggaggccaaggcaggcggcugggagguggagguuguagcgagccgagaucacuccacugcacuccagccugggcaccauugagcacugagugaaccagacuccgucugcaaucccggcaccucgggaggccgaggcuggcggaucacucgcaguuuggagcuggagaccagcccggccaacacagcgaaaccccgucuccaccaaaaaaauacgaaaaccagucaggcgugguggugcgcgccugcaaucgcaggcacucggcaggcugaggcaggagaaucaggcagggaggcugcagugagccgagauggcagcaguacaguccagcuucggcugggcaucagugggagaccguggaaagagagggagagggagaccguggggagagggagaggggggagagggagagggaaagggagagggagagggagagggagagggacuucuuuauuuuuuuuaauguagccauaugcucaugcuauuuuuuuucccuguaggaaucaaaaauugaagagagauauaucugaaaacuggaauaagaagcaaauaaauaucauccugccuucauggaacucagcugucuguggcuucccaugucuuucuccaaaguuauccagaggguugugauuuugucugcuuaguaucucaucaacaaagaaauauuauuugcuaauuaaaaaguuaaucuucauggccauagcuuuuauucauuagcugugauuuuuguugauuaaaacauuauagauuuucauguucuugcagucaucagaagugguaggaaagccucacugauauauuuuccagggcaaucaauguucacgcaacuugaaauuauaucuguggucuucaaauugucuuuugucauguggcuaaaugccuaauaaacaauucaagugaaauacuaa

SEQ ID NO: 192882 - RNA, 37027 nt, Homo sapiens
uaaaaauguaaaagaucagcugggugugguggcucacaccuguaaucccagcacuuugggaggcugagguggguggaucacgagaucaggaauucaagaccagcguggccaacauggugaaacccugucucuacuaaaaauacaaaaauuagcugagcaugauggugcacacuguaaucccagcuacucagcaggcuguggcaggagaaucacuugaacccaggagguagagguugcagugagccgagaucgcgccagugcacuccauccugggcaacagaacaagacuccaacucgaaaaaaaaaucaauaaaaauguaaaagaucauucuuagcuuggaggcuauaaaaaaggaugcagcaugucagauuuggcccauuagcugcaguuuccugaccucuaucuaccucaauugguucuuuacuuacauuacauggaaagugcaaacuuggauggcuucaaugucuggcuucuuuuauuuauuuauuuauuuauuuauuuauuuauuuauuuauuuuuugagacggggucucgcuguggcccgggcuggagugcaguggcacgaucucugcucacugcaagcuccaccuccuggguucacaccauucuccugccucagccucccgaauagcuggaacuacaggugcacgccaccacgcuuggcuaauuuuuuauauuuuuaguagagacgggguuucacuguguuaguuagccaggauggucucgaucuccugaccucaugauccgcccaucucggccucccaaagugcugggauuacaggugugagccaccgugcccggcuggcuggcuucuuuuuacccuucacaucuggcuuuaaauacuaccuuuucacagauuucuucucuaaucacucuuucuaaaguaaauaugcuguuuuucauuauuagucauugcauccuauuucuuucccuuuaauuuucuuaucacaauguauaauuauauguuuuuuuuuuuuuuugguuauugccugucucccucaauagaucauaaguuccauuugauaagguacaaugucuguugguuuauuagccagugccuaacacuaccauuuaauauguauucaaugaauauuuguuaaauguauugauugaauuuaaagugacuacucagccuacuucugccccuuggagcuuggauuguuucuucaaagguauugauccuuuugacuauuuuaauuaugaauucacuaaagacaucuggaaggcuuauugugucaagcagugccaaauccauggcuugaugaaccuagauccauccccuuccccuuuccauaucacagaugacaacuugaugguuggccuaugacuuguaaaaguugucauauuugaauucugaaauuucucuaauuuucuugggaagcagaaaggaaaaauuaguaguuggccucaaagggacaguugaauuucacauauaaugagcaaaguagugugaggaagagaggagggccuuuucuuuugaggucauaacuaaaaguuaggugagcaaaugccauaagcaugaaaauagcaaaccaagcuucuugguuucuauccaaaggcuuuguugggaaaaguaucaaaguguguucauuuguuauguaauauauaagguagagaacccaauuugaaggagguggaauaacuuuccaaaauacuuauggcuaaauucucaguugaucuuggaauaagauucaagaauccaaaugcacccuucuuuguuaucuugcuagaaaacaugcugggcaugguggcucaugccuguaaucccaacacguugagaggccgaggugggcagaucacgagaucaggaguuggagaccagccugaucaacauggugaagccccgucucuacuaaaaauacaaaaauuagccagacauaguggcacgcaccuauaauccgugcuacucaggagguaggcaggagaauugcuggaacccgggagguggaguuugcagugagccaagaucacaccacugcaauccagccugggugacagagcgagacucugucucaaaaaaaaaagaaaagaaaaaagaaaagaaagaaaaaagggaagggaaggaaaggggggaggggagggaagggaagggaagggaagguaagggaagggaagggaagggaagggaaaagggaaaacaaugugcuuuuacccacagcugauaagcuuuucuaauugucuaccuuuggguuaaacuuuaucauugaguguuuuuaucccauuaugaaagaauuaagguuugaaggacugagguaaggguggauauuuacucuuaauugaguagcuuaaccaagucaagccacagauuagcugaagccaaaaagcacuggcagcauuugaaauaacugagaacauauuauacuuaacacuuuauuaucuaagagaggcacuugaaguugagaccuagaaauuugauucuggguucuuuguuucuaaggggcagggugaacccagcuauagcauucacagaugcuauagaauuauauauauucuauauauaauuauauauauuacauucauauuaauauauguuaauauauucuauauuauucauauagaauucacagauaauccaagugcuuuuuuaauacauugauaccaaaucucuccugcucucaaaaaaaaaagcccaaggcaaaaauuuuugauuagccuguauccgcaaauucauagugcauggcaugauggguacucuacaucccuccuccuauugcacucacugugcccagaugaaccuaaagucaccaguaauagugcuaauguaguaaugggcccaagcuucaaaagaaggaaaauuaguauucaguauuuaaaugugggaaagaggaagaauauggaaauuaucaauuuuauaauaccuauacauauucuuaccugcauuaaugugaauagacaucaaugauaaacagaauaaugccccauaaagaugucuacacuguaaucuccaaaacuuauaacuauacuauaucacauggcaagagggaauuaagguuacuaaucagcugaccuugagaugggagauucuccugguuuguaugggugggcccaauguaaucacaggguccuuauaaauggaaaaggcagacaggagauucagugucagacugauacaaugagggaaagacuaccagcaguugauggcuuugaagauagaagaagggggccaugagccaagaaaugugaguagccucuagaagcugaaaaaggcaagaaaacggauucuucccuagaaucuccagaaaugcagcccugccaacauggugauuuuaacucaaugagaugcauuuuagacuucugacaucuagaauuguguuauuuucagcccucaaguuugugguaauuuguuacagcagcauuaagaaaauguacaaugaccaugugcagugccucaugcuuguaaucccagcacuuugggaggccaagguggguggaucgcuugaguccaagaguucgagaccagccugggaaacauggugaaaccuugucucuacaaaaacacaaaaauuagccuggugugguuguguggaccuguagucccagcuacucuggaggcugaggugggaggauggcuuaaacccauaagguggagauuacaaugagccaagaucaugccacugcacuccagccuggacaguagagccagaacuucucucaaaaaaauaaaaaagaaagaaacuauacaaugcuccugugauucuagugcuauguacauauauccuuuauagggaauuaaggagguuauagacacaaccagaagaggaggcauggaauagacuaauguauaauggauaggaaaguguaucuuuuacaacuucucuguaaaaacaccuucaccuacuuuaugaguuugccucagcugccauaacaaaauaucagaccaaguggcuuaaauaacaauuuauuuucucacaguucuggaggcuagaagucuaagaugaaagugccagcaaguuugauuucuggugaagucucucuuccuugcuugccaauggccgcuuucucacugugucuucaaauguccuuccucugaguaugugaggagagagagguuugaugccucuucaccuucuuauaaggacaccaguccuacuggauuagggcuccacccuuaugaccucauuuaaccuuaauuaccuccuuaaagguucuaucuccaaauacagucacauuuggagucagaccuacaacauaugaauuuugagaggacacaauucagucuauaacaccuagauggaaggcaauuucauauaaagaugauaugcagucuaugacagcaaaguagcuaguggaaaucacaaccccuaauucuauuuuuaugucauucccuaaguccaggucccauguggauauagcauuguucagggcuaucucuuugcuguucuuuuuuuuuuuuuagacucacacaagcaauguggagaaggaacaugaaaacaucuuugagauagagcuuaauacagaugucaaucucuuuguaaauaagcaauuaaaaguggaaccacuguccaccaugugagaagagugacuggcuauggcuggauauuuuuaaauacacauaaaaugugguauaaaugguagaaugccagggauagaaggaguaucuuauaaguuaccuagucaacguucuggcuucugggcagaaaacuaucuaaacucagccagauaaucaguuucaacuaaaucaggaaaacauggaaucaucuuuaucuagguaguguuauaguuacauugccucauuuaucuacacaucaauaaauucuuucucauugcuaauauuuaucauucuuaucauaguauaagcaaauguuuuaauucuauuaugguaaagauaaagcuucuguaauuaaaacacuuuaaucuggaaagacagcaguaaacccuucaagcaaaagcccaaguagguucaaaaauaauagccagagagguuaaagguaaaccaauagagugauauguuacagcaacuaagggagagaggcaggaguuuuuuaaaagagagaagaggaauuauaacaacagaaacagguuagccagcugccaguuuagaugagcauaaugagucccuuagauagaucauuggugauuuuuaucaaaacacuaucgguggaguugugggagugguaggcugacuauaguggauuggggaauuaaauagugaugaacccaaaacagaaagucugaagaaauucccuuugagccaaaaaaaaaaaaggccgggugcaguggcucacacccauaaucccagcacuuugggaggccgaggugggaggaucaccugaggucaggaguucaagacaagccuggccaacauggugacucuacuaaacauugucucuacuaaaagauacaaaaauuagccggaagugguggcaggcaacuuaaucccagcuacuugggaggcagaggcaggagaauuguuugaacccgggagguggagguugcacugagcugagaucgagccauugcacucaaaccugggggacaagagggagacuucucuaaaaaaaaaaaauucccuuugagcaucucuacuguagagaugaaauaagagagaaguggauucuuuaguauagagauggaaagguauggagcuagaacauguggguugugaacaguggcuaacuaaaccaggaccaguaaccuagauaucacauugggcuuaauugcuggguuauucauucauucaggcaacauguauuuguugagagccugaaugugccagguaauagaaacacaaaggugguuaaaauagaccuuggccucugucuucaggaagcuuccagucugaagagggaugaagacauauauuaaucaaacaaucccacaaaugcagguauaaucugcauaaacugacaaauauaucuacuuuggagucaagaaauuaagagaaaucacugaugugaucagugaacaaguaagauuuauuaggaagauggaaggaugacauuacuucaaauauauuacaggaaaccccaaccaugguaacaacaucaggccuaucuuuacauauguuuaauaaugcuuaacuucacuuuugcuccuauccuccccaaagcaaucuucaaguucuucuguaucuuuguuuuauuuucuuuguucuuuuuugucucauuuccuauacuguuuuuauuccauacuuugacaguucagugaacuccuuugauagaucccaaguccuccuuuuucaauauuuacacuuauaaucauuuuugaucacuccaaaacugagaacuuugaguguagauuuucuaggcuucuuauuuuauuuuuagacauuauauagaaaaauuagagggaagggaaaagaaggauggcaacaugguaacugggacaguguucaaaaggucuaaguccuacuucucacuccauacaaauuaucugcaauuuuuuuauuuuugagacaggcucuuaucucucaccugggcuagagugcaguggcacaaucauagcucacuauaaccuugaacuccagggcucaagggauccuuccauuucggccucccgaguaguuaggacuacaggugugugccacuacacacagcuaguuuuuaauuuuuuuuuauuuucauagacacagggucucacuauguugcucaaacuggucuugaacuccuggccccaagcaauccuccugccuuggccucccaaaguucuagaauuguuacaggaaagaggucccaauccaggcccaaagagauuuuauuuauguacuaguguggagccuagccuaggacacaucaagcagaagugcagauaaggucugacucuuuccaguacagcuagggugccuggcucuccacauguccccagaccuuaucuagaaucuaaugucuccaagguagguacauugaauaauuuucaaaagucaaggaagcaguuuaugaccuuaaaguaguuagcaaacuuaauaucugaccugacuaauuuagaccaaauguuuacauuuuugaagauauuuuuauuuuaucaguaaucuuuaaaacuauuuucuauuuuccaaagauuacuuaagucaaaugaacuaaaaggcauuauacauuuuaguuuucugaugaaauaucugauuuaagcacuuauuauuuuugaaccaauuaaagcuuuuuuauaucacacacacaacacauauaaauacacagacaggcugggugcaguggcucacacuuguaaucccagcacuuuggguggccaaggcaggcggaucacgugaggucaggaguuugagagcagccuggucaaugugguaaaaccccaucuccacuaaaaauacaaaaauuagcugggcaugguggaggaugccuguaaucccagcuacucaggaggcugaggcaggaggauagcuugaacccaggagguagagguugcagugagccaagauugugccacugcacuccaggcugggugacagagggagacccugucucaaaaaauuaauaaauaaauacacagaagaagauaaaggacuuauccccuaaggcaggaaucaaacccugaacacaggccaccauugugaaaagaaaaagcacagccacaugguuacaaggucaagcucccaaggacauacaaaacaagaaggaaaccucauccaguuuuuucagggaccugcagcaaaguuuguaccugauaaauuuacugggccaucuugaacagcagguuuacagguguccuaagcucauguucuauccuaagauaccccucuuuaugacagaacaauacagaaagacacacaacagauuugcuacaacuuaagacuagccucauaaauccauuuuuucacuaaucaaaacuuuacagaggaaaugaacagugauuuuugccauccauucaaccaguuuuauagagagagagagaggaaagcauugccugaggcaggguggggaaggcccggcacuccgagugccagagaaagccccacccauugcagcaacacugaaaaguucaugcagcugcuugucagucaugaacggauuuuuuccagcagucccaucagcucucauuucccuuuuuaggagggaaaagcuccccauguucuacaauccucuacaugccuaauucugucaaccauagccaucagcaaagagugcaaggcagaucaauccaaagagaauagcgguuaacauccuauaaugccaaaccuguucuuagccgaaagggacuuuaaggagagggacuuuacugagagggaccucuaacccccuaaaucuuaaaagggacucuaauccuccuaaguugggccucuaacccagugucagucaagcauccuugccuuuuauugagaggaagcuuuaacccucucuuacgagagacucuaacuccccuaaguugagcuauaaccaaucccauccuuugccugaguaccccaccacuuacccaaaguuguccaauuaguaaugcugcagucuauuuccuuugugcugggggucuccucaguaucaucccuucgaguuucaccagaaagauguuaucaggccccaccacuuacccaaaguuagccuuuggauuggggguuucugcauuauagucacuucagugguugccaaaaagauguuauaggacccccaacacuuacccaaaauuaaccuuugggucagguauuucugcacuauagucccuucugugauaaucagaaagauguuauaggaaaaggauccugauccaggcccccaggagaggguucuuggaucuugugcaagaaagaauucagggcgaguccgcagugcaaagcaaaaccaaguuuauuaggaaaguaaaggaguaacagaauggcuacuccauagacagaguaaccccaagggcugcugguugcccauuuuuguguuuuuuucuugaugauauacuaaacaagggguggauuguucaugccuucccauuuuagaccauauaggguaacuuccugacauugccauggcauuuguaaacugucauggugcugaugggaauguagcagugaggauggccacacuaauguguuuuaagccuuuuccucagccaaacuacaaaaaagcaaaaauuacuuuguuucaauauuaccccuacuggcuaacacacuagcaggucaucagaauauuugccauuccuacaaaauuccaagauucugugaugauccuuugaguauaagaaucacagagauacacacaauuguuacaugcucuauuuaaguuuucuauguuauauuuucucuuuauaccccccaccccauuuccugacucuuucuuuuuaaagggucuuugggaucaugaaagcaaaaugcagcauccucagugucacacacguccaugugaagagaccaccaaacaggcuuugugugagcaauaaagcuuuuuaauaaccugggugcgggcaggcugagucugaaaagagagucagcaaagggagauagggguggggcaguuuuauaggauuuggguagguaguggaaaauuacugucaaaggggguuguucucuggcgggcagggguggaggacacaaggugcucagugggggagcuucugagccaggagaaugaauuucacaaaugucaucagcuaaggcaggaaccagccauuuucacuuauuuugugauucuucaguugcuucaggccaucuggauguauacaugcaggcuugggcucagaggccugacauuccugucuuuuuauauuaauaagaaaaauaaaacaaaauaguguugaaguguuggggcggugaaaaauuuuuuggggggugguauggagaguuacugggugauguuucuuaggguugcuuugagugggauuagggguggcgugggaaccuagagugggagagauaaagcugaaggaagauuuugugguaaggggugauauuguggauuuguuagaaggaauauuugucacauagaaugauuggugauggccuggauacaguuuuguaugaauugagaaacuaaacagaagacacaaggucccaauaacagaaggagaaaaacagguauuaaaggacuaagaauugggaggacucaggacauccaaucagagugccuaaggggguucagcgugauuauuuucuugguugaugaguuuuugggcucuauccuugaguuuuuuuauguugucauauaccaagccagauugauuuagguaaaaacaacacuuuucauuuaaaaauacacacaguccccuuuuuuugagcaguaagucaaggccucagugauuuuggaggaaagagaaaugcaaagccagcaaucauuuuuuaaagaaggauuagaaacagcuaggagagagugaaugagauugauagugugguggagauagcuggggagagguagagggucgcauaagaacaggaaugagaauaagagugaauauaaagguaaagaauaggacuuuauuagggugaaaguauuggaguguaccuugucacugaagaucuucuauccacuucaagagagacuuaaggaaggugguuugagguaaaaccaggagauaugaguuaugaugguuuggaggaaaaguguaaacuggcaguguaaacaagggcagggcauuuacgaguaguugagaauggugaauaggaguaugacuagacagaagauaguagggaugacaaguuuugggguugcaguccaaguagugggggugacugcauaaagccuuguugcaauaaguaggguaauaaacuuaauagaaugaaaggauguuuuaggcucauaaggguuacuacuguucuucagaaaugugagugaguuuaagggaaguaggguugaguacuugcaacuucuaggaggaagaggagagauuaggcuggcuguccaauggacacagcuuuauucuggaauggugagccuaauagggagggucuuacaggcggauggcaguugggguauuauagaugacuaaguaggguccggucuaucaagguuauagaguuugaggggucagauucuuaacaagaacugaucguccaucuagggugucuuuauauggcugggaauauggaguaggcaagaaaagauuagcagcuuggcaaauuuccugucuugccugcuggaggaccagcagauagauuccuagaggacuggugucugagacgagguuggggccaagcaagaaagugugucuauauaaaaguuuaaauggacuguacccucuagcaucucaaggacaggcucuaauucugagaaaggcaagagguaaaaguacuguccaaucuuuuuuaaguuggaggcugagcuuggugagaugugucuuuaaaagaccauuaguccauucuaccucuccugaagauugagaaugguaagggguaugaagguuccacugaauaccaagagccugagaaacugcuugggugauuugacuaauaaaggccgguccauuaucagacuguauagaggugggaaggccaagccuaggaauuaugucugaaagaagggaagaaaugacuaugguggccuucucagacccugugggaaaguccucuacccauccaaugaaagugucuacccagaccaagagguauuuuaguuuccugacucggggcaugugaguaaagucaauuugccaguccugggcagggcaaauucucgagcuugauguguagggaagggagggggccugaggaauuccugaguaguaguaguauagcagaugggacagagaagugauuuuuuuaggauagauuuuuacaaaggaaaggaaaugagagguuuuaagaggcaggauagcagcuugcaacuuacauggaagggguuacaaaaugacaacagaauagaauaggccugugaggcuggaaggagauauuuuccuuguuccaagaaccauuugccuuguguggaaagagauugauagguggaaguuucagugggagaguaggugggagugacagaugagaaggagaaaaacuggccaugagggacagaaguugggacacuagcugcuucuuuagcuaccuuaucagcauaagcacuguccugagugaugggaucugaugccuuuugauggcccuuggagugaaugacuccagcuuccuuuggaaguaaaguggccuugagaagaguuuuuauuaaagaggcauuaaugauggaggacacuugcauagcgaggaaaccucuuuuagccuacauaacagcaugguggugcaggauauggaaggcauauuuagagucaguauaaauauugauguguagucccuuugcaagagugagagccugaguuaaggcaaugaguuuggcuugcugacagguaguggagguggacagagugguaacaucaaggauagauguggaagauacuauagcauagccugccuuugcuaaugagugacaauuaggccugauggaacugccaucaauaaaccaagugugaucagggugaggaacaggaaagaaugaaauauggguaaauggagugaaugucagguagaucagaaagauacagucaugggggucaggugugguaucaggaauaaugugggagccagccuaaaacaguaagaucaaguugcuuggacagaaaggcuacaggucaugguccuggcucuuguguaagaauucugaccgcacagcccugcacuucagcuguguguaaugaaaaaggguucagaugaguuagggagagcuagugugggagcagcuuccagggcuguuuuaagaaauggaaaaaggaguggggaaaggauuuaggaucuauggggucagcuagguuuucuuuugugaguuuauauaaugguuuagucaggacaguaaagcuagguauuuaaaggcaaaaguacugaaccaugcucaggaaagaaaggaguuguugcuuugucaaggggguugggguuugggagauuagccagacacgaucagcagggagagcauguguguuuuuaugaagaauuaugucaagauauauaacggaugaggaagaaauuugggcuuuggaggcagaugugcaauguccuuuugagaauagauuguuggagcagcaggaggguguccuguugggaagauuuguaggaggggcuauaaaguagaaggucaucaaaauauuuaauaaggugagauguagauggauggaaagagaguaaaucaugagaaagggccugacugaaguaauaggagcugucccugaagccuugcagcaguacagcccagguaaguugcugagacugaugggugucagggucaguccagguaaaaguaaagagggccuuggaggaagggugcaaaggaauaguaaagaaagcauauuugagauccagaacauaauaauggguuguggagggguugugaagggagguauuaagaauaagagaguauauggguuuggcaccaugggguggauaggcaaacaauuugguugauaaggugcagauccugaacuaaccuguaagacuuguccgguuuuuggacagguaaaaugggagaauuguaaggagaguuuauaggcuucagaagcucaugcugcagcaggcgagugauaacaggcuuuaaccuuuuuaaagcauguugugggaugggauauuggcauugagcgggguaagggugauuguguuuuaaugggaugcuaaggggugcaugaucgguccccaaggagggaguaaagguguccuauacuuguggauuaagguggggagauacaaggggaggaugcgaaggaggcuuugaacuggggaaaaggcggcaaugagguguggcuguaguccaggaauagccagggaaguagauaauuugguuaaaaugucuuggccuaauaagagaacugggcaggugggaauaacugaaaaagagugcauaaaagaauguuguccaaguuggcaccagagugggagaguuuuaagggguuuugaagcuuggccgucaauacccacaaccguuaugggggcaagggaaacaggcccuugaaaggaagguaauguggaguggguagccuccauauugauuaagaaggggauggacuuaccuuccacuguaagaguuaccuaaagugucugugaugguccaggaggcuucugaggugaucaggcagcgucagucuccagcugcuaagccaagcagaucugggaaagugucagucagagagccuuggaccagagcuuuaggggcuguaggaguagcugccaggugaguuggacaauccuauuuccagugggguccugcauagaugggacauggcuuacgaggaaucccaggcugcagcauuccuuggcccaguggccagauuuccagcgugugaagcaagauccugggggaggaggucuggaaggaaugccugacugcuguggcuuaggugcuaugaaguucuugugugcuggagauguggcugggguuucucucacaguggaggcaaguaauugcaacucuucucuauuauuguacaccuugcaggugagguugauuaauuccuguugugggguuugagggcuggagucuaauuuuuggagcuuuuucuaaugucaggagcugacugggugauaaaaugcauauugagaaugagacggccuucugacccuucugggucuagcuagggugguaaagugucuaaggguuguugccaaaugggccaugaacugggcuggguuuuuauauaugaugaaaaagagccuaaacacuaacugauuugggagaggucagcuaaagaaaaaggagcauuaaccuugacuaugccuucagcuucagccaccucuguaagaggaaacuguuggguagaugggggagggcuagccacagaacgcaacuguaagcuggaccaggugugaggaggggaggugauagaaggauuauagggugggagagcagaggcugaggaaaaauugggaccuggcucagccuggugaggagcagccuggggaggaggggagaggucagaugggucuguagaaaaggaggauucaaaggacucagagcuugggguggagacugaaggaagagacaggagagaaagaagaaagauuugggaugagucacauugggagcagagauuaggaaaagacuuguugcaggaagucagggaccccaaauggagggaccggcugaagccauggcagaagaauguggauugugaagauuuuauggacauuuauuaguuccccaaauuaauacuuuuguaauuucuuaugccugucuuuauugcaaucucuaaacauaaauuguaaagauuucauggacacuuaucacuuccccaaucaauacccuugugauuuccuaugccugucuuuaauuuaaucucaaucuugucaguugaggaggauguauauugucucaggacccuguaauaauugcauuaacuacacaaauuguacagcauguguguuugagcaauaugaaaugugggcacccugaaaaaugaacaggauaacagcaauuguucagggaauaagacagauaaccuuaaacucugacugccggugagcugggcagaacagagccauacuucucuucuuucaaaagcaaaugggagaaauaucgcugaauucuuuuucucagcaugggauaucccugagaaagagaaugcgcaccuagggguaggucucugaacuggccccccuggggcguaccugucucuuaugguugagacugcaggggugaaauaaacuccagucucccauagcgcucccaggcuuauuagaaaaaggaaauucccaccuaauaaauuuuggucagaccgguugaucucaaaacccugucuccugauaagauauuaucaaugacaguggugcccuaaacuucguuagcaauuuuaauuucaccuugguccugugguccugugaucucacccugccuccacuugccuugugauauucuauuacccuguuaaguacuugaugucugucacccacaccuauucgcacacucccuccccuucugaaaaucccuaauaaaaacuugcugguuuuuguggcuuguggggcaucacagauccuaccgaugugugaugucucccccagaugcccagcuuuaaaauuuaucucuuuuguacucuguccuuuuauuucucaagccagucaaugcuuagggaaauagaaaagaaccuacgugauuaucagggcaggucccccgauagggacugaugugcaaaagaauuccuggauaucaggcaccucagaccauuugcccauuuuacgacaagaauuaucuagaucuuguaggauggagaaaucgaaagugcuguuuucuggcuauuuggaaccauugucaaguuuguauuggggucaagugguauugcagaagaaaauaagauguuuagguuuuaggucaggugugaguugaagagguuuuaaguuauugagaacacagucuaagggugaagauggaggaauggaggguggaaguuugccuauagugaaggaggcaagcccugagaaaagagaggguagagacacggagagaaggggugggggguacuugccucccggggagguggugcuugccaccaaggugaaggaucaaggcaggcauccccauggugaucagacaccucugaaaugugggugaauaaucaggcaggcauccccgcagugauuaaacacugagggaagacugucuucccgagaccaugaccaucgucagaguuuuggguucacacauaaaacaugucuccucugucucuaccagaaaaggaaaggcacugaaauuaagggaagggagagauugaaggguagcacagaaauugaaaggagaaagagguugagggauagugaaagaaguuggagaagagagcaaaaagaggcugcuuaccagauuuaaaauuggugagauguuccuugggcugguuggucugaggaccagaggucauagguggaucuuucucacggagcaaagaacaggaggacaggggauugaucucccaagggaaguccccugaucugaguuauggcaccaaaugucacgugcauccgugggaagagaccaccaaacaggcuuugugugagcaauaaagcuuuuuaaucaccugggugcaggcgggcugagucugaaaagaaagucagcaaagggagauagggauggggcaguuuuauaggauuuggguagguaguggaaaauuacaaucaaagggaguuguucucuggcaggcagggguaguggucacaaggugcucagugggggagcuucugagccaggagaaggaauuucacaagguaaugucaucaguuaaggcaggaaucggccauuuucacuucuuuugugauucuucaguugcuucaggccaucuggauguauaugugcaggcuugggcucagaggccugacacucagcagcuacuaccaccauuggcaccacuggcaccacugccaccaccccacugcaccccaguugcuucacucuccaucacagaagccuuuucagcaacagccaacauuuguacccucaccaagcccucugauuuucccaaucacaaggccuucacuacaauauuuucuucauucacaagugucaccuauucuccauccccaagguaagucaauucuaauuuucuugcaaggguugacagagguaaaaccuguccagauaccccaaagguguuucaucuuggcaauucuugacucuuucaaggaaauaagaauagucaaauauaacuaaguaaaauaaauaagaauauauaaggucuguaaaccaaaaaugaaauucuaagccccccaaccaacugaauggaccccuccucucagccaagggcauucuaaaguuaaccugaaagacuaauucaggccaugauggaaguggguggucaggcaugccucauuauauccuccucccuuuggaauuuagacacaaaugaccaacauuaacauuaaaacagagaccuuaagauugacaaaguagacucuuuguagcaauaagauaugaacacaacagauagcaggccccaaaauauauuuauucaacauauuuuuaaauggcccugcaaagcugucucuuguggggaaaccuacauucuguagagaaugcccuucccuuuccagaucuuuucgcuuauccaggagagaauuaacuaagagucugguaccuuuuuaagucugauaagaaacauuuacaaucuauucucucugaagccuccuaccuggaggcuucaucugcauaagagccuuagucucagaagccccuuauguuaaugcagauacucccuucuauugauuucaagacuuuaaucagaaaaccucugagucuuccuaugaccuggaagcccccacuuagaguugucccacauuuucagacccaaccaauguacaucuuacaugcauugauugaugucuuauguuucccuaaaauguauaaaaccaagcuguagccugacuacuuuggguacauguucucaggucucuuggagcugugucaugagcuauuggucacucauauuuacuuggcucagaauaaaucucuucaaauauuuuauagaguuugacucucuguugacaaguccuaguuuuaaaacaguuuuuauuucauuuauuuauuuugagauggggucuucccucugucacccauguuggagugcaguggcacaaucucagcucacuguaaccucugccucccaggcucaggucauccugccaccucagucucccaaguaguuagaaccacauacgugugccaccauguccagcuaauuuuuuguauuuuugauagagaugggguuucuccauuuugcccaggcuggucucaaacucucuaagcucaggcaauccaccugccucagccucccaaaaugcugggacuacaggcaugacccacagcgcccaaccaaaaugacuuguuuuuagacaagagguuagaaauuuuuuuuccucaaagggccagacaauaaguagauuaggccaggguuucucaaccucaacaguauucacauuuugggccagauaauucuuuguuguggagugcuuuccuuuucacuguaggguauuuaacugcaucccugacuucuacucccuaggugccaauaacaucuuauucucaguugugacaauaaaaacauuuuccagacauuucuagaugucccauaggagguaaaauugcccugaggugagaauaacugguauagacuuugcauuccauaugcuaucugucacaacuacucagcagugccauuauagcacaaaagcagccauagacaauaugaaaaugaauggacaugguacuuucccaauaaguacuauggaaacugaaauuuaaauuucauauaauuuucacauguaauaaaauauuccuuuaaaaauuuaagcauuuagagauggaaaacccauuguuagcuugugggacaaacaaaaacaggugguaagccauagcuuuccaacuccuauuuguuuuauuuuugaaaguuuaauaauauauguaauuuaaacuacuguauccaaauaauauuauuuuaacaugugguaauuauaaaaaucaauucauaaauucaguauguauuuuacauuuauaauacaucucaauuuguacuagccacauuuuaaguacucaauagucauauauggcuaguagcuaccauauugggccaugaugcccuagaguauuugcuuuuaauuauuaggcauacuuccucucaagaggcccuagucauugggaacaugaggucacuuucucuuugaagguaaaagccucuaaguccuguuauugaucuaaacucacacaaaaaaaaaaaaaacugaaaguaagguuuaaaagaccaccaugacaauauuuauccaauuugugacuguauuucugauuggcaauucaaaauuuuguuuggcuuaguaauuuuucuugcuaucuugaauagaauuaaucccagaaggucugguagacaaugaguguuuugguguaacuggguuucuuuauguacaaagcuacagaauuccccuugaagacacuggccuugacaucccugaaauagcaaaauagacuuuuuuguuuacuccacguguaguauaugacaguuagugcauuguagauagggccaucuauugaaaucuacaugugauuauacucuaucgaacaucuacuuuaaaacagcaaacaugagagccuacaauugacaucucacuguuuaaaaaaaacaauuucacauauauauucacaaacauacuaaaguggucaauauucaaaguaaagacucagauauuccucacuuugcaccaugguuuaguuaaauaauacaaguaccccaacaacacaguuuaaauuucaguuaccaugguauauugacugugauauuaaauaaaguacaaauuucacugcuagguuuucaguauguaaauuacuauauaacuaacagaugugcaucaugaucaauuaugaaucacaucacuucuuucacagucuuuggugacuggucacuuaucagcuauucaguacaugugcagagaacaaaccauguguuuguguugccucuuugucugccagugauaaacccaagugacauuuaacaaaaacauauaaugaaagagggaauuggccaauaaaaaugaaagcucaagaaagaaacuaaagucacaaugcuggaaaugaaauucaaaucaaagguaaaugaaguuauagaggaaacagcugacugugggaauguugacacuuucacugguuggaaaggcuauauagauaugaagccaaaggaacuuaguuaaagcagacauugacauaaaugaggaauuugguugugacaagcaaugccuauuuuagaccaauggcuuguauccucauuagggacugucaguauaccaaaagaauggguguuaagucuaggaaaauuauaaucaucauuaaguugacuuuuaguucccaagauuuccuauaauuacuguuuucaguauuuagauauuacugcuaaugguaaaauggccuaugaguagaaaauaugaaauuuacauuucucuuuauccaaauuuccuaguggaacccugccccuaacaauguuuaccacuucuuacuguccauuuucacagauaugggggacaugauuacaugcccucaacccauauguuuucuagguaacucuaccacagaauaaagcgguacucaaauuacucucagcuugcuuaauauccacuuuaggacacugaaaaacaaacacaaagggacuaaacaagaugaacaguacguaucccauuucuuuuaaguccacuaucuugauaucaugaggcccccucacugguuuuauguagaugggcuacuggaaugcauaagcuagugccaauucuuauuuuccaaagauguuaaaagauuaacauaggaugggaggagagugaggaucaaaaaaucuaccuaucagguacuaugcucacuaccaguguaaugaaaucauuuguacaucaaagcccaugacacacaauuuacccauggaaauuuacccauuggcuuuugcugcaaaaguaccccuugaaccuaaaauaaaaguuggaagaaaaaaacuuaacauagcaaauucuuagacauuguucugacuuguuugcaagaccuaugcuuucuuccuaagcuggugcuggauaguucuuuugacuuuuuucauuauugaucuucucucucccuagcauugccaccaagggaaacuauuucauguaagacauucuuuuccauccagccaucugguuggcccuaauuucucugagcacaucuuucccaccuguauugugaaccauagagcaggccuaagggaagguuauaaagaagguaagguuggucuguauugucucagucucuuuuaauaucuauucccuucuguaugguacuccuucuucucagagacuccuguucucuagcuucuucauaaucggcuuucaaaauaggaucugcugucagcgauuuaucccuuuagugcuaggaugguaaauaaauuuuaucuugcaugccaacucuaaauuauuaguagcagccaccugaaaugcuacgugaaggauucuggggaugcauccaguugaauuaguuaugagaagaaaaauuggcuacuauaggaaagagaaucaacaauucaauggauuaaacaaaaagaguguuaauuauuucuuacaugacaguaucaauguaaaaaguucaaaucagagagggaauucuguuucuuagucauucagggacuugauuuccuuccaagucauuguacuuucaucucauagggaaucacucccaucuguauacugaaacuggguagccauuacaucugaguugcagcuggugggagaaaguauggaaaggagagcauacccuaugucuuaggacccaggcauggaaauggcauacaucacuucuacucacauuuuauugaucauaacaaucauuuggcugcacagaacugcaaaagaagcugaaaaauguacccuagcugggcagccacacaucaagcaagaaugggagaauguauuuuggugggcaacgagcauuuuugucccuuacuaggcuuaacaggaaucaaugcuaugauuaauuaaugaaauuuuccacgaguuggaaaaaaacuguggcauccacccauauuaugguauuagcugaucuugccuuaagugugaaauggaagucuuguuuucuuuccuagaggguccugaaguuuaaauauaauuccaaaaaauuugacaggcauuuuccacuaugagaaagguacuuuuguuagguacaaaaauaaacuugucccugcuuuaucacuuaauguagaaucaaagauucgucuccagauaacagaauuucagacaucagcuaccaaggagggaaaauauaggcuugggaaagaaggccuucuuguaugaaaucacaccacacaggcacuagacagcucuacuuauauaaaguuuagcucuauaaaaaugagauugggguguuucagagauuuuauuaggaaauguacagagaaaacaguugauggggcaaaagcuauaaacacuaaggugagaaggaaucagaauauaggcaagaguuauagaagcaucuaaauggcauuuguaucuguuuaaucagccuaucagguaaaucugcccacuuuucucccuaccagugaacaucuguuuugaaccucuaggauaugggaccucuugcuugauaccagucuuucugugccuaccuauucuaaagccugaugucaucuucugugccuucccuuauaggcuuacuuccuucaacgcugaccauuccuccagcauuucuuauucuaaagaggaacagguaagaaacuucguuggagggaaaauuaagcaaggauuggcauuagagagggagcugugcacagucccugucucaacaaaaauagcuuaagaugagacaaguacuuuacuuagcauaaucuugcuacugaaggggcuauucuaaauguccccccgcccaacaccauuauguaaacauucucuaauauucgcuacuuaauuuagauuauccacccuuccuucuggccauugcauuccuuaucuagcaaugcaggaaaagggcaagaaaucaaagggaaggaauaaagggacuucuguuuccagacuguauuuuaaagggaagucaugguugguuagcgauuuucuuuagcuuuugcuuugcguuugcagaauagcuaauauuauuguuuuaccuaugggaacugguauccaaucuagugcccaauggggcuguuguuacuagagcuauuuucugugaaccucauagcagacucucuucugcugaaaaugagauuuacuauucauucuggguucucucaaaagccagccugccaucuacaauuagcggucacauccauuuggcuauaguucagguaaguccaauucuucauguccugcuucucagcucucugcugcucagagccaaaaaccuuaucuuagaaccccaaaauacaugucuaguugcuguaucaaagaccagguagcagccuuuacagaaagucccuuuucucagaaucuaguugagccaauacuaugcaguguccacuauauucuucuugguucauucucuuucuuuuggaggcaacagcuuacuauggugaggacaacuggaauccaucucuaccuauucaccacuuuuuaaguaguaaaauugguagcucaaaaguaacuuuauucccugcuaagucuugcucuuuccaauuauuauucaaacaugagaggugacagugagaagauugguuuggcauuauaggaugguaccaugcaagguacucuaacaaccggccuucugucucauggucuaucucccugcagauucagguugcaucagcuguccuccuauguccacaauccaaaugcuaugggauacuauggcagacaaguuuuccaguucuucaggaaguagcaacugugaguauucuagcucacaaugggaggagcacaacgacuggacuccagccaugagcaaauacaaguaaagguuuaacugagacugucugcuccccaguucuccaaccccugccuaccccaagccccuuuuugucuugauuuauaguagaaaaguaauagucggucgggcgcgggggcucacaccuguaaucccaccacuuuggaaggacgaggcagguggaucacccgaggucaggaauucuagaccagccuggccaacauggugaaaccccaucucuacuaaaaauacaagaaaaaaauuagcugggugugguggcaggcuccuguauucccagcuacucagggggccaaggcaggagaaucauuugaacccaggaggcagagguugcagugagcugagauugcgccaucacacuccagccugggcaacaagggcgagacgucauuucaaaaaaaaagaaaaagaaaaguaauagucacaaaauggauauaaaaagagagguaacaaugggaaacuacaggggggcaaauuaauacuuuuauaguuucagcagaccuguaguaacagaagaaaaacugauuuucacuugguucagacuaucucccugggcuagaaaguauagggccaagguagaggaaucggagguagaugaauuaucuuccugugucuuccuuuaaguaguucacauugcucccauuuagguaccaguuaauagucauaauuacuauaaucccucucuuuggauauucucuaagacuuuauuuccucgugagcauaaagacauaaaauaguacacuggagguuagcuaugauuaggaagagccauucuaacuguaaauuacucauaauccaagcucuuuccugaugagcauguauccguuauaaaagaggcuaugauaauauacagugagaaaagaauuuguuuagaaauuaagugaauuuggaucuagggucaccucagcuauuuugcgcugcgacauugaucaaguuauuuucucuggguuucagaugccucaucuuuauuuugugcauuuagauacacaauucuaauuggcccaaugggaauuacacagcuaacaccaucaugcagcaaaacaaaauaaaauacaguggaacugaagugagggaguaaaaccaccacacuaugcagaugagacuaucugccuaguaacaagacauuucuuggacucugguacuucagccaaauguccucugggaguggagaggcggggagacaauauaguccacugccagaaagaacccacaucuguuccaccacucucauugucauugcguuuccugggauacuuucagaauaauucauuaguaacaacaacaacaacaacaaaaaaaaaaaacagcaaggaaaaggcuacaaggggaaggguuuuucuaggucuuugggauauaucuaaucauuucuucacggaauauuauaaaguaggguccacucaaagcucaucccucacaagccacucaaccuuugacauucuucuucuauuuaaugugagucagaauuccuaagauuuuuugaaauccugccugcaaagucugcuuaugaauuuuuuuccuuaccacggaguucccauaaagugacagguucugccuaaguaguuagcuaccugcaaggcugcucgaauccaacuuucuuucccacucuacuuugcauucugcucucccuuugcucuccucuccuuaggcccucaagugaugccagcuuuuguucuagcacucuagaaaggaguuacuauuuugauccagaguacacagagaagagaaacuggaguggguaaaaggaagcucgucacugagaaugcugguacugggagcaagacuguggcaaacccaggaaauacuaacaauaagaaccccucaaaaguucaccuuuaccaagccaauggaaacaauauagcugagugggguuugaauuuugagaacuaaugacuccucagcuaccauguaauugccuuggugcuccauuugcuauaauucaugggaaagguacuaagguccuucaacugguuuuccuugcuaccuccaccuuuuucagaaguuggaccuaugauuagcacacuuccugccuauccauucacagugaauagaauggcuggcuaaauuuuaaaccccauuuaaauuauuccacuucgaaauuugaaugauagaugcuugccuaagucuacuggccucaguaacauuaccuuuucucaugaccaaggguaaaagaguaaauugauaggaggcacaaguuuuuguggauguggguugggcuggcaccaaauccaacuacaagcauacagugaccacuucauacacaccacauaaaaaauacaaaaacugaaaaauacuaucaaaugcuuugacauuuucuaaauauuucugcugccccuauaaaauugccuugucugaccuuuccucacuaaccaggagauacgguguuuuucauuuccucucccuucaaauuuuacaagagaaucaaggaauuugaggaccaaagcaccacaaacacaagaguaagcacagcaaauaugacaaggggacugaaguaagccccuaugggaauaggaucugcugaaggaaucaagagggauggacaaaggaacagaagacacucaagaauaacuucaggaagucuccuuaccgccucaccugcuuucccucuguccuacacauccagccuugcaaagaaauaagaguaaagagaaaaguccauguagcaccaucccaguucagaagcaacccccaagauaugggucaacuuuaucaccucaaacucuacucauuuauaaugacaaaauucaacuguuaacacauagguaagaguucuucaggcaucgguuuuaaagguccauguacugggacgggugcggcggcucacaccuguaauccuagcaccuugggaggccaaggcugguggaucaccugaggucaggaguucaagacuagccuggccaacauggugaaacccagucucuacuaaaauacaaaaguuagccgggcaugauggcgggugccuguaaugccagcuguucuggaggcugggacgggagaaucacuugaaccugggagacaguggcugcagugagccgagaucacaccacugcacuccagccuggguggcugagcaagacacugucuaaaaaaaaaaaaaaaaaaguucauauacugaauaaccaucugggcccauaacagcuuaagacuuucuggagaaaaaaaaaaaaaccaguuuccaguuuaauuuccaacaaagcaguaggaacucuugccuauagaauacugugcugggggcugggcacggcgacuuaugcccguaaucccagcacuuugggaggccgaggcggguggaucauuugaggucaggaguuaagagacuagccuggccaaaauggugaaacccucucucuacuaaauuaaauacaaaaauuagccugcugucguacuacacgccuuuaaucccagcuauucgggaggcugaggcacaauugcuugaaccuggguggcagagguugcagugagccgaucacaccaccgcacuccagccuggagacagagcgagacucugucucaaaaaaaaaaaaaauacugugcugguucauuugccuauaaagucaccaaucuaauguuuggguauuugaucauucagaauucuagaaacacugaagaucccuucaccuacucagggucugggccucuuucaugaaugcuuaauucccacagccuuacaguuuauacccuucuccucucccacuuuugauccucaaguuuuuugcuucucacauuuuuuacuggguuugugcuucucaguauccuugaccaaagcaacugaugcuguaagaaaugagacuucaaaccauuuacccacacugggugauuaagguaguuuaaaaaaagaaaugaggccaggcacgguggcucccgccuguaaucccagaacuuugggaggccgaggcagguguuucacuuuaagucaggaguucgugaccagccuggccaacauggcaaaaccccgucucuacuaaaaauacaaccauuagccaggcaugguggcucaugacuguaaucccagcuacuggugaggcugaggcaggagaaucgcuugaacccaggaggcagagguuacagugagccaagauggcaccacugcacuccagccugggcaacaaagcgagacuccaucuccaaaaaauaaauuaauuuauuaauuuaaaaagaaaaagaaaaaagaaaugaagaacuuacgguaauuagugugguuagggacagugaguuagaaauugucacaucaaaauacaaaguuuucaaaacaguauauuuuauuuuacaauagcaaccaacuccccaguuuguuucaauugugacaucuagauggcuuaagauuacuuucugguggucacccaugcugaacaauauuuuucaaucuuccaaacagcaaagacucaaaagagauucugcauuucacaucaguucacaaguucaagagucuuccauuuaucuuagcuuuuggaauaaauuaucuuugagguagaaggacaaugacgaagccacuuaauuccuugugucugcauaaaagcagauuuauucaucacaacuucauuuaugugaauaaagcagaugaugauaaaauguucucuuauucuuguuuaaucaguagugguagugaugccagaaacugugaaaggaaggcuuuuaguuacuuucuucuuuccauuuuccaauaauccauuccccauccccagcugaagaaagggguguuacugaguccagcugauaccacacauugaaagguaaacauuaauauuucaaaucugaugucuaacuaaaaauguacagaaugaaaacuagaaaauuucaaccccagauuaucuucaaccuugcucccuccaccaaucauacuuugacauuuaucuauuuccuucuccacuuauggauguaauuggcuugcuauagaaacuacaguucagaugcuuugaauguaugaacuacaaugaacaauaaaguccucuucuuuugaagcauauuuuggcuucagcuuuaagauaaucuuaugacaagaagggucacacugauucacuuaauaaauuccauucuuaccuaacacaagguuuaguugauaagcacuuggacaaaaauaauacuuuucaaaaauguaaagcaaacuagugaggacaaaggauuuuguccucaucucaacaaugaucagcuauuggaacugcaugaaacugaacaauuuaaaccuggagcugguaauguucuuaagaccaauucagaacaaaggcagguugcccuuaaaacagguuugaccuuuuccuucacucuuccuccugucccacccucugugagugauuuaaaaacggaaaaggucaaagcccagccaggccuacauuuagagaaauuuuaaaaaaauuuuuccuuucaauuuuggccaauuauuuccaauuuuuauuuuauucuuaaaacuuaagcaugguaaaauguuaagcuguuuucauccacugauauuauucuacuauaaaaagcccuucuugagcagauuugaugauaaaaaggagaacauuucuaagguauaauuagagaagcuguugcaugagaaaucaugucuccaucuccauuuugcuaugcguuaucugaggauuguuucugaaagagaucuauuuaggcaguguauguaugugucagcauguaaaaaguaaagaacugaaaauagacaaaccuuguaaaugcacuucaaaaccaauuguggcucaaguguaggugguuccccaaggcugguaccaaugagacugggguuugggaauuaguuggucaucaucccuccugcugcccagcaguggucagucauuuuucaugagggauggacuaggaaaaugaagugucuauuauaaggagaguuccuguaacuuaaggagcaagcucacuacaaaacccagcuaccugcuuaucguaguggccagagugguagaagagauacggaguaggaauuaaaccacacaauguuauuuagggacuaagccaugccccuaacaagaaaacaagccaaaaggaaaguauuaggcauucucugggaaggcaugcauuuuuuucccaugucucuggggccaaaaaccuuauaccaaguaccuauuggcacccgaauauauuuguagaaugaaugaauacaugaaaaaaaauaaacaguaaccuuucuccuauauucuacuuuccaagccaauuaauaagcaagugucuuuucgucaugauuuuuuuuguuuucuguuuaggauuuaacaaaaugguugagauaacagucacuucuguuugaugaagaguaucacuucauuccauuuuuguguuuuuguugcaucuccaagucagaauaaaugccuuuuggagcagauauauuucauuuagcauuuaguaucaucuucaucaauacucguaugaacgaaaaaauaaaaagcccucucuuauucccacucuacaacgcaugucaaaggugaucuguuuaguuuuuccuuaguaucgaacauaucacagcuacucaaugaaguuucuucucaacuaaagaaacacagucucuuagagaauuuguuccuguguuuccaccauaagauaaaugagauaaagugcacuuugguuuacgucuuucaagcacuuaagaacagcacuuuauucaguuuuaauaaauuuuuacuaaauugguaaaugcaaaagaaucuuuuuuuuauugcucauaugucuuccugucucuaagccagaccaaugagcaaauaccuuuaaaacuaguuguuacaucuugaaccauuuaacuguaauaaaagcagaauguuuaguuaaugaauuaaagaacaaacccugagcccuuuuaucagucuccuggcuuuaaacuaagccaaugaggaagugauuugggggauuccugaaacuaggaaaaaugucucuuuauuuugaaagaaacuugcauuuuucuuucuuuuuuuuuuuuuuuuuaaucucaaaggcaauugagugggucuucugggccagaccuauuuaauuuacgaaacauaguaccuugcagagaauaggcauugaaauauuauuuaaacaaucaaaccaaagauguucuucuaucuucagcugucagugaucuaaugcccucaucucucuuauccucaggacccagaaugguauauuccacauaaaagaugcuuuguuuaucaaaugaaucaaaaagcacgccugaggcauuuauuuuuacuccuuuacuucuguaggccaggucaaggugggucuaauucacuuuuaucaucagcacuuaagaaacuggauggaagaccacaacaccuuguuuuuugcaaaaauuuuccaucuccucaaucaggccaggaagcauguaucuucuggacaggacuuuaucucucuacucagcuuaguacacugccuuauauuaguccauuugucccauguuuucaucacugaauaaacuuguuaaaugacuuuuggucuggaucucacaccuauauuacuucauuuccuucugugagcacucuauaaugauaacaucauuuuuauauccuagggcauguaguuccgagccccacagaaaguaaucaccauucaguaagccaauaguucauuccuaucuguauagaacuguaggcuuuguaaaucuacacauagaucucuguuguagguucaauaaugauaauaaauguuugugcccccaguuguuaucucuaaggauaagaguaaucaaugaucauucagcagauauagcuuauauauggguggcaguuuacaaauuauaaauugauuuuacacauauuuucuucugcuacccaagacacaauaaagaugguuuaucuuugcauccccaaugccuagcaaugagauuggcacacaauagauaacuacuauaguggcauucuucagacaaccaaucccuugcguaugcguauucaaaagauaaucauuguuauucaaauuuuccuacuuuauuugcacaauauaauaacuaucauacaauuuuauaaaccuaguacccagcaccaagugagaaaaucaacaguuacauuuauauggugccuuagaguucacaaaaugcuaacauagguauugccuuauuuuuggcuguggcuaaaugaaauaugauaaauuuucagugccuuuaacagugaguucacauaguaggcaaucaaaauugaucuauuuaacagguauuuaaacccuugguuuguauaacuacuuauagaacccuucucacugugguuuaacuauacaaugagaauuuuguagagacaauaccuagcuuacagaaaguuuuauucauacagaaagcaucaaauuuuucauuuacaagugcuuuauaauuuagaaagcacauucgcaagcugaauuaagugacuuucggucuggaucucacaucuauuacuucauuuccucauacuagcucuuuccugguuaccuggaaaaauguaucaguaauaauuuaacuuaaccucaccaguaaagucuugauuguuuaaaauuaagcaauauaucauuccuuacaucugaauaguauagaggauaaacuuuccucuuauuacauaggagaauuaaucuuguauuuuacaguacccaaaauagcugguauguaagaggcacuuaauauucauucauccauucauucauucauaaauauguagcccauugacauuuguaucaugcuuuaguuuacaaagcacuuuaauaugcaccuuucugaaauuuuuuguucuaugagaauacuuuucccccuuugguagcucuagcacccagcaugguaucuggcacauuauaggugaccacaacaagcuuagucccuuauguuuucaguauauuuuaaaguuuaaaagcaguuuccauguguuuucguuucugauaccuggaauacugcauuuuuacucaaaauuaccagagcagcaaacacaaauuggccucaaauauacauauaauuuauucauuuaucaaacaauuccuugugucugcauaguacuauauccuuuugaaagagcacuuuuuuaugcuugcuccuuucuuuguauccacaacgcuuaucacaguagaauacaagugcuuuacaguuuacaaagcacauucacuauuuuuuuucaggucaccuagauaucaauaaucauugcauuuuuagugccuagcacagggacaggcacagaaaaggaaacuaguaguauucagaaauuuucucugaauaacaaauaauacaucagggggugguaagcuaugaacagcaggccaaauccaauuggcucaaaaacuaagaaugauuuugaccuuauaaaaacguuguuuaaaaaacaaauauguaacagaaaccauauggcccacagucuaaaguauuuaugauuugaccccuuacagaaaaacuguggaccccugauuuacauaaugcuucacaauuuacacugcacuuucaaauguuaacugcaugauugccaauacacuaauugguuuuucucuuauguuuuacagugcuuucauacacauuaucagucauuuaaaucaacuucccacauaaacaggaagaaaaaaaucaaggaaaguauuaaacaugcucaacagucccagguucucucaucuuuaagccuagagauggguauuaaacccaggaguagcguuggcacaguccaccaaauuauuuggccacuacuaugagcagggaguucaggcuguccccuugggaccucgcuuugucccaggcacagucacccuuuccauaaccaucacuagaaaucccaaaccccagaauccugcucaccuaagcucaaagaaggaagcuguugcuggcaggugcuucucagaagucuggcacaucuguguauuucuugucuaauucuucucauuggccuggagcaucucuucacauuuuucucuagagagccuggcacuuuuuuuuccccaacaaccugaccauuuuaucuucucagucuagggcuucuggggucaaaagaaaggacugaaauacaguaucaccuauaugaaugucugcuccugagggaaguuaacaaaagccagauuagauacugacuggauuuuggugucucucucaaguggagaagaugugaauagaaacagaaguuuacaaaacacuauagccuaacaaauagguaaaagcugugauuuaaagcuggcucaagacuggcccaggcauaauacugucaaucuaaagguaaccggcaacaucaaaaaguacaucucaaaagaaucaggcuuaaagauaaacaggagaacuggaaauaucuaagaguaagaaguguaaacaauagaaaagagguaggguuuaggguucucaucuugggauuuccccaggucuucaagcuucuauccuuccuggguucugggucaugggccuccagauuccggccguuagucuugagauaccuuuuucgcuuggguccucuauccaucuagguaggcuuugugacaggggccuuccauccuuggguuguaggucuuccagcuacaacccugggcuaaucuuaggucguuggccuugugucacaagucucaguucuuaggccuuccauguguccugucccaggucuuaagacuucuaacucaagccuugagacuuccauccaacucaggccuucgguccaauucaggccacccucuguuuucuuggcucuugaggcuuuuguugguuucaggccugaggcuucuaucuaucuuggaacaugggcuuuccaucuuaguccucgggucucaagucucaaaccaucugucuuauacuuugggccuucuauccauaugagccuuccaccuucugcccuacuugaguucuggguuuuacugcagucuagggccuuguuuuggucuuggaucaucucacauggcagccuggcauaaggaaccgcuccacaaugcuugcucugauagccgacguucugcaccuaucaggcagggguuaggaagccccucugccacacaugacacacacacacguacacuugcccacauaugcaaagaaauauuuaaggagagauuacaugaaaucaaagagagggagauagauucaugaagaggcugaaauacucaaaggugaguagaaagggaagaagcagagaacaaauacaagccaacagagauuaauacugaaauagaaaaucacaaacagcaagagaugcugaggcacgcaggggaggagagagagaauagcccaagagaggcagaaaggaaaugcagaaaugagaaaugugagauaaaaaguagaaacagcagaaaggaggccagacucagaaaaaaggugaaauuuaaaacgaacgagaaggggaagggguaacaaauaaucacaguucacaaagagaaaagagagguaggcagagaaaggagagguagacagaacaagaaaaggacaaaaagcacacagcaugugacccaaaaaggagacaugaaauaaagcgugaaagaagagccacaucuaggagagcaaagagaaauagcaacaaaaugaaaaaugagagauaugucuaagacaagacacagaccacucuugugaacaaaaagagaaaaugaggcaaaggcacacacgaaagaaauuagcaagagaaacauggaaauggguaagacacacuuuagauagagaacaaagagcaaagacaagaaagaaagagacaaagaaauacacacuugagugcaagagauaagcaaaggcagacauucagaggaaguaaguaguagaagaggcaagauacagugaggggcacaagaggcaugaaaagcaucacagaaagauaaaaaaaaucaaaaagugucauuaguaauuauaauaaacuauuguuacuacgaauacuacuuauaguacuacaauaauaacaaccaccaauaccaacacagaugcucuucuauuuauaaacuuuuaccuuagggauuucuuacauagaaccaaagcaugccaacucugccugcuaccugauagugcuaguggucacuuauauugugggaaaugaacuuaugagucuucuuggguuaccuuuuacuugacaugugccaggcacugcaauaggugagcacuuuacauacaugauuucauuuaacccucacaaacagagaagucuagagacuuuaaguugucaaaggucauauaccuaaugaguagcagaggauuuaaaacacacaauguaugccucuuaacauccuguuacaacuauuuacuaggauuucuggaagagccaaaugggaugucacagaugacuaaguauuuucauaaaaggcucuuugauaggacuugcucaauccccuccuuuagcaucaccuuuccccaacucuuuagaaaacugacuucauucucacacuuuuauaauggcuacuucagaguuuaguuuucuuuuuacacuaaucuuaacugacgacagagucucucacaaacggagaugagaaaggguuacccuuucagcagaaagcagaaaugguguuuuaagcuucucaacguuuaaggcucuaagaaugacagagggccuauacagugaagacauagaacacacaagcaaaggcuaaauucuucugugauacaacugguaagaagaccauaaugucuuugaguugcuucagugaacccagucaguaauauggaagacuggucaucuuuccaucucacauuuagccccacuucacauuagaccaacacaccccauccaacaccagcucccaaaaaacagcuguuauaacaguucugaagugauccucacaggacugcaacaucaacaacuuacuucauucagcuauccucaagugcuagagugccaggcauguugaucuucaggugggaaggcugacuuccuucaguguguucaaauuucuuggaccugcugaagacucagcucucugcacugcuuguaggaaguauaaugauuuggcagauaggaacaaugaagag

SEQ ID NO: 192883 - RNA, 37027 nt, Homo sapiens
cucuucauuguuccuaucugccaaaucauuauacuuccuacaagcagugcagagagcugagucuucagcagguccaagaaauuugaacacacugaaggaagucagccuucccaccugaagaucaacaugccuggcacucuagcacuugaggauagcugaaugaaguaaguuguugauguugcaguccugugaggaucacuucagaacuguuauaacagcuguuuuuugggagcugguguuggaugggguguguuggucuaaugugaaguggggcuaaaugugagauggaaagaugaccagucuuccauauuacugacuggguucacugaagcaacucaaagacauuauggucuucuuaccaguuguaucacagaagaauuuagccuuugcuuguguguucuaugucuucacuguauaggcccucugucauucuuagagccuuaaacguugagaagcuuaaaacaccauuucugcuuucugcugaaaggguaacccuuucucaucuccguuugugagagacucugucgucaguuaagauuaguguaaaaagaaaacuaaacucugaaguagccauuauaaaagugugagaaugaagucaguuuucuaaagaguuggggaaaggugaugcuaaaggaggggauugagcaaguccuaucaaagagccuuuuaugaaaauacuuagucaucugugacaucccauuuggcucuuccagaaauccuaguaaauaguuguaacaggauguuaagaggcauacauuguguguuuuaaauccucugcuacucauuagguauaugaccuuugacaacuuaaagucucuagacuucucuguuugugaggguuaaaugaaaucauguauguaaagugcucaccuauugcagugccuggcacaugucaaguaaaagguaacccaagaagacucauaaguucauuucccacaauauaagugaccacuagcacuaucagguagcaggcagaguuggcaugcuuugguucuauguaagaaaucccuaagguaaaaguuuauaaauagaagagcaucuguguugguauuggugguuguuauuauuguaguacuauaaguaguauucguaguaacaauaguuuauuauaauuacuaaugacacuuuuugauuuuuuuuaucuuucugugaugcuuuucaugccucuugugccccucacuguaucuugccucuucuacuacuuacuuccucugaaugucugccuuugcuuaucucuugcacucaaguguguauuucuuugucucuuucuuucuugucuuugcucuuuguucucuaucuaaagugugucuuacccauuuccauguuucucuugcuaauuucuuucgugugugccuuugccucauuuucucuuuuuguucacaagaguggucugugucuugucuuagacauaucucucauuuuucauuuuguugcuauuucucuuugcucuccuagauguggcucuucuuucacgcuuuauuucaugucuccuuuuugggucacaugcugugugcuuuuuguccuuuucuuguucugucuaccucuccuuucucugccuaccucucuuuucucuuugugaacugugauuauuuguuaccccuuccccuucucguucguuuuaaauuucaccuuuuuucugagucuggccuccuuucugcuguuucuacuuuuuaucucacauuucucauuucugcauuuccuuucugccucucuugggcuauucucucucuccuccccugcgugccucagcaucucuugcuguuugugauuuucuauuucaguauuaaucucuguuggcuuguauuuguucucugcuucuucccuuucuacucaccuuugaguauuucagccucuucaugaaucuaucucccucucuuugauuucauguaaucucuccuuaaauauuucuuugcauaugugggcaaguguacgugugugugugucauguguggcagaggggcuuccuaaccccugccugauaggugcagaacgucggcuaucagagcaagcauuguggagcgguuccuuaugccaggcugccaugugagaugauccaagaccaaaacaaggcccuagacugcaguaaaacccagaacucaaguagggcagaagguggaaggcucauauggauagaaggcccaaaguauaagacagaugguuugagacuugagacccgaggacuaagauggaaagcccauguuccaagauagauagaagccucaggccugaaaccaacaaaagccucaagagccaagaaaacagaggguggccugaauuggaccgaaggccugaguuggauggaagucucaaggcuugaguuagaagucuuaagaccugggacaggacacauggaaggccuaagaacugagacuugugacacaaggccaacgaccuaagauuagcccaggguuguagcuggaagaccuacaacccaaggauggaaggccccugucacaaagccuaccuagauggauagaggacccaagcgaaaaagguaucucaagacuaacggccggaaucuggaggcccaugacccagaacccaggaaggauagaagcuugaagaccuggggaaaucccaagaugagaacccuaaacccuaccucuuuucuauuguuuacacuucuuacucuuagauauuuccaguucuccuguuuaucuuuaagccugauucuuuugagauguacuuuuugauguugccgguuaccuuuagauugacaguauuaugccugggccagucuugagccagcuuuaaaucacagcuuuuaccuauuuguuaggcuauaguguuuuguaaacuucuguuucuauucacaucuucuccacuugagagagacaccaaaauccagucaguaucuaaucuggcuuuuguuaacuucccucaggagcagacauucauauaggugauacuguauuucaguccuuucuuuugaccccagaagcccuagacugagaagauaaaauggucagguuguuggggaaaaaaaagugccaggcucucuagagaaaaaugugaagagaugcuccaggccaaugagaagaauuagacaagaaauacacagaugugccagacuucugagaagcaccugccagcaacagcuuccuucuuugagcuuaggugagcaggauucugggguuugggauuucuagugaugguuauggaaagggugacugugccugggacaaagcgaggucccaaggggacagccugaacucccugcucauaguaguggccaaauaauuugguggacugugccaacgcuacuccuggguuuaauacccaucucuaggcuuaaagaugagagaaccugggacuguugagcauguuuaauacuuuccuugauuuuuuucuuccuguuuaugugggaaguugauuuaaaugacugauaauguguaugaaagcacuguaaaacauaagagaaaaaccaauuaguguauuggcaaucaugcaguuaacauuugaaagugcaguguaaauugugaagcauuauguaaaucagggguccacaguuuuucuguaaggggucaaaucauaaauacuuuagacugugggccauaugguuucuguuacauauuuguuuuuuaaacaacguuuuuauaaggucaaaaucauucuuaguuuuugagccaauuggauuuggccugcuguucauagcuuaccacccccugauguauuauuuguuauucagagaaaauuucugaauacuacuaguuuccuuuucugugccugucccugugcuaggcacuaaaaaugcaaugauuauugauaucuaggugaccugaaaaaaaauagugaaugugcuuuguaaacuguaaagcacuuguauucuacugugauaagcguuguggauacaaagaaaggagcaagcauaaaaaagugcucuuucaaaaggauauaguacuaugcagacacaaggaauuguuugauaaaugaauaaauuauauguauauuugaggccaauuuguguuugcugcucugguaauuuugaguaaaaaugcaguauuccagguaucagaaacgaaaacacauggaaacugcuuuuaaacuuuaaaauauacugaaaacauaagggacuaagcuuguuguggucaccuauaaugugccagauaccaugcugggugcuagagcuaccaaagggggaaaaguauucucauagaacaaaaaauuucagaaaggugcauauuaaagugcuuuguaaacuaaagcaugauacaaaugucaaugggcuacauauuuaugaaugaaugaauggaugaaugaauauuaagugccucuuacauaccagcuauuuuggguacuguaaaauacaagauuaauucuccuauguaauaagaggaaaguuuauccucuauacuauucagauguaaggaaugauauauugcuuaauuuuaaacaaucaagacuuuacuggugagguuaaguuaaauuauuacugauacauuuuuccagguaaccaggaaagagcuaguaugaggaaaugaaguaauagaugugagauccagaccgaaagucacuuaauucagcuugcgaaugugcuuucuaaauuauaaagcacuuguaaaugaaaaauuugaugcuuucuguaugaauaaaacuuucuguaagcuagguauugucucuacaaaauucucauuguauaguuaaaccacagugagaaggguucuauaaguaguuauacaaaccaaggguuuaaauaccuguuaaauagaucaauuuugauugccuacuaugugaacucacuguuaaaggcacugaaaauuuaucauauuucauuuagccacagccaaaaauaaggcaauaccuauguuagcauuuugugaacucuaaggcaccauauaaauguaacuguugauuuucucacuuggugcuggguacuagguuuauaaaauuguaugauaguuauuauauugugcaaauaaaguaggaaaauuugaauaacaaugauuaucuuuugaauacgcauacgcaagggauugguugucugaagaaugccacuauaguaguuaucuauugugugccaaucucauugcuaggcauuggggaugcaaagauaaaccaucuuuauugugucuuggguagcagaagaaaauauguguaaaaucaauuuauaauuuguaaacugccacccauauauaagcuauaucugcugaaugaucauugauuacucuuauccuuagagauaacaacugggggcacaaacauuuauuaucauuauugaaccuacaacagagaucuauguguagauuuacaaagccuacaguucuauacagauaggaaugaacuauuggcuuacugaauggugauuacuuucuguggggcucggaacuacaugcccuaggauauaaaaaugauguuaucauuauagagugcucacagaaggaaaugaaguaauauaggugugagauccagaccaaaagucauuuaacaaguuuauucagugaugaaaacaugggacaaauggacuaauauaaggcaguguacuaagcugaguagagagauaaaguccuguccagaagauacaugcuuccuggccugauugaggagauggaaaauuuuugcaaaaaacaagguguuguggucuuccauccaguuucuuaagugcugaugauaaaagugaauuagacccaccuugaccuggccuacagaaguaaaggaguaaaaauaaaugccucaggcgugcuuuuugauucauuugauaaacaaagcaucuuuuauguggaauauaccauucuggguccugaggauaagagagaugagggcauuagaucacugacagcugaagauagaagaacaucuuugguuugauuguuuaaauaauauuucaaugccuauucucugcaagguacuauguuucguaaauuaaauaggucuggcccagaagacccacucaauugccuuugagauuaaaaaaaaaaaaaaaaagaaagaaaaaugcaaguuucuuucaaaauaaagagacauuuuuccuaguuucaggaaucccccaaaucacuuccucauuggcuuaguuuaaagccaggagacugauaaaagggcucaggguuuguucuuuaauucauuaacuaaacauucugcuuuuauuacaguuaaaugguucaagauguaacaacuaguuuuaaagguauuugcucauuggucuggcuuagagacaggaagacauaugagcaauaaaaaaaagauucuuuugcauuuaccaauuuaguaaaaauuuauuaaaacugaauaaagugcuguucuuaagugcuugaaagacguaaaccaaagugcacuuuaucucauuuaucuuaugguggaaacacaggaacaaauucucuaagagacuguguuucuuuaguugagaagaaacuucauugaguagcugugauauguucgauacuaaggaaaaacuaaacagaucaccuuugacaugcguuguagagugggaauaagagagggcuuuuuauuuuuucguucauacgaguauugaugaagaugauacuaaaugcuaaaugaaauauaucugcuccaaaaggcauuuauucugacuuggagaugcaacaaaaacacaaaaauggaaugaagugauacucuucaucaaacagaagugacuguuaucucaaccauuuuguuaaauccuaaacagaaaacaaaaaaaaucaugacgaaaagacacuugcuuauuaauuggcuuggaaaguagaauauaggagaaagguuacuguuuauuuuuuuucauguauucauucauucuacaaauauauucgggugccaauagguacuugguauaagguuuuuggccccagagacaugggaaaaaaaugcaugccuucccagagaaugccuaauacuuuccuuuuggcuuguuuucuuguuaggggcauggcuuagucccuaaauaacauugugugguuuaauuccuacuccguaucucuucuaccacucuggccacuacgauaagcagguagcuggguuuuguagugagcuugcuccuuaaguuacaggaacucuccuuauaauagacacuucauuuuccuaguccaucccucaugaaaaaugacugaccacugcugggcagcaggagggaugaugaccaacuaauucccaaaccccagucucauugguaccagccuuggggaaccaccuacacuugagccacaauugguuuugaagugcauuuacaagguuugucuauuuucaguucuuuacuuuuuacaugcugacacauacauacacugccuaaauagaucucuuucagaaacaauccucagauaacgcauagcaaaauggagauggagacaugauuucucaugcaacagcuucucuaauuauaccuuagaaauguucuccuuuuuaucaucaaaucugcucaagaagggcuuuuuauaguagaauaauaucaguggaugaaaacagcuuaacauuuuaccaugcuuaaguuuuaagaauaaaauaaaaauuggaaauaauuggccaaaauugaaaggaaaaauuuuuuuaaaauuucucuaaauguaggccuggcugggcuuugaccuuuuccguuuuuaaaucacucacagagggugggacaggaggaagagugaaggaaaaggucaaaccuguuuuaagggcaaccugccuuuguucugaauuggucuuaagaacauuaccagcuccagguuuaaauuguucaguuucaugcaguuccaauagcugaucauuguugagaugaggacaaaauccuuuguccucacuaguuugcuuuacauuuuugaaaaguauuauuuuuguccaagugcuuaucaacuaaaccuuguguuagguaagaauggaauuuauuaagugaaucagugugacccuucuugucauaagauuaucuuaaagcugaagccaaaauaugcuucaaaagaagaggacuuuauuguucauuguaguucauacauucaaagcaucugaacuguaguuucuauagcaagccaauuacauccauaaguggagaaggaaauagauaaaugucaaaguaugauugguggagggagcaagguugaagauaaucugggguugaaauuuucuaguuuucauucuguacauuuuuaguuagacaucagauuugaaauauuaauguuuaccuuucaaugugugguaucagcuggacucaguaacaccccuuucuucagcuggggauggggaauggauuauuggaaaauggaaagaagaaaguaacuaaaagccuuccuuucacaguuucuggcaucacuaccacuacugauuaaacaagaauaagagaacauuuuaucaucaucugcuuuauucacauaaaugaaguugugaugaauaaaucugcuuuuaugcagacacaaggaauuaaguggcuucgucauuguccuucuaccucaaagauaauuuauuccaaaagcuaagauaaauggaagacucuugaacuugugaacugaugugaaaugcagaaucucuuuugagucuuugcuguuuggaagauugaaaaauauuguucagcaugggugaccaccagaaaguaaucuuaagccaucuagaugucacaauugaaacaaacuggggaguugguugcuauuguaaaauaaaauauacuguuuugaaaacuuuguauuuugaugugacaauuucuaacucacugucccuaaccacacuaauuaccguaaguucuucauuucuuuuuucuuuuucuuuuuaaauuaauaaauuaauuuauuuuuuggagauggagucucgcuuuguugcccaggcuggagugcaguggugccaucuuggcucacuguaaccucugccuccuggguucaagcgauucuccugccucagccucaccaguagcugggauuacagucaugagccaccaugccuggcuaaugguuguauuuuuaguagagacgggguuuugccauguuggccaggcuggucacgaacuccugacuuaaagugaaacaccugccucggccucccaaaguucugggauuacaggcgggagccaccgugccuggccucauuucuuuuuuuaaacuaccuuaaucacccaguguggguaaaugguuugaagucucauuucuuacagcaucaguugcuuuggucaaggauacugagaagcacaaacccaguaaaaaaugugagaagcaaaaaacuugaggaucaaaagugggagaggagaaggguauaaacuguaaggcugugggaauuaagcauucaugaaagaggcccagacccugaguaggugaagggaucuucaguguuucuagaauucugaaugaucaaauacccaaacauuagauuggugacuuuauaggcaaaugaaccagcacaguauuuuuuuuuuuuuugagacagagucucgcucugucuccaggcuggagugcgguggugugaucggcucacugcaaccucugccacccagguucaagcaauugugccucagccucccgaauagcugggauuaaaggcguguaguacgacagcaggcuaauuuuuguauuuaauuuaguagagagaggguuucaccauuuuggccaggcuagucucuuaacuccugaccucaaaugauccacccgccucggccucccaaagugcugggauuacgggcauaagucgccgugcccagcccccagcacaguauucuauaggcaagaguuccuacugcuuuguuggaaauuaaacuggaaacugguuuuuuuuuuuuucuccagaaagucuuaagcuguuaugggcccagaugguuauucaguauaugaacuuuuuuuuuuuuuuuuuuagacagugucuugcucagccacccaggcuggagugcaguggugugaucucggcucacugcagccacugucucccagguucaagugauucucccgucccagccuccagaacagcuggcauuacaggcacccgccaucaugcccggcuaacuuuuguauuuuaguagagacuggguuucaccauguuggccaggcuagucuugaacuccugaccucaggugauccaccagccuuggccucccaaggugcuaggauuacaggugugagccgccgcacccgucccaguacauggaccuuuaaaaccgaugccugaagaacucuuaccuauguguuaacaguugaauuuugucauuauaaaugaguagaguuugaggugauaaaguugacccauaucuuggggguugcuucugaacugggauggugcuacauggacuuuucucuuuacucuuauuucuuugcaaggcuggauguguaggacagagggaaagcaggugaggcgguaaggagacuuccugaaguuauucuugagugucuucuguuccuuuguccaucccucuugauuccuucagcagauccuauucccauaggggcuuacuucaguccccuugucauauuugcugugcuuacucuuguguuuguggugcuuugguccucaaauuccuugauucucuuguaaaauuugaagggagaggaaaugaaaaacaccguaucuccugguuagugaggaaaggucagacaaggcaauuuuauaggggcagcagaaauauuuagaaaaugucaaagcauuugauaguauuuuucaguuuuuguauuuuuuaugugguguguaugaaguggucacuguaugcuuguaguuggauuuggugccagcccaacccacauccacaaaaacuugugccuccuaucaauuuacucuuuuacccuuggucaugagaaaagguaauguuacugaggccaguagacuuaggcaagcaucuaucauucaaauuucgaaguggaauaauuuaaaugggguuuaaaauuuagccagccauucuauucacugugaauggauaggcaggaagugugcuaaucauagguccaacuucugaaaaagguggagguagcaaggaaaaccaguugaaggaccuuaguaccuuucccaugaauuauagcaaauggagcaccaaggcaauuacaugguagcugaggagucauuaguucucaaaauucaaaccccacucagcuauauuguuuccauuggcuugguaaaggugaacuuuugagggguucuuauuguuaguauuuccuggguuugccacagucuugcucccaguaccagcauucucagugacgagcuuccuuuuacccacuccaguuucucuucucuguguacucuggaucaaaauaguaacuccuuucuagagugcuagaacaaaagcuggcaucacuugagggccuaaggagaggagagcaaagggagagcagaaugcaaaguagagugggaaagaaaguuggauucgagcagccuugcagguagcuaacuacuuaggcagaaccugucacuuuaugggaacuccgugguaaggaaaaaaauucauaagcagacuuugcaggcaggauuucaaaaaaucuuaggaauucugacucacauuaaauagaagaagaaugucaaagguugaguggcuugugagggaugagcuuugaguggacccuacuuuauaauauuccgugaagaaaugauuagauauaucccaaagaccuagaaaaacccuuccccuuguagccuuuuccuugcuguuuuuuuuuuuuguuguuguuguuguuguuacuaaugaauuauucugaaaguaucccaggaaacgcaaugacaaugagagugguggaacagauguggguucuuucuggcaguggacuauauugucuccccgccucuccacucccagaggacauuuggcugaaguaccagaguccaagaaaugucuuguuacuaggcagauagucucaucugcauaguguggugguuuuacucccucacuucaguuccacuguauuuuauuuuguuuugcugcaugaugguguuagcuguguaauucccauugggccaauuagaauuguguaucuaaaugcacaaaauaaagaugaggcaucugaaacccagagaaaauaacuugaucaaugucgcagcgcaaaauagcugaggugacccuagauccaaauucacuuaauuucuaaacaaauucuuuucucacuguauauuaucauagccucuuuuauaacggauacaugcucaucaggaaagagcuuggauuaugaguaauuuacaguuagaauggcucuuccuaaucauagcuaaccuccaguguacuauuuuaugucuuuaugcucacgaggaaauaaagucuuagagaauauccaaagagagggauuauaguaauuaugacuauuaacugguaccuaaaugggagcaaugugaacuacuuaaaggaagacacaggaagauaauucaucuaccuccgauuccucuaccuuggcccuauacuuucuagcccagggagauagucugaaccaagugaaaaucaguuuuucuucuguuacuacaggucugcugaaacuauaaaaguauuaauuugccccccuguaguuucccauuguuaccucucuuuuuauauccauuuugugacuauuacuuuucuuuuucuuuuuuuuugaaaugacgucucgcccuuguugcccaggcuggagugugauggcgcaaucucagcucacugcaaccucugccuccuggguucaaaugauucuccugccuuggcccccugaguagcugggaauacaggagccugccaccacacccagcuaauuuuuuucuuguauuuuuaguagagaugggguuucaccauguuggccaggcuggucuagaauuccugaccucgggugauccaccugccucguccuuccaaaguggugggauuacaggugugagcccccgcgcccgaccgacuauuacuuuucuacuauaaaucaagacaaaaaggggcuugggguaggcagggguuggagaacuggggagcagacagucucaguuaaaccuuuacuuguauuugcucauggcuggaguccagucguugugcuccucccauugugagcuagaauacucacaguugcuacuuccugaagaacuggaaaacuugucugccauaguaucccauagcauuuggauuguggacauaggaggacagcugaugcaaccugaaucugcagggagauagaccaugagacagaaggccgguuguuagaguaccuugcaugguaccauccuauaaugccaaaccaaucuucucacugucaccucucauguuugaauaauaauuggaaagagcaagacuuagcagggaauaaaguuacuuuugagcuaccaauuuuacuacuuaaaaaguggugaauagguagagauggauuccaguuguccucaccauaguaagcuguugccuccaaaagaaagagaaugaaccaagaagaauauaguggacacugcauaguauuggcucaacuagauucugagaaaagggacuuucuguaaaggcugcuaccuggucuuugauacagcaacuagacauguauuuugggguucuaagauaagguuuuuggcucugagcagcagagagcugagaagcaggacaugaagaauuggacuuaccugaacuauagccaaauggaugugaccgcuaauuguagauggcaggcuggcuuuugagagaacccagaaugaauaguaaaucucauuuucagcagaagagagucugcuaugagguucacagaaaauagcucuaguaacaacagccccauugggcacuagauuggauaccaguucccauagguaaaacaauaauauuagcuauucugcaaacgcaaagcaaaagcuaaagaaaaucgcuaaccaaccaugacuucccuuuaaaauacagucuggaaacagaagucccuuuauuccuucccuuugauuucuugcccuuuuccugcauugcuagauaaggaaugcaauggccagaaggaaggguggauaaucuaaauuaaguagcgaauauuagagaauguuuacauaaugguguugggcggggggacauuuagaauagccccuucaguagcaagauuaugcuaaguaaaguacuugucucaucuuaagcuauuuuuguugagacagggacugugcacagcucccucucuaaugccaauccuugcuuaauuuucccuccaacgaaguuucuuaccuguuccucuuuagaauaagaaaugcuggaggaauggucagcguugaaggaaguaagccuauaagggaaggcacagaagaugacaucaggcuuuagaauagguaggcacagaaagacugguaucaagcaagaggucccauauccuagagguucaaaacagauguucacugguagggagaaaagugggcagauuuaccugauaggcugauuaaacagauacaaaugccauuuagaugcuucuauaacucuugccuauauucugauuccuucucaccuuaguguuuauagcuuuugccccaucaacuguuuucucuguacauuuccuaauaaaaucucugaaacaccccaaucucauuuuuauagagcuaaacuuuauauaaguagagcugucuagugccuguguggugugauuucauacaagaaggccuucuuucccaagccuauauuuucccuccuugguagcugaugucugaaauucuguuaucuggagacgaaucuuugauucuacauuaagugauaaagcagggacaaguuuauuuuuguaccuaacaaaaguaccuuucucauaguggaaaaugccugucaaauuuuuuggaauuauauuuaaacuucaggacccucuaggaaagaaaacaagacuuccauuucacacuuaaggcaagaucagcuaauaccauaauauggguggaugccacaguuuuuuuccaacucguggaaaauuucauuaauuaaucauagcauugauuccuguuaagccuaguaagggacaaaaaugcucguugcccaccaaaauacauucucccauucuugcuugauguguggcugcccagcuaggguacauuuuucagcuucuuuugcaguucugugcagccaaaugauuguuaugaucaauaaaaugugaguagaagugauguaugccauuuccaugccuggguccuaagacauaggguaugcucuccuuuccauacuuucucccaccagcugcaacucagauguaauggcuacccaguuucaguauacagaugggagugauucccuaugagaugaaaguacaaugacuuggaaggaaaucaagucccugaaugacuaagaaacagaauucccucucugauuugaacuuuuuacauugauacugucauguaagaaauaauuaacacucuuuuuguuuaauccauugaauuguugauucucuuuccuauaguagccaauuuuucuucucauaacuaauucaacuggaugcauccccagaauccuucacguagcauuucagguggcugcuacuaauaauuuagaguuggcaugcaagauaaaauuuauuuaccauccuagcacuaaagggauaaaucgcugacagcagauccuauuuugaaagccgauuaugaagaagcuagagaacaggagucucugagaagaaggaguaccauacagaagggaauagauauuaaaagagacugagacaauacagaccaaccuuaccuucuuuauaaccuucccuuaggccugcucuaugguucacaauacaggugggaaagaugugcucagagaaauuagggccaaccagauggcuggauggaaaagaaugucuuacaugaaauaguuucccuugguggcaaugcuagggagagagaagaucaauaaugaaaaaagucaaaagaacuauccagcaccagcuuaggaagaaagcauaggucuugcaaacaagucagaacaaugucuaagaauuugcuauguuaaguuuuuuucuuccaacuuuuauuuuagguucaagggguacuuuugcagcaaaagccaauggguaaauuuccauggguaaauugugugucaugggcuuugauguacaaaugauuucauuacacugguagugagcauaguaccugauagguagauuuuuugauccucacucuccucccauccuauguuaaucuuuuaacaucuuuggaaaauaagaauuggcacuagcuuaugcauuccaguagcccaucuacauaaaaccagugagggggccucaugauaucaagauaguggacuuaaaagaaaugggauacguacuguucaucuuguuuagucccuuuguguuuguuuuucaguguccuaaaguggauauuaagcaagcugagaguaauuugaguaccgcuuuauucugugguagaguuaccuagaaaacauauggguugagggcauguaaucaugucccccauaucugugaaaauggacaguaagaagugguaaacauuguuaggggcaggguuccacuaggaaauuuggauaaagagaaauguaaauuucauauuuucuacucauaggccauuuuaccauuagcaguaauaucuaaauacugaaaacaguaauuauaggaaaucuugggaacuaaaagucaacuuaaugaugauuauaauuuuccuagacuuaacacccauucuuuugguauacugacagucccuaaugaggauacaagccauuggucuaaaauaggcauugcuugucacaaccaaauuccucauuuaugucaaugucugcuuuaacuaaguuccuuuggcuucauaucuauauagccuuuccaaccagugaaagugucaacauucccacagucagcuguuuccucuauaacuucauuuaccuuugauuugaauuucauuuccagcauugugacuuuaguuucuuucuugagcuuucauuuuuauuggccaauucccucuuucauuauauguuuuuguuaaaugucacuuggguuuaucacuggcagacaaagaggcaacacaaacacaugguuuguucucugcacauguacugaauagcugauaagugaccagucaccaaagacugugaaagaagugaugugauucauaauugaucaugaugcacaucuguuaguuauauaguaauuuacauacugaaaaccuagcagugaaauuuguacuuuauuuaauaucacagucaauauaccaugguaacugaaauuuaaacuguguuguugggguacuuguauuauuuaacuaaaccauggugcaaagugaggaauaucugagucuuuacuuugaauauugaccacuuuaguauguuugugaauauauaugugaaauuguuuuuuuuaaacagugagaugucaauuguaggcucucauguuugcuguuuuaaaguagauguucgauagaguauaaucacauguagauuucaauagauggcccuaucuacaaugcacuaacugucauauacuacacguggaguaaacaaaaaagucuauuuugcuauuucagggaugucaaggccagugucuucaaggggaauucuguagcuuuguacauaaagaaacccaguuacaccaaaacacucauugucuaccagaccuucugggauuaauucuauucaagauagcaagaaaaauuacuaagccaaacaaaauuuugaauugccaaucagaaauacagucacaaauuggauaaauauugucaugguggucuuuuaaaccuuacuuucaguuuuuuuuuuuuuugugugaguuuagaucaauaacaggacuuagaggcuuuuaccuucaaagagaaagugaccucauguucccaaugacuagggccucuugagaggaaguaugccuaauaauuaaaagcaaauacucuagggcaucauggcccaauaugguagcuacuagccauauaugacuauugaguacuuaaaauguggcuaguacaaauugagauguauuauaaauguaaaauacauacugaauuuaugaauugauuuuuauaauuaccacauguuaaaauaauauuauuuggauacaguaguuuaaauuacauauauuauuaaacuuucaaaaauaaaacaaauaggaguuggaaagcuauggcuuaccaccuguuuuuguuugucccacaagcuaacaauggguuuuccaucucuaaaugcuuaaauuuuuaaaggaauauuuuauuacaugugaaaauuauaugaaauuuaaauuucaguuuccauaguacuuauugggaaaguaccauguccauucauuuucauauugucuauggcugcuuuugugcuauaauggcacugcugaguaguugugacagauagcauauggaaugcaaagucuauaccaguuauucucaccucagggcaauuuuaccuccuaugggacaucuagaaaugucuggaaaauguuuuuauugucacaacugagaauaagauguuauuggcaccuagggaguagaagucagggaugcaguuaaauacccuacagugaaaaggaaagcacuccacaacaaagaauuaucuggcccaaaaugugaauacuguugagguugagaaacccuggccuaaucuacuuauugucuggcccuuugaggaaaaaaaauuucuaaccucuugucuaaaaacaagucauuuugguugggcgcugugggucaugccuguagucccagcauuuugggaggcugaggcagguggauugccugagcuuagagaguuugagaccagccugggcaaaauggagaaaccccaucucuaucaaaaauacaaaaaauuagcuggacaugguggcacacguaugugguucuaacuacuugggagacugagguggcaggaugaccugagccugggaggcagagguuacagugagcugagauugugccacugcacuccaacaugggugacagagggaagaccccaucucaaaauaaauaaaugaaauaaaaacuguuuuaaaacuaggacuugucaacagagagucaaacucuauaaaauauuugaagagauuuauucugagccaaguaaauaugagugaccaauagcucaugacacagcuccaagagaccugagaacauguacccaaaguagucaggcuacagcuugguuuuauacauuuuagggaaacauaagacaucaaucaaugcauguaagauguacauugguugggucugaaaaugugggacaacucuaagugggggcuuccaggucauaggaagacucagagguuuucugauuaaagucuugaaaucaauagaagggaguaucugcauuaacauaaggggcuucugagacuaaggcucuuaugcagaugaagccuccagguaggaggcuucagagagaauagauuguaaauguuucuuaucagacuuaaaaagguaccagacucuuaguuaauucucuccuggauaagcgaaaagaucuggaaagggaagggcauucucuacagaauguagguuuccccacaagagacagcuuugcagggccauuuaaaaauauguugaauaaauauauuuuggggccugcuaucuguuguguucauaucuuauugcuacaaagagucuacuuugucaaucuuaaggucucuguuuuaauguuaauguuggucauuugugucuaaauuccaaagggaggaggauauaaugaggcaugccugaccacccacuuccaucauggccugaauuagucuuucagguuaacuuuagaaugcccuuggcugagaggagggguccauucaguugguuggggggcuuagaauuucauuuuugguuuacagaccuuauauauucuuauuuauuuuacuuaguuauauuugacuauucuuauuuccuugaaagagucaagaauugccaagaugaaacaccuuugggguaucuggacagguuuuaccucugucaacccuugcaagaaaauuagaauugacuuaccuuggggauggagaauaggugacacuugugaaugaagaaaauauuguagugaaggccuugugauugggaaaaucagagggcuuggugaggguacaaauguuggcuguugcugaaaaggcuucugugauggagagugaagcaacuggggugcaguggggugguggcaguggugccaguggugccaauggugguaguagcugcugagugucaggccucugagcccaagccugcacauauacauccagauggccugaagcaacugaagaaucacaaaagaagugaaaauggccgauuccugccuuaacugaugacauuaccuugugaaauuccuucuccuggcucagaagcucccccacugagcaccuugugaccacuaccccugccugccagagaacaacucccuuugauuguaauuuuccacuaccuacccaaauccuauaaaacugccccaucccuaucucccuuugcugacuuucuuuucagacucagcccgccugcacccaggugauuaaaaagcuuuauugcucacacaaagccuguuugguggucucuucccacggaugcacgugacauuuggugccauaacucagaucaggggacuucccuugggagaucaauccccuguccuccuguucuuugcuccgugagaaagauccaccuaugaccucugguccucagaccaaccagcccaaggaacaucucaccaauuuuaaaucugguaagcagccucuuuuugcucucuucuccaacuucuuucacuaucccucaaccucuuucuccuuucaauuucugugcuacccuucaaucucucccuucccuuaauuucagugccuuuccuuuucugguagagacagaggagacauguuuuaugugugaacccaaaacucugacgauggucauggucucgggaagacagucuucccucaguguuuaaucacugcggggaugccugccugauuauucacccacauuucagaggugucugaucaccauggggaugccugccuugauccuucaccuugguggcaagcaccaccuccccgggaggcaaguaccccccaccccuucucuccgugucucuacccucucuuuucucagggcuugccuccuucacuauaggcaaacuuccacccuccauuccuccaucuucacccuuagacuguguucucaauaacuuaaaaccucuucaacucacaccugaccuaaaaccuaaacaucuuauuuucuucugcaauaccacuugaccccaauacaaacuugacaaugguuccaaauagccagaaaacagcacuuucgauuucuccauccuacaagaucuagauaauucuugucguaaaaugggcaaauggucugaggugccugauauccaggaauucuuuugcacaucagucccuaucgggggaccugcccugauaaucacguagguucuuuucuauuucccuaagcauugacuggcuugagaaauaaaaggacagaguacaaaagagauaaauuuuaaagcugggcaucugggggagacaucacacaucgguaggaucugugaugccccacaagccacaaaaaccagcaaguuuuuauuagggauuuucagaaggggagggagugugcgaauaggugugggugacagacaucaaguacuuaacaggguaauagaauaucacaaggcaaguggaggcagggugagaucacaggaccacaggaccaaggugaaauuaaaauugcuaacgaaguuuagggcaccacugucauugauaauaucuuaucaggagacaggguuuugagaucaaccggucugaccaaaauuuauuaggugggaauuuccuuuuucuaauaagccugggagcgcuaugggagacuggaguuuauuucaccccugcagucucaaccauaagagacagguacgccccaggggggccaguucagagaccuaccccuaggugcgcauucucuuucucagggauaucccaugcugagaaaaagaauucagcgauauuucucccauuugcuuuugaaagaagagaaguauggcucuguucugcccagcucaccggcagucagaguuuaagguuaucugucuuauucccugaacaauugcuguuauccuguucauuuuucagggugcccacauuucauauugcucaaacacacaugcuguacaauuuguguaguuaaugcaauuauuacaggguccugagacaauauacauccuccucaacugacaagauugagauuaaauuaaagacaggcauaggaaaucacaaggguauugauuggggaagugauaaguguccaugaaaucuuuacaauuuauguuuagagauugcaauaaagacaggcauaagaaauuacaaaaguauuaauuuggggaacuaauaaauguccauaaaaucuucacaauccacauucuucugccauggcuucagccggucccuccauuuggggucccugacuuccugcaacaagucuuuuccuaaucucugcucccaaugugacucaucccaaaucuuucuucuuucucuccugucucuuccuucagucuccaccccaagcucugaguccuuugaauccuccuuuucuacagacccaucugaccucuccccuccuccccaggcugcuccucaccaggcugagccaggucccaauuuuuccucagccucugcucucccacccuauaauccuucuaucaccuccccuccucacaccugguccagcuuacaguugcguucuguggcuagcccucccccaucuacccaacaguuuccucuuacagagguggcugaagcugaaggcauagucaagguuaaugcuccuuuuucuuuagcugaccucucccaaaucaguuaguguuuaggcucuuuuucaucauauauaaaaacccagcccaguucauggcccauuuggcaacaacccuuagacacuuuaccacccuagcuagacccagaagggucagaaggccgucucauucucaauaugcauuuuaucacccagucagcuccugacauuagaaaaagcuccaaaaauuagacuccagcccucaaaccccacaacaggaauuaaucaaccucaccugcaagguguacaauaauagagaagaguugcaauuacuugccuccacugugagagaaaccccagccacaucuccagcacacaagaacuucauagcaccuaagccacagcagucaggcauuccuuccagaccuccucccccaggaucuugcuucacacgcuggaaaucuggccacugggccaaggaaugcugcagccugggauuccucguaagccaugucccaucuaugcaggaccccacuggaaauaggauuguccaacucaccuggcagcuacuccuacagccccuaaagcucugguccaaggcucucugacugacacuuucccagaucugcuuggcuuagcagcuggagacugacgcugccugaucaccucagaagccuccuggaccaucacagacacuuuagguaacucuuacaguggaagguaaguccauccccuucuuaaucaauauggaggcuacccacuccacauuaccuuccuuucaagggccuguuucccuugcccccauaacgguuguggguauugacggccaagcuucaaaaccccuuaaaacucucccacucuggugccaacuuggacaacauucuuuuaugcacucuuuuucaguuauucccaccugcccaguucucuuauuaggccaagacauuuuaaccaaauuaucuacuucccuggcuauuccuggacuacagccacaccucauugccgccuuuuccccaguucaaagccuccuucgcauccuccccuuguaucuccccaccuuaauccacaaguauaggacaccuuuacucccuccuuggggaccgaucaugcaccccuuagcaucccauuaaaacacaaucacccuuaccccgcucaaugccaauaucccaucccacaacaugcuuuaaaaagguuaaagccuguuaucacucgccugcugcagcaugagcuucugaagccuauaaacucuccuuacaauucucccauuuuaccuguccaaaaaccggacaagucuuacagguuaguucaggaucugcaccuuaucaaccaaauuguuugccuauccaccccauggugccaaacccauauacucucuuauucuuaauaccucccuucacaaccccuccacaacccauuauuauguucuggaucucaaauaugcuuucuuuacuauuccuuugcacccuuccuccaaggcccucuuuacuuuuaccuggacugacccugacacccaucagucucagcaacuuaccugggcuguacugcugcaaggcuucagggacagcuccuauuacuucagucaggcccuuucucaugauuuacucucuuuccauccaucuacaucucaccuuauuaaauauuuugaugaccuucuacuuuauagccccuccuacaaaucuucccaacaggacacccuccugcugcuccaacaaucuauucucaaaaggacauugcacaucugccuccaaagcccaaauuucuuccucauccguuauauaucuugacauaauucuucauaaaaacacacaugcucucccugcugaucgugucuggcuaaucucccaaaccccaacccccuugacaaagcaacaacuccuuucuuuccugagcaugguucaguacuuuugccuuuaaauaccuagcuuuacuguccugacuaaaccauuauauaaacucacaaaagaaaaccuagcugaccccauagauccuaaauccuuuccccacuccuuuuuccauuucuuaaaacagcccuggaagcugcucccacacuagcucucccuaacucaucugaacccuuuuucauuacacacagcugaagugcagggcugugcggucagaauucuuacacaagagccaggaccaugaccuguagccuuucuguccaagcaacuugaucuuacuguuuuaggcuggcucccacauuauuccugauaccacaccugacccccaugacuguaucuuucugaucuaccugacauucacuccauuuacccauauuucauucuuuccuguuccucacccugaucacacuugguuuauugauggcaguuccaucaggccuaauugucacucauuagcaaaggcaggcuaugcuauaguaucuuccacaucuauccuugauguuaccacucuguccaccuccacuaccugucagcaagccaaacucauugccuuaacucaggcucucacucuugcaaagggacuacacaucaauauuuauacugacucuaaauaugccuuccauauccugcaccaccaugcuguuauguaggcuaaaagagguuuccucgcuaugcaaguguccuccaucauuaaugccucuuuaauaaaaacucuucucaaggccacuuuacuuccaaaggaagcuggagucauucacuccaagggccaucaaaaggcaucagaucccaucacucaggacagugcuuaugcugauaagguagcuaaagaagcagcuagugucccaacuucugucccucauggccaguuuuucuccuucucaucugucacucccaccuacucucccacugaaacuuccaccuaucaaucucuuuccacacaaggcaaaugguucuuggaacaaggaaaauaucuccuuccagccucacaggccuauucuauucuguugucauuuuguaaccccuuccauguaaguugcaagcugcuauccugccucuuaaaaccucucauuuccuuuccuuuguaaaaaucuauccuaaaaaaaucacuucucugucccaucugcuauacuacuacuacucaggaauuccucaggcccccucccuucccuacacaucaagcucgagaauuugcccugcccaggacuggcaaauugacuuuacucacaugccccgagucaggaaacuaaaauaccucuuggucuggguagacacuuucauuggauggguagaggacuuucccacagggucugagaaggccaccauagucauuucuucccuucuuucagacauaauuccuaggcuuggccuucccaccucuauacagucugauaauggaccggccuuuauuagucaaaucacccaagcaguuucucaggcucuugguauucaguggaaccuucauaccccuuaccauucucaaucuucaggagagguagaauggacuaauggucuuuuaaagacacaucucaccaagcucagccuccaacuuaaaaaagauuggacaguacuuuuaccucuugccuuucucagaauuagagccuguccuugagaugcuagaggguacaguccauuuaaacuuuuauauagacacacuuucuugcuuggccccaaccucgucucagacaccaguccucuaggaaucuaucugcugguccuccagcaggcaagacaggaaauuugccaagcugcuaaucuuuucuugccuacuccauauucccagccauauaaagacacccuagauggacgaucaguucuuguuaagaaucugaccccucaaacucuauaaccuugauagaccggacccuacuuagucaucuauaauaccccaacugccauccgccuguaagacccucccuauuaggcucaccauuccagaauaaagcuguguccauuggacagccagccuaaucucuccucuuccuccuagaaguugcaaguacucaacccuacuucccuuaaacucacucacauuucugaagaacaguaguaacccuuaugagccuaaaacauccuuucauucuauuaaguuuauuacccuacuuauugcaacaaggcuuuaugcagucacccccacuacuuggacugcaaccccaaaacuugucaucccuacuaucuucugucuagucauacuccuauucaccauucucaacuacucguaaaugcccugcccuuguuuacacugccaguuuacacuuuuccuccaaaccaucauaacucauaucuccugguuuuaccucaaaccaccuuccuuaagucucucuugaaguggauagaagaucuucagugacaagguacacuccaauacuuucacccuaauaaaguccuauucuuuaccuuuauauucacucuuauucucauuccuguucuuaugcgacccucuaccucuccccagcuaucuccaccacacuaucaaucucauucacucucuccuagcuguuucuaauccuucuuuaaaaaaugauugcuggcuuugcauuucucuuuccuccaaaaucacugaggccuugacuuacugcucaaaaaaaggggacuguguguauuuuuaaaugaaaaguguuguuuuuaccuaaaucaaucuggcuugguauaugacaacauaaaaaaacucaaggauagagcccaaaaacucaucaaccaagaaaauaaucacgcugaacccccuuaggcacucugauuggauguccugaguccucccaauucuuaguccuuuaauaccuguuuuucuccuucuguuauugggaccuugugucuucuguuuaguuucucaauucauacaaaacuguauccaggccaucaccaaucauucuaugugacaaauauuccuucuaacaaauccacaauaucaccccuuaccacaaaaucuuccuucagcuuuaucucucccacucuagguucccacgccaccccuaaucccacucaaagcaacccuaagaaacaucacccaguaacucuccauaccaccccccaaaaaauuuuucaccgccccaacacuucaacacuauuuuguuuuauuuuucuuauuaauauaaaaagacaggaaugucaggccucugagcccaagccugcauguauacauccagauggccugaagcaacugaagaaucacaaaauaagugaaaauggcugguuccugccuuagcugaugacauuugugaaauucauucuccuggcucagaagcucccccacugagcaccuuguguccuccaccccugcccgccagagaacaacccccuuugacaguaauuuuccacuaccuacccaaauccuauaaaacugccccaccccuaucucccuuugcugacucucuuuucagacucagccugcccgcacccagguuauuaaaaagcuuuauugcucacacaaagccuguuugguggucucuucacauggacgugugugacacugaggaugcugcauuuugcuuucaugaucccaaagacccuuuaaaaagaaagagucaggaaauggggugggggguauaaagagaaaauauaacauagaaaacuuaaauagagcauguaacaauuguguguaucucugugauucuuauacucaaaggaucaucacagaaucuuggaauuuuguaggaauggcaaauauucugaugaccugcuaguguguuagccaguagggguaauauugaaacaaaguaauuuuugcuuuuuuguaguuuggcugaggaaaaggcuuaaaacacauuaguguggccauccucacugcuacauucccaucagcaccaugacaguuuacaaaugccauggcaaugucaggaaguuacccuauauggucuaaaaugggaaggcaugaacaauccaccccuuguuuaguauaucaucaagaaaaaaacacaaaaaugggcaaccagcagcccuugggguuacucugucuauggaguagccauucuguuacuccuuuacuuuccuaauaaacuugguuuugcuuugcacugcggacucgcccugaauucuuucuugcacaagauccaagaacccucuccugggggccuggaucaggauccuuuuccuauaacaucuuucugauuaucacagaagggacuauagugcagaaauaccugacccaaagguuaauuuuggguaaguguuggggguccuauaacaucuuuuuggcaaccacugaagugacuauaaugcagaaacccccaauccaaaggcuaacuuuggguaagugguggggccugauaacaucuuucuggugaaacucgaagggaugauacugaggagacccccagcacaaaggaaauagacugcagcauuacuaauuggacaacuuuggguaaguggugggguacucaggcaaaggaugggauugguuauagcucaacuuaggggaguuagagucucucguaagagaggguuaaagcuuccucucaauaaaaggcaaggaugcuugacugacacuggguuagaggcccaacuuaggaggauuagagucccuuuuaagauuuaggggguuagaggucccucucaguaaagucccucuccuuaaagucccuuucggcuaagaacagguuuggcauuauaggauguuaaccgcuauucucuuuggauugaucugccuugcacucuuugcugauggcuaugguugacagaauuaggcauguagaggauuguagaacauggggagcuuuucccuccuaaaaagggaaaugagagcugaugggacugcuggaaaaaauccguucaugacugacaagcagcugcaugaacuuuucaguguugcugcaauggguggggcuuucucuggcacucggagugccgggccuuccccacccugccucaggcaaugcuuuccucucucucucucuauaaaacugguugaauggauggcaaaaaucacuguucauuuccucuguaaaguuuugauuagugaaaaaauggauuuaugaggcuagucuuaaguuguagcaaaucuguugugugucuuucuguauuguucugucauaaagagggguaucuuaggauagaacaugagcuuaggacaccuguaaaccugcuguucaagauggcccaguaaauuuaucagguacaaacuuugcugcaggucccugaaaaaacuggaugagguuuccuucuuguuuuguauguccuugggagcuugaccuuguaaccauguggcugugcuuuuucuuuucacaaugguggccuguguucaggguuugauuccugccuuaggggauaaguccuuuaucuucuucuguguauuuauuuauuaauuuuuugagacagggucucccucugucacccagccuggagugcaguggcacaaucuuggcucacugcaaccucuaccuccuggguucaagcuauccuccugccucagccuccugaguagcugggauuacaggcauccuccaccaugcccagcuaauuuuuguauuuuuaguggagaugggguuuuaccacauugaccaggcugcucucaaacuccugaccucacgugauccgccugccuuggccacccaaagugcugggauuacaagugugagccacugcacccagccugucuguguauuuauauguguugugugugugauauaaaaaagcuuuaauugguucaaaaauaauaagugcuuaaaucagauauuucaucagaaaacuaaaauguauaaugccuuuuaguucauuugacuuaaguaaucuuuggaaaauagaaaauaguuuuaaagauuacugauaaaauaaaaauaucuucaaaaauguaaacauuuggucuaaauuagucaggucagauauuaaguuugcuaacuacuuuaaggucauaaacugcuuccuugacuuuugaaaauuauucaauguaccuaccuuggagacauuagauucuagauaaggucuggggacauguggagagccaggcacccuagcuguacuggaaagagucagaccuuaucugcacuucugcuugauguguccuaggcuaggcuccacacuaguacauaaauaaaaucucuuugggccuggauugggaccucuuuccuguaacaauucuagaacuuugggaggccaaggcaggaggauugcuuggggccaggaguucaagaccaguuugagcaacauagugagacccugugucuaugaaaauaaaaaaaaauuaaaaacuagcuguguguaguggcacacaccuguaguccuaacuacucgggaggccgaaauggaaggaucccuugagcccuggaguucaagguuauagugagcuaugauugugccacugcacucuagcccaggugagagauaagagccugucucaaaaauaaaaaaauugcagauaauuuguauggagugagaaguaggacuuagaccuuuugaacacugucccaguuaccauguugccauccuucuuuucccuucccucuaauuuuucuauauaaugucuaaaaauaaaauaagaagccuagaaaaucuacacucaaaguucucaguuuuggagugaucaaaaaugauuauaaguguaaauauugaaaaaggaggacuugggaucuaucaaaggaguucacugaacugucaaaguauggaauaaaaacaguauaggaaaugagacaaaaaagaacaaagaaaauaaaacaaagauacagaagaacuugaagauugcuuuggggaggauaggagcaaaagugaaguuaagcauuauuaaacauauguaaagauaggccugauguuguuaccaugguugggguuuccuguaauauauuugaaguaaugucauccuuccaucuuccuaauaaaucuuacuuguucacugaucacaucagugauuucucuuaauuucuugacuccaaaguagauauauuugucaguuuaugcagauuauaccugcauuugugggauuguuugauuaauauaugucuucaucccucuucagacuggaagcuuccugaagacagaggccaaggucuauuuuaaccaccuuuguguuucuauuaccuggcacauucaggcucucaacaaauacauguugccugaaugaaugaauaacccagcaauuaagcccaaugugauaucuagguuacugguccugguuuaguuagccacuguucacaacccacauguucuagcuccauaccuuuccaucucuauacuaaagaauccacuucucucuuauuucaucucuacaguagagaugcucaaagggaauuuuuuuuuuuuagagaagucucccucuugucccccagguuugagugcaauggcucgaucucagcucagugcaaccuccaccucccggguucaaacaauucuccugccucugccucccaaguagcugggauuaaguugccugccaccacuuccggcuaauuuuuguaucuuuuaguagagacaauguuuaguagagucaccauguuggccaggcuugucuugaacuccugaccucaggugauccucccaccucggccucccaaagugcugggauuaugggugugagccacugcacccggccuuuuuuuuuuuuggcucaaagggaauuucuucagacuuucuguuuuggguucaucacuauuuaauuccccaauccacuauagucagccuaccacucccacaacuccaccgauaguguuuugauaaaaaucaccaaugaucuaucuaagggacucauuaugcucaucuaaacuggcagcuggcuaaccuguuucuguuguuauaauuccucuucucucuuuuaaaaaacuccugccucucucccuuaguugcuguaacauaucacucuauugguuuaccuuuaaccucucuggcuauuauuuuugaaccuacuugggcuuuugcuugaaggguuuacugcugucuuuccagauuaaaguguuuuaauuacagaagcuuuaucuuuaccauaauagaauuaaaacauuugcuuauacuaugauaagaaugauaaauauuagcaaugagaaagaauuuauugauguguagauaaaugaggcaauguaacuauaacacuaccuagauaaagaugauuccauguuuuccugauuuaguugaaacugauuaucuggcugaguuuagauaguuuucugcccagaagccagaacguugacuagguaacuuauaagauacuccuucuaucccuggcauucuaccauuuauaccacauuuuauguguauuuaaaaauauccagccauagccagucacucuucucacaugguggacagugguuccacuuuuaauugcuuauuuacaaagagauugacaucuguauuaagcucuaucucaaagauguuuucauguuccuucuccacauugcuugugugagucuaaaaaaaaaaaaagaacagcaaagagauagcccugaacaaugcuauauccacaugggaccuggacuuagggaaugacauaaaaauagaauuagggguugugauuuccacuagcuacuuugcugucauagacugcauaucaucuuuauaugaaauugccuuccaucuagguguuauagacugaauuguguccucucaaaauucauauguuguaggucugacuccaaaugugacuguauuuggagauagaaccuuuaaggagguaauuaagguuaaaugaggucauaaggguggagcccuaauccaguaggacugguguccuuauaagaaggugaagaggcaucaaaccucucucuccucacauacucagaggaaggacauuugaagacacagugagaaagcggccauuggcaagcaaggaagagagacuucaccagaaaucaaacuugcuggcacuuucaucuuagacuucuagccuccagaacugugagaaaauaaauuguuauuuaagccacuuggucugauauuuuguuauggcagcugaggcaaacucauaaaguaggugaagguguuuuuacagagaaguuguaaaagauacacuuuccuauccauuauacauuagucuauuccaugccuccucuucugguugugucuauaaccuccuuaauucccuauaaaggauauauguacauagcacuagaaucacaggagcauuguauaguuucuuucuuuuuuauuuuuuugagagaaguucuggcucuacuguccaggcuggagugcaguggcaugaucuuggcucauuguaaucuccaccuuauggguuuaagccauccucccaccucagccuccagaguagcugggacuacagguccacacaaccacaccaggcuaauuuuuguguuuuuguagagacaagguuucaccauguuucccaggcuggucucgaacucuuggacucaagcgauccacccaccuuggccucccaaagugcugggauuacaagcaugaggcacugcacauggucauuguacauuuucuuaaugcugcuguaacaaauuaccacaaacuugagggcugaaaauaacacaauucuagaugucagaagucuaaaaugcaucucauugaguuaaaaucaccauguuggcagggcugcauuucuggagauucuagggaagaauccguuuucuugccuuuuucagcuucuagaggcuacucacauuucuuggcucauggcccccuucuucuaucuucaaagccaucaacugcugguagucuuucccucauuguaucagucugacacugaaucuccugucugccuuuuccauuuauaaggacccugugauuacauugggcccacccauacaaaccaggagaaucucccaucucaaggucagcugauuaguaaccuuaauucccucuugccaugugauauaguauaguuauaaguuuuggagauuacaguguagacaucuuuauggggcauuauucuguuuaucauugaugucuauucacauuaaugcagguaagaauauguauagguauuauaaaauugauaauuuccauauucuuccucuuucccacauuuaaauacugaauacuaauuuuccuucuuuugaagcuugggcccauuacuacauuagcacuauuacuggugacuuuagguucaucugggcacagugagugcaauaggaggagggauguagaguacccaucaugccaugcacuaugaauuugcggauacaggcuaaucaaaaauuuuugccuugggcuuuuuuuuuugagagcaggagagauuugguaucaauguauuaaaaaagcacuuggauuaucugugaauucuauaugaauaauauagaauauauuaacauauauuaauaugaauguaauauauauaauuauauauagaauauauauaauucuauagcaucugugaaugcuauagcuggguucacccugccccuuagaaacaaagaacccagaaucaaauuucuaggucucaacuucaagugccucucuuagauaauaaaguguuaaguauaauauguucucaguuauuucaaaugcugccagugcuuuuuggcuucagcuaaucuguggcuugacuugguuaagcuacucaauuaagaguaaauauccacccuuaccucaguccuucaaaccuuaauucuuucauaaugggauaaaaacacucaaugauaaaguuuaacccaaagguagacaauuagaaaagcuuaucagcuguggguaaaagcacauuguuuucccuuuucccuucccuucccuucccuucccuuaccuucccuucccuucccuucccuccccuccccccuuuccuucccuucccuuuuuucuuucuuuucuuuuuucuuuucuuuuuuuuuugagacagagucucgcucugucacccaggcuggauugcaguggugugaucuuggcucacugcaaacuccaccucccggguuccagcaauucuccugccuaccuccugaguagcacggauuauaggugcgugccacuaugucuggcuaauuuuuguauuuuuaguagagacggggcuucaccauguugaucaggcuggucuccaacuccugaucucgugaucugcccaccucggccucucaacguguugggauuacaggcaugagccaccaugcccagcauguuuucuagcaagauaacaaagaagggugcauuuggauucuugaaucuuauuccaagaucaacugagaauuuagccauaaguauuuuggaaaguuauuccaccuccuucaaauuggguucucuaccuuauauauuacauaacaaaugaacacacuuugauacuuuucccaacaaagccuuuggauagaaaccaagaagcuugguuugcuauuuucaugcuuauggcauuugcucaccuaacuuuuaguuaugaccucaaaagaaaaggcccuccucucuuccucacacuacuuugcucauuauaugugaaauucaacugucccuuugaggccaacuacuaauuuuuccuuucugcuucccaagaaaauuagagaaauuucagaauucaaauaugacaacuuuuacaagucauaggccaaccaucaaguugucaucugugauauggaaaggggaaggggauggaucuagguucaucaagccauggauuuggcacugcuugacacaauaagccuuccagaugucuuuagugaauucauaauuaaaauagucaaaaggaucaauaccuuugaagaaacaauccaagcuccaaggggcagaaguaggcugaguagucacuuuaaauucaaucaauacauuuaacaaauauucauugaauacauauuaaaugguaguguuaggcacuggcuaauaaaccaacagacauuguaccuuaucaaauggaacuuaugaucuauugagggagacaggcaauaaccaaaaaaaaaaaaaaacauauaauuauacauugugauaagaaaauuaaagggaaagaaauaggaugcaaugacuaauaaugaaaaacagcauauuuacuuuagaaagagugauuagagaagaaaucugugaaaagguaguauuuaaagccagaugugaaggguaaaaagaagccagccagccgggcacgguggcucacaccuguaaucccagcacuuugggaggccgagaugggcggaucaugaggucaggagaucgagaccauccuggcuaacuaacacagugaaaccccgucucuacuaaaaauauaaaaaauuagccaagcgugguggcgugcaccuguaguuccagcuauucgggaggcugaggcaggagaauggugugaacccaggagguggagcuugcagugagcagagaucgugccacugcacuccagcccgggccacagcgagaccccgucucaaaaaauaaauaaauaaauaaauaaauaaauaaauaaauaaauaaaagaagccagacauugaagccauccaaguuugcacuuuccauguaauguaaguaaagaaccaauugagguagauagaggucaggaaacugcagcuaaugggccaaaucugacaugcugcauccuuuuuuauagccuccaagcuaagaaugaucuuuuacauuuuuauugauuuuuuuuucgaguuggagucuuguucuguugcccaggauggagugcacuggcgcgaucucggcucacugcaaccucuaccuccuggguucaagugauucuccugccacagccugcugaguagcugggauuacagugugcaccaucaugcucagcuaauuuuuguauuuuuaguagagacaggguuucaccauguuggccacgcuggucuugaauuccugaucucgugauccacccaccucagccucccaaagugcugggauuacaggugugagccaccacacccagcugaucuuuuacauuuuua

SEQ ID NO: 192884 - RNA, 32094 nt, Homo sapiens
caaaacaguauauuuuauuuuacaauagcaaccaacuccccaguuuguuucaauugugacaucuagauggcuuaagauuacuuucugguggucacccaugcugaacaauauuuuucaaucuuccaaacagcaaagacucaaaagagauucugcauuucacaucaguucacaaguucaagagucuuccauuuaucuuagcuuuuggaauaaauuaucuuugagguagaaggacaaugacgaagccacuuaauuccuugugucugcauaaaagcagauuuauucaucacaacuucauuuaugugaauaaagcagaugaugauaaaauguucucuuauucuuguuuaaucaguagugguagugaugccagaaacugugaaaggaaggcuuuuaguuacuuucuucuuuccauuuuccaauaauccauuccccauccccagcugaagaaagggguguuacugaguccagcugauaccacacauugaaagguaaacauuaauauuucaaaucugaugucuaacuaaaaauguacagaaugaaaacuagaaaauuucaaccccagauuaucuucaaccuugcucccuccaccaaucauacuuugacauuuaucuauuuccuucuccacuuauggauguaauuggcuugcuauagaaacuacaguucagaugcuuugaauguaugaacuacaaugaacaauaaaguccucuucuuuugaagcauauuuuggcuucagcuuuaagauaaucuuaugacaagaagggucacacugauucacuuaauaaauuccauucuuaccuaacacaagguuuaguugauaagcacuuggacaaaaauaauacuuuucaaaaauguaaagcaaacuagugaggacaaaggauuuuguccucaucucaacaaugaucagcuauuggaacugcaugaaacugaacaauuuaaaccuggagcugguaauguucuuaagaccaauucagaacaaaggcagguugcccuuaaaacagguuugaccuuuuccuucacucuuccuccugucccacccucugugagugauuuaaaaacggaaaaggucaaagcccagccaggccuacauuuagagaaauuuuaaaaaaauuuuuccuuucaauuuuggccaauuauuuccaauuuuuauuuuauucuuaaaacuuaagcaugguaaaauguuaagcuguuuucauccacugauauuauucuacuauaaaaagcccuucuugagcagauuugaugauaaaaaggagaacauuucuaagguauaauuagagaagcuguugcaugagaaaucaugucuccaucuccauuuugcuaugcguuaucugaggauuguuucugaaagagaucuauuuaggcaguguauguaugugucagcauguaaaaaguaaagaacugaaaauagacaaaccuuguaaaugcacuucaaaaccaauuguggcucaaguguaggugguuccccaaggcugguaccaaugagacugggguuugggaauuaguuggucaucaucccuccugcugcccagcaguggucagucauuuuucaugagggauggacuaggaaaaugaagugucuauuauaaggagaguuccuguaacuuaaggagcaagcucacuacaaaacccagcuaccugcuuaucguaguggccagagugguagaagagauacggaguaggaauuaaaccacacaauguuauuuagggacuaagccaugccccuaacaagaaaacaagccaaaaggaaaguauuaggcauucucugggaaggcaugcauuuuuuucccaugucucuggggccaaaaaccuuauaccaaguaccuauuggcacccgaauauauuuguagaaugaaugaauacaugaaaaaaaauaaacaguaaccuuucuccuauauucuacuuuccaagccaauuaauaagcaagugucuuuucgucaugauuuuuuuuguuuucuguuuaggauuuaacaaaaugguugagauaacagucacuucuguuugaugaagaguaucacuucauuccauuuuuguguuuuuguugcaucuccaagucagaauaaaugccuuuuggagcagauauauuucauuuagcauuuaguaucaucuucaucaauacucguaugaacgaaaaaauaaaaagcccucucuuauucccacucuacaacgcaugucaaaggugaucuguuuaguuuuuccuuaguaucgaacauaucacagcuacucaaugaaguuucuucucaacuaaagaaacacagucucuuagagaauuuguuccuguguuuccaccauaagauaaaugagauaaagugcacuuugguuuacgucuuucaagcacuuaagaacagcacuuuauucaguuuuaauaaauuuuuacuaaauugguaaaugcaaaagaaucuuuuuuuuauugcucauaugucuuccugucucuaagccagaccaaugagcaaauaccuuuaaaacuaguuguuacaucuugaaccauuuaacuguaauaaaagcagaauguuuaguuaaugaauuaaagaacaaacccugagcccuuuuaucagucuccuggcuuuaaacuaagccaaugaggaagugauuugggggauuccugaaacuaggaaaaaugucucuuuauuuugaaagaaacuugcauuuuucuuucuuuuuuuuuuuuuuuuuaaucucaaaggcaauugagugggucuucugggccagaccuauuuaauuuacgaaacauaguaccuugcagagaauaggcauugaaauauuauuuaaacaaucaaaccaaagauguucuucuaucuucagcugucagugaucuaaugcccucaucucucuuauccucaggacccagaaugguauauuccacauaaaagaugcuuuguuuaucaaaugaaucaaaaagcacgccugaggcauuuauuuuuacuccuuuacuucuguaggccaggucaaggugggucuaauucacuuuuaucaucagcacuuaagaaacuggauggaagaccacaacaccuuguuuuuugcaaaaauuuuccaucuccucaaucaggccaggaagcauguaucuucuggacaggacuuuaucucucuacucagcuuaguacacugccuuauauuaguccauuugucccauguuuucaucacugaauaaacuuguuaaaugacuuuuggucuggaucucacaccuauauuacuucauuuccuucugugagcacucuauaaugauaacaucauuuuuauauccuagggcauguaguuccgagccccacagaaaguaaucaccauucaguaagccaauaguucauuccuaucuguauagaacuguaggcuuuguaaaucuacacauagaucucuguuguagguucaauaaugauaauaaauguuugugcccccaguuguuaucucuaaggauaagaguaaucaaugaucauucagcagauauagcuuauauauggguggcaguuuacaaauuauaaauugauuuuacacauauuuucuucugcuacccaagacacaauaaagaugguuuaucuuugcauccccaaugccuagcaaugagauuggcacacaauagauaacuacuauaguggcauucuucagacaaccaaucccuugcguaugcguauucaaaagauaaucauuguuauucaaauuuuccuacuuuauuugcacaauauaauaacuaucauacaauuuuauaaaccuaguacccagcaccaagugagaaaaucaacaguuacauuuauauggugccuuagaguucacaaaaugcuaacauagguauugccuuauuuuuggcuguggcuaaaugaaauaugauaaauuuucagugccuuuaacagugaguucacauaguaggcaaucaaaauugaucuauuuaacagguauuuaaacccuugguuuguauaacuacuuauagaacccuucucacugugguuuaacuauacaaugagaauuuuguagagacaauaccuagcuuacagaaaguuuuauucauacagaaagcaucaaauuuuucauuuacaagugcuuuauaauuuagaaagcacauucgcaagcugaauuaagugacuuucggucuggaucucacaucuauuacuucauuuccucauacuagcucuuuccugguuaccuggaaaaauguaucaguaauaauuuaacuuaaccucaccaguaaagucuugauuguuuaaaauuaagcaauauaucauuccuuacaucugaauaguauagaggauaaacuuuccucuuauuacauaggagaauuaaucuuguauuuuacaguacccaaaauagcugguauguaagaggcacuuaauauucauucauccauucauucauucauaaauauguagcccauugacauuuguaucaugcuuuaguuuacaaagcacuuuaauaugcaccuuucugaaauuuuuuguucuaugagaauacuuuucccccuuugguagcucuagcacccagcaugguaucuggcacauuauaggugaccacaacaagcuuagucccuuauguuuucaguauauuuuaaaguuuaaaagcaguuuccauguguuuucguuucugauaccuggaauacugcauuuuuacucaaaauuaccagagcagcaaacacaaauuggccucaaauauacauauaauuuauucauuuaucaaacaauuccuugugucugcauaguacuauauccuuuugaaagagcacuuuuuuaugcuugcuccuuucuuuguauccacaacgcuuaucacaguagaauacaagugcuuuacaguuuacaaagcacauucacuauuuuuuuucaggucaccuagauaucaauaaucauugcauuuuuagugccuagcacagggacaggcacagaaaaggaaacuaguaguauucagaaauuuucucugaauaacaaauaauacaucagggggugguaagcuaugaacagcaggccaaauccaauuggcucaaaaacuaagaaugauuuugaccuuauaaaaacguuguuuaaaaaacaaauauguaacagaaaccauauggcccacagucuaaaguauuuaugauuugaccccuuacagaaaaacuguggaccccugauuuacauaaugcuucacaauuuacacugcacuuucaaauguuaacugcaugauugccaauacacuaauugguuuuucucuuauguuuuacagugcuuucauacacauuaucagucauuuaaaucaacuucccacauaaacaggaagaaaaaaaucaaggaaaguauuaaacaugcucaacagucccagguucucucaucuuuaagccuagagauggguauuaaacccaggaguagcguuggcacaguccaccaaauuauuuggccacuacuaugagcagggaguucaggcuguccccuugggaccucgcuuugucccaggcacagucacccuuuccauaaccaucacuagaaaucccaaaccccagaauccugcucaccuaagcucaaagaaggaagcuguugcuggcaggugcuucucagaagucuggcacaucuguguauuucuugucuaauucuucucauuggccuggagcaucucuucacauuuuucucuagagagccuggcacuuuuuuuuccccaacaaccugaccauuuuaucuucucagucuagggcuucuggggucaaaagaaaggacugaaauacaguaucaccuauaugaaugucugcuccugagggaaguuaacaaaagccagauuagauacugacuggauuuuggugucucucucaaguggagaagaugugaauagaaacagaaguuuacaaaacacuauagccuaacaaauagguaaaagcugugauuuaaagcuggcucaagacuggcccaggcauaauacugucaaucuaaagguaaccggcaacaucaaaaaguacaucucaaaagaaucaggcuuaaagauaaacaggagaacuggaaauaucuaagaguaagaaguguaaacaauagaaaagagguaggguuuaggguucucaucuugggauuuccccaggucuucaagcuucuauccuuccuggguucugggucaugggccuccagauuccggccguuagucuugagauaccuuuuucgcuuggguccucuauccaucuagguaggcuuugugacaggggccuuccauccuuggguuguaggucuuccagcuacaacccugggcuaaucuuaggucguuggccuugugucacaagucucaguucuuaggccuuccauguguccugucccaggucuuaagacuucuaacucaagccuugagacuuccauccaacucaggccuucgguccaauucaggccacccucuguuuucuuggcucuugaggcuuuuguugguuucaggccugaggcuucuaucuaucuuggaacaugggcuuuccaucuuaguccucgggucucaagucucaaaccaucugucuuauacuuugggccuucuauccauaugagccuuccaccuucugcccuacuugaguucuggguuuuacugcagucuagggccuuguuuuggucuuggaucaucucacauggcagccuggcauaaggaaccgcuccacaaugcuugcucugauagccgacguucugcaccuaucaggcagggguuaggaagccccucugccacacaugacacacacacacguacacuugcccacauaugcaaagaaauauuuaaggagagauuacaugaaaucaaagagagggagauagauucaugaagaggcugaaauacucaaaggugaguagaaagggaagaagcagagaacaaauacaagccaacagagauuaauacugaaauagaaaaucacaaacagcaagagaugcugaggcacgcaggggaggagagagagaauagcccaagagaggcagaaaggaaaugcagaaaugagaaaugugagauaaaaaguagaaacagcagaaaggaggccagacucagaaaaaaggugaaauuuaaaacgaacgagaaggggaagggguaacaaauaaucacaguucacaaagagaaaagagagguaggcagagaaaggagagguagacagaacaagaaaaggacaaaaagcacacagcaugugacccaaaaaggagacaugaaauaaagcgugaaagaagagccacaucuaggagagcaaagagaaauagcaacaaaaugaaaaaugagagauaugucuaagacaagacacagaccacucuugugaacaaaaagagaaaaugaggcaaaggcacacacgaaagaaauuagcaagagaaacauggaaauggguaagacacacuuuagauagagaacaaagagcaaagacaagaaagaaagagacaaagaaauacacacuugagugcaagagauaagcaaaggcagacauucagaggaaguaaguaguagaagaggcaagauacagugaggggcacaagaggcaugaaaagcaucacagaaagauaaaaaaaaucaaaaagugucauuaguaauuauaauaaacuauuguuacuacgaauacuacuuauaguacuacaauaauaacaaccaccaauaccaacacagaugcucuucuauuuauaaacuuuuaccuuagggauuucuuacauagaaccaaagcaugccaacucugccugcuaccugauagugcuaguggucacuuauauugugggaaaugaacuuaugagucuucuuggguuaccuuuuacuugacaugugccaggcacugcaauaggugagcacuuuacauacaugauuucauuuaacccucacaaacagagaagucuagagacuuuaaguugucaaaggucauauaccuaaugaguagcagaggauuuaaaacacacaauguaugccucuuaacauccuguuacaacuauuuacuaggauuucuggaagagccaaaugggaugucacagaugacuaaguauuuucauaaaaggcucuuugauaggacuugcucaauccccuccuuuagcaucaccuuuccccaacucuuuagaaaacugacuucauucucacacuuuuauaauggcuacuucagaguuuaguuuucuuuuuacacuaaucuuaacugacgacagagucucucacaaacggagaugagaaaggguuacccuuucagcagaaagcagaaaugguguuuuaagcuucucaacguuuaaggcucuaagaaugacagagggccuauacagugaagacauagaacacacaagcaaaggcuaaauucuucugugauacaacugguaagaagaccauaaugucuuugaguugcuucagugaacccagucaguaauauggaagacuggucaucuuuccaucucacauuuagccccacuucacauuagaccaacacaccccauccaacaccagcucccaaaaaacagcuguuauaacaguucugaagugauccucacaggacugcaacaucaacaacuuacuucauucagcuauccucaagugcuagagugccaggcauguugaucuucaggugggaaggcugacuuccuucaguguguucaaauuucuuggaccugcugaagacucagcucucugcacugcuuguaggaaguauaaugauuuggcagauaggaacaaugaagagcuauaaaaaaacaugagauaaaccauguaaaugccauaaauauugaguacugugcuagaguuacauaagauucaaauuaauaagcaauagaaaauguuuccacagaacuuugaaaccuauaaagucaaaacuuuuaggucuuuagagagaaaauuuccucauucaacagaauaggaaacuggcauaaaugggaaaaugucuugccaaauaucacuugaugagucacuagagacaccacuaccagucauagccuuauaccuuaguuaaagaccagaacugccgggcgcgguggcucacgcccauaaucccagcacuuugggagguugaggugggcggaucaccugaggucaggaguuugagaccagccugaccaacauggagaaacaccgucucuauuaaaaauacaaaauuagccgggcgugguggugcaugacuguaaucccagcuacuugggaggcugaggcaggagaaucgcuugaacccgggaggcagagguugcagugagcugagauugcaccauugcacuccagccugggcaacaagagcaaaacuccaucucaaaaaaaaaaaaaaaaaaaaagacuuccauccuguuuuaagugccaaucagcuaggaaagagucccuuuaaaugauuaauaacugagaucacaaaaauaauagauaugagagggaaaaacauaaggucuucccaauguuuaaggcucacuucgauguuuuaagaccccucaaguuugcuuuaagucuccuggcucaggacuaacaaaacacagccuuagagcagcauuuucaaaacucacaauauugcucuuugagauaaaggugagucacucuggaaggcaaauauucucacaauaagaaaauucacauagguuguuuaacauugcagcuaaaauacaaaaaaaaagaagaagaagaagaagaaaaagaaaauucacauagacuacuggcccuaggagaauuuaucuaaagauuaugaguacaauagauagaucuuccuagauaacucucaacuuagcuuucuaguuccuagacuuucuaacaauuuguuaguaacucucuauuucuaaaucuacagagauuucuagucaauuauaacauuucaagaguucuuacccaugaaaauauuucaugaaauuuauagcuacccacuauuuacgaagaaugcugggcaaagccuauacguucaggauuuauugcaccgaauggucaccuuuaucugccaauucucacucgcuaaucagccucucccaacacugaccuagagaauguaggguccugguucuuuagcuccugccugaugacagauaacuuugugccauuuuuagucagguuuccauuuguauuuaugcggcuuccaucaaucagcaaccauagcauaaaaagacacaccucucacuuguuguauuauacaccauggcaucccaagccauccugaaguauguaaaugauuggcaaaguucuucuguaaggcuuuaagagagacuuuggggaccacauggaacagaaugauuugcccaugugaucaaugucacugaugugacaguuguccauguucuccuaaaagaacaacuuagcuguaagccucugccacgugcuauagucccacuccaaacacccgaacacaugcaacccgcuacccucuuuacaucaucacuuuaaccaguuaaucucacacccaguugcuucccagguuaguuaggaagcuguuuuuaccaaaucauaugcagaauaaugaugaauacgaccucagugaaacacuaagugcaauguauacuggaaaacaaaaucaaaauuaagacuacuuauuaugcuuuuagggacagcuuacgcaccuugacguguggugguuguuuuugagacuuuaucuuccuaucugggaccaggaaaguaucuugacagaaccuccugaccuaggguuguugcccagugguagugagcuuuuccccuggaggauccucaugccccaucuccaccuagggaucgucaaagggaauggaucacuaacacuguaaaacaacaagccuauucuucugaggaagaucugaaaagagauaaaagaaaaaguauugaaaugcaguacacugggaaagucuguucuaaugggcaacuagugguugaguucaaccauauuuuuacccuuuucuucauguggauugaagaguggacauuuacaguugugcggagcuguuauauucuggcuaccaacuuagcaaaaaaaaaaaaaauuauccuauucauuccagcucuauucuguaugcuuucccucauuuccaagagaaauuuagaacugaguaauugccaauauucccaugcugcauuuuauucuccagucuuuauuacugagcgauccucuacaauguggguuguuaauacccuuguguucucagcacaaaauauaguaggggggucaagaaaucaagagguugaaacuaauggaaggagaaacuaaugcuuucucaaccaagagagccaugaagccacacagaaaaggucggauguggucuaacccuaugaguuauguaagaauucuccuccacaaugccucuggcuuccuuuauaaagagcuauuuuaagaacugagaaauccaccucuaucaaagugccugucagcuaguucuguagcaucccccucuuuuaauuuguacuuuaaguagugccaugccauaauauugccaagauaaagagaauuguuuccuacucaauccacaugguaacauuucuucaacaaccuguauaauagggcgccaccaaaguucuaggauauucggagaaaccaagaauggucacaagcacauagaacuccaguuauaacaacagcuggccaggcgugguggcucacgccuguaaucccagcaguuugggaggucgaggcgggugaaucaccugaggucaggaguuugagaccagccugaccaacauggagaaaccccgucucuacuaaaaauacaaaauuagccuggcguggucgcgcaugccuguaaucucagcuacucgagaggcugaggcaggagaauaacuugaacccaggagacagagguugcagugagcugagauugcgccauugcacuccagccugggcaacaagagcgaaacugcgaaaaaaaaaaaauacacgccacaaaaacaguuaagcaaaucuaugcagaaggaaaaacaagguacagaaaaccagggauucaguaaauuccuuauacaggcccccggggcucuccuauuccacuuuuuaacaauuucaauuguuuuucaagcuaagaaauuuugauuucuuaaaacaaggaaauggcagugauaauggaauuaggccuaccaaaacugagcuaauacagaugaaguuagucuuauuuguaaacaaauccugagaacuuaauacccaucugccaaaggaaagugggaauaauuuaaaaggccacuaaucaaaagguguuaaguucauuaaaucuaucuugcuguguggugagaaaagaaauaauuuagugcuuugcaucucucauucuucauuggggaucaaguaugcuugcccuuacagaccucacuggagcccagcucugagggauaaaugaaacaggccgaacucauuauguaaaguuaaaauguauguguacaugcaaaagaaaaaguauaggaauugaugaaaacuggcucacguucugcuuuucuuucuuuuuaagagacugggucccgcucugccaccuaggcuggagugcaguggcuaaugauggcucacugcagccuugaacuccugggcucaagcaauccugcugccucagccuccagaguagguaggacuacaggcacguaccaccaugcccaacuaauuuuauuuuauuguagagacaugggucuucaacuccuggccucaagugauccccccaccucaaccucccaaagcccuggaauuacaagcaggagccaccaugcccagcuguguucugcuuuaaaaaggagaguugugggaaguucaauccaaagacagaagcacuacaacaauaaauuccccaaacuaccuuuuucuccagauagcuggcaacccauccaaguagauuagcuggagcuuggccagauucucaaagggaaagauaugauuaauuuggagccucuuauagcuguuugcaguccucaggucucacaugcucagaauguccuuaagaagaaagacaggguucaguaggcuaccaaagcaccgguaggauaccaaaagaguuacaaaaaccccaaugaaaaaaaccuaggaaguauaaacugaagcauuagacauagguaucuccugucucuacuuucuagccugcuuggucucccuaaaguccucuaaugacaagcccuggcaguacacgggaagauuagacaagugaagaaaaagaacuacaugaaaauaugggucaaaccaauaccgaccuuaagggcugacacuaaauuuguggcuaauggucauccuguugcugaaaauacuucaagauucaaggugguguggcaacugcuacuacugcuuagaggugcaauugucuugacuguuuuuaauaauuggcuaucuaccuuuacuauagcauaggagcucacuaaaggggaucuaagccaaauuugcagucuugaaagcacuuugcaugguacuguauaguauggugugaaaagcacccaguauguuaaaccugaguaccuuaaaugaauacaggcuuccagaucccugaucagggauuacuguaucaugaggaaaccuuuaugucaaugucaaacaggaauauauggaacaucacuuauucaacacuauucucuagcuuuaaaaaggccaaacuguucuaugauguucucaauauaagcagaacaagcuucaaaaucucuugccaacauccuuccccauccuaauuuaaucuaagauuagauacuugacuuccaaaugcaggcuuccaguuaaacauggcgguucauacauguuuaugcauuuacucuacugcuuccuaaaacuccauuaaugagaguaaaugugcacuccauaugcaagcaaauacaccuaaagaaauuuuaaauaaacggauccuagcucaaauucauuuauacacuggcaucuaaaagggaacaacuauuccagucuccccaagucuucuuaagcauauuuauggaguaucuugcuuuagcaucaaagcccucuaguuuugccuguuacuauggugaugacauacucaaagagcauucccuuucccuuaacgggaaucuaaggcuagagaaaaugguuacauuuuggaacugggaaucuaaggcuagagaaagugguuacauuuuggaacugauacagaaccauacauuucacuaggguucaauauucacugacaagaauuuugagaauccgucaucuugcagaccaacaaaauaucaaagucuuauggagagaauaacugaguggcacagccagccaucugguucaaauacuccagcaucagacagaauugucacagcuagacgugauauuaauaaucacauaggccaggcgcaguggcucaugccuguaauccuagcacuuugggaggccaaggcgaguggaucaccugaggucagaaguucgagaccagccuggccaacacggcaaaacuccaucuguacuaaaaauacaaacauuagcugggggcgggggguggggggcgggugccuguaaucccagcuacuugggaggcugaggcaggagaauugcuugaucaugggggaaggagguugcagugagucgagaucgugcuacuucacuccagccugggcgaaagagcaaaacuccgucucaaaaaaaaaaaaaaaucacauaauucaacauuuucauucucuaaggaaacugggaacccagaagaugaaacuaccucaauguuacacaaauagaagguaaccaagugauacuuaaacccaugucuucccacaauucaaaggucuuuuaacuguggggucugugcauagauucucaggacauauggggagcuuucuacaaaacuuucacaauacucucauuucacuguaaggauaguuuagaucagcuauaugacuacuucauaauauaggaccacguugccagauuaguggcaaauguucuaguuuuguugccuggggauuacagaaaagaagagaagcaaacaauauauaaauguguuuugugccaaaugaaagugaaauagcauugcuaugugcuauaauggcaggauuuaaagcaguuugaaaacagcaguuuggugaagugcaucaacacagcaugugauauuacagacacgccacucaaaagaaacuauaauacuauaauaguagugccauauuugcauuuuaguuaucuauuaacuacuaauuuguacaucugcuauguuuuauaguuguauuauagauguaggcaaacagauuucauuccagguuuguucauacacuuuaacuuaacaauuauucccauaaaccuaaauaguacauaauaauauuuuucuuuuacagaaaacguuuaaucaaauauagcaaaauauuaauuguagaaucuaagcagugauuauguaggugcacacugaauaauucuuuucuugagagaaaaccucccuacuaucaaacuuauuauacagacuugagaaacacugucucaaacuaauaucuaauauaaaauauuaaaauuauacucaacauaauuucauguuauuuuaaauugcugauuaauaugcaaugcacaugacaaugcuguuaaucagggcacuuuuuguaacagcacaccaacuuucuugacuaaaauugaaagguuaaaaauuauauuuggguuacaauugccaaggaagacaucuacuccuugggucuuaaauaggcacuuuggaaggcuagcuggaggucaguaaaugaaccuuuccuaucccacgugugaacaugccuuucccuuccuuucccaccuccaguguucucaggguccuuuagcucuuagaaaaaaacggaaagaagaaaugcauacccaaggaacagcuuaccuggcgauaucagaauaauuuaaucugaaaaucaaugucaaaauguggauugaaguaaauucugguucuuaagauaaaguuuguuucugcaaccuauuuuacguuucaaaacuggcagaaacauuuagggcagaagggucauuucuaguuucaagaauacccuacagcuaaacucucccuaaacuuaaccauagaagcaaaugucaaacacucacuaccguaauauuaacagaaaaauuucccaaccaagccagguuucucacuguagaaaugggagguaacagauaagcaaggaggugagacuauaaugauccauguggcaaugauuagaguuggagacguagguauaaacacauuuaguuuaauauagauacagaugguuauauauauuuauagcuaugugcauauacacacguuagaaugcaaauauauaucuccuugcucuugucaacugaaaaggucuugaaggaaugacacuccaguaguaaugagcgcaccuagcauucacuucuugauuucuaauauuacucuccaauaaaaaguaucaaggcuccuugcagaaauacaucauuuuagguccaggcaggagauaugcaaaugagucugaagcauguuguaguuccaaaaauaagaaagugcucaaacaaaaaacccacauucaugggguuauaucaaagccaaaugaaagaccucccaauggccaaagcuggaacaauuugaacaacagaauaaaguaauacuguauuauaacccagaguauaaaauaucccugagaucauacugauauaaaugacugaauaaacacaauacauuguggagaaaagacauccugugcaaaagaauuccaaauaauuuauguaaauacucugcccucaaugagguggaagguaauuucccauuccuuaagugcuggcugcacauagugacuuccuaugugaacaguauaguagggaaauggagaaauaaagacuaauuuuacgcuggagaaaccugacaaauaguaccucagacaggugauuaaggauaacauaaacagugauaagucauguugauaguauguacucuugauaagugauaagaauggcacucuaccuuuguggucuuccuccuaaacacucauaaacccaaucuagucaugagaagaacaucagacaaauuccaauagagagacauucuauagaauacuggaccauuaguccucaaaacugugaaguucaucaaaaacaaagagucugagaaacugucauuaccaagaggagccuaaggagacaugacuacuaaggacacaugcagcgugguaucuucaaugggauccuggaacacaaaaagaacauuaaggaaaaacuaaggaaaucugaauaaaauauggacucuaguuaauaauaauguaucaauauugguuuguugugacaaauguaccaaacuaauguaaaauguuaacacugggaaaaacugggugugaaguacacagaaacucuaucuucagaaucauucuguaaaucucuacacuguucuaacauuaaaagguuauuuuuucuaaaaaucucccaaccaguugcugaagacuuauaagacacaguuuuuaaaaagcaagcaaaauggaaccuaagaacugguaagucuauguuccagauuuuucuacaguacguaccaucauuguuugcagaucugaucuaaagacuuacucucuuucuuuucuguuuauauggauuuauaauagguaauuuugauguuaaaauauacaaggcccaaauaaccagguauccguaauaucaaaaaguuauuuuuuaaaaaaacauuagcaauuaaacuuuguuuuuguacaucaacagauuuccuggaaagaccuagucaaucugcuguaaaaaauaagucguaaguuaguagcuaauuuucagucaagggagaucuauaaggcuggaaaacuuuaauaacauauagauuguagagugauuauaucccaucacuguucaaugccaaucacacuaacagcauacuauaaaauauacuaugccacuaguuuucaaagcuauggguaaaguaacauagauaauuuuauaaugggaccugguaaaguacagugauguuccagucauaucccuauuuuuaaauucuuauacgcacuugauuauguaauaagaggguauugcuugggucuacugcauaaccucucauguuuccgggaacacuagaagacuagcauucuaauugguuaaggaaaauaauacuuuaagucuacccauaauuuaagaagucuagcaccggucaaauuuacauuuuguuucaguuucucauccuaacaugaaaaaaaauaaucaaaaguuauuucuaauauaaacaucaaaacaguaaaggagaggcuucuuuaccaaacucauuuguauaagaugcagaagaagcccaagcuccauguaucaguacucaauuuggaaaggucaaggaagagcuaucaaguaaagccuaagucaccaacaaaaacaugaccaacucgacagccuaauacacauauauauagugauauauaacuguacauggccacugaaguuuaacuuguuaaauucagcaggccagcuaugucuuaaauacaugagcuccaacuugaguuggauuuuugaaggaaaccuguguaaaaugcuacuugccuacagcccaaaauaugguagugagaauaucaauuuucucccaauccagucuuuaagacaaggcagaggaaggcauuagcucuguuuaacugacacaucauuacucuuugccauccaaacugauaagguuugggggaagagaagaggcauuagcucaguucagauauaaucauuaguuucuuucucuuuaagcugguaacguauuuuuccaggaugcuuucacauauaagaauauuuuagcagucaacaaaggucaacucuuaauucauuacuuuaagacaugaacucccuucaagcuguacauuugauaaucagggcacaaacacccugaaaagaaauuaugaaugccuaaucacagcagcccugggucucacagucuucuguaauuuagggagguggcuagagaaauggaaguuacagaaagauaaagcugaaagaggauaugagaaaauggucagaaaacuuccuccaauccuacauguuaagguuuuauaaagggaaaagucagaaaagaaaugacaauaaucauuuaaagaaaugccaaaaaaguuuccuucauuagacuuuugaaaauuuuccaaaucacaaaaugucauuuucagggauuuagguauuugauauaagccccuaucuuauuucacuagcagucucgagauggucagauugauggugaucugaaccaaacucagagccaggacuaaagucuaagcauuucugcccaaaaccauaaugauuuccuucugcauccuccauaagaaagcaaauuccuugauauaaauccugucuuugguuuugcuauuuauuccagcaccugguacaauaauauuuguugaacuaacacaagaauuaucucuauuuugaagaugcccacauuuccagagcaucccuuuuuacaauugcuagagauuuuucuuaaggguggaaauuauuucaagcaaugaauuuaaauacagcuucaagauucaccuuuggaugcuaucuaguauaaucaauccaccuaaaaucaagccauccuuccucuugacuuaagguacagaaucaccuccaaauucauucauuuaaaacaaauuccaauaauaauuauaauuguauguugacaaugaaugacaauuuaauuaccaauagaagauuucauaagcauagaccaggguuucucaaauuggggugauaacccuggggauuugugaauauauucuaauggauccccaaguucuacauaaguuauauaaaacacaucuuugacaaagacaacgugaaauuggaaaacauauuuacauuucaaauaucuuuguuaagucaguguuccucaaaacacauuuuuuuaggaucucagaaaauuuuguuccuuuagaagguguuucaucaugaagcauuacuuggguuugagaaacaauggcacagaccauguuuccaagaagguucaagaccaugauguauauaacccucagucagccagacaauguuguuaagcauauggaguggggcugggaggcauggaaacaagcccugaggaaauauggauaugaauuaaaacgggcuauaagugaagccaguucacuuauaugguucuuguugcuccugcugugaugcaugaaugugcaccagaaaaaaaguuucgaauguuauguuaaacaauauuuugucagcuggaaaacauuaaggaggcuaagcuucuuuuagcuuuacgaaaggugggaggaaagaagguauauaaacuacagcauaaaguaggcaaggaaggucaagguuuugacuucacuucuccacuacccucuuggcaaaaagguuccaaacuuaaaaaguaucuacgauaugcauuauccauggucaucuguucuugggcagaaauguaguaaaauuguggaaggagccgaaguauuagauuuaugcccucaaucucugaacuuuaaaauacucaagcuuaugagauuuagcaaucacuaauuugccaaccuucgcaaauagccaaacacaauggcuaugcucuaucccuuucaucucuuuccauggcuccaaaagagguaaaaaacaaaugaaauuaaaauaaaccaacuggacuauccagauggcugcaauauuaauccuaucuuggcuuaaagagaaaaagcaaacccacuuccuuaaguuuauucuaucaacuucaaauccuuguggguucccuuccuaaaacuacuacuuaugauucacacaaaacagcacuuauuauuuucuaaaguuauuucaaaugugcucacauuagcuccucaacgauaaaaucaucucaggaaugaaauuauauaggaugauaucauuccuacccagguuaucaguguaaccuagcauagagcuggguccacaauauuaauucuacaguucugcugguuaacucacauauguguauuuaugcauguauguauguaucuauuucucucucuauauauauauauugcagaugaggugggaagaaggaaagaaacuuacuggacccucugacuuuucuauagguggcaucuaagagaaagaaaauagaauaggaaaaagauuacuuaauagcuacgaaguaguacuuacaguauucuaaagagccagagacucuucuuuacagcuguccgaggagcuaguagggcaaacugcucccugagcugggccgaucuuuugacauccuucuccgagaaacaauauucuuuuucaguuauuacaaagaacugcuguugugaugacuaguuauuugcuugagcaguuccauauuacauaauccugugccacaaaacacccuguacacuaguggcugggauauuauucauuuccacuaggcagcuaucucacuguugaaauuuauauccaaaagaauauuuaauuuuggcuuauuuuucuuauaaaauagggaacucgucuuaucauuuuuaaguccucaccucagugugguacuucaaacuacuucaaauuauuacuauaauuaaaugcuucauuuuauauaauaauuaauaaaaaagguggcauaugcuuuuuaaaagcaccucugcauauguucccucauuuaaucguuuuacugcaaucuucuugaaauaaguaggggcaggugcuccagaugaagaaauuaaaggauuauaaaauuuagguaguuuuucuaaaagugaaugcugguaaagcccacacaaagauacuggucuuaagaguuccacucuagaauaucuuugauauuaaaauagcaagagucaguguucuauccacagacccaccacccucaguuaaaaugagagacacuggucaccagguacauaguauaaauggauauuuuggcuucaaaaaaauaaugaccagguuaucgaguccacccuacaauccagaugucuuucuuaaaaaaauuuuuuuaauaauaauaagcaauuuuucuggcuguauccuggcauuuggcacuuuacaauaacaauauacaaaggggacaacaagagauucuuaaccaggcaaucugcucuggaaagaagaaugcagagaaagugccaaccuuccuuccuggggagacaauuuuauaguguacacuggaaacacaaaauaaaggauggcaauccagcucccugggucugacuugccuucaguauuuugcacaguaaagcaguaacacaggugggcaagaaugguucuuguccccagaaucugacaauaauugaaacuaggaucauuaauaaaugaaagaaaaugagugaaggcuuauccaccuaguucaggccugcuuuucauagucaacacugcaccaacacaccaaagugguagggagaucuuggacugaugggcugaaaaaugggacaaucaguacuguguuuauuaauaacacagaaggggcuuuggguagucagcauacucagaagcaaugcgaaaggaaguagagggguucauguauaaugggugggaccaaggaaagugcaacugagaauuguuuaaguccaagagaaagggccuugucuggucaacauuacccagcaaagaggcaaaaggggcagggcagagggaagggaagagggagacagcacaaucuuaccuaauagcugcaaauauggacaccugagauugugagcaauagucuguaaaaaggggccaagggcacacaaggggcagagagagggaagacuucguauauaaagcaugacaccauggcuaccugugauuuuacacacuggcgcaaugcaaaaggguugggaguauggaccacuguuugauagacaagugcauggaauacuccaaugcuuauacuuuauuaugccaugggaaacuaagggugggguggggcgcuugcuuaacaaggucagggagggagaaaaccauugauaacugccauugugccuauuaacagucccaggagaaguuuugaguagucagcagccccugcaguaaugcaaaggggauacuagggcauaauaucccacucuaccagaaggagacauauauaauugcaaauauucacauuaacaguacaaggggccuuagugggucaguacccccgauguaagcaacgaggaagcaggagucuuaucuaaugaucagugcccuugauaauuguuauuaaugcuauuaauuguccaagagcugagauuaugaguaguuaacacuucucagcagcaauccaaaggguaaugggaggaacauagggucuuuuucuccuacacagguccacaaauacaauuaugacauuaauauuaaaagaaaaggguucauucauaauuaacaugccccugaugcaaggggaauauguggagaucaacucuuagucuaaaagaagagguggacaauugcauuaaugcauauuaaguccaaaagaaggggcacuuagugaauaucaucccccugcucuaaagcaaaggugguacaggaacaugcuuagagaauugaguuugugcacaugaacauuccaagugacagucuugaguagugggcacuaccugcuaaaaacacuaagaaaguagguaggauccuuaucuagugcacagaucaggagcaaauguaauugcacauauuaacaguccaaaacaacaggacuuugguugaucaggacacccuguuguacuacaaaggaaaggugaugggguaugaccuuaaucuacugacaaagacaaaagaaaauuucaauuauauguugauaguccaccagaaggggccuuggagggaaacaguauaccccacaguaaugcaaaagagguauaaugguccuagaagugauaggguuguggacaacugcaauuauucacauuaacuguucaaauguaaagaucauaaggagugggcacccacuauugaaaagagguggggcauccuugucuagggcacaagaaccaacauaaaugcaauuaugcaugucaacaagccaagaaaaggggacuuagggggucagcaacccugguauacugcaaauggagggugagaagguagaacuuuguuuaauuaggaugaaccauguggugauuacauacauuaauguccaagggacauuguuguggucaauuaaaaccauguacuuuggacaaauauaagaaucuuaaaaaguaguggguacuccuuguugaaaagcaaagggaguccaugagaaggugcccuuaucuaguacacaagaauauagacaagccaagcaaagaggccucagugaucagcaccccagcuauacugcaaagggggucugagaguaggacuuuauucaaauaggauaagccaugugcaguuaugcacauaaauuuccaagaugcaugguuguggucacuuacaauugugcaccuugauuguccaaauguaagggucuuauggagugagcacucccugcugggaggaaaagaaagauuaugcguagaugggauggggcagaggaggcuuccuugucuaguacacagaaaccuggacaaauauaaucacacacauaacaggccaggaaaaugggccuugguuaucagcaccccugcuguacugcaaaaggggucugagaguaaggccuuauucagaugagauaggccgugugcaguuacacacauuauugaccaaggugcauggcugcggucacuuagaauugugcaccuugacuguccaaauguaagguucuuauggagcuggcacucccugccagaagggaaaggaagauugagggugggguggggcaggggaggcuuccaugucuuauacacuggaacccagacaaauauaaucacauacguuaacaggccaggaagaggggccuugguuaucagcacaccuacuguacugcaaaaggggucugagaguaggaccuuauucagaugggaugggccaugugcaguuacacacauuuauguccaaggugcaugguuguggucacauacaauugugcaccuugacuguccaaauguaagggucuuauggagcggguacuuccugccagaagggaaaggaagauuggggguggaguguggcaggggaggcuuccaugucuauuacacaggaacuggaacaaauauaaucacacacauaacaggccaggaaaaggggccuuggugaucagcaccccugcuguacugcaaaaagggucugagaguaggaccuuauucagaugggaugggccaugugcaguuaugcacauucauguccaaggugagugccuaugcucacuuacaauugugcaccuugauuguccaaauguaaggguauauggaguggacacucccugguggaagggaaaggaagauuggaggugggguguggcaggggaggcuuucaugucuauuacacagaaacugggauaaauauaaucacacacauaacaggccaagaaaaagggccuuggugauucaguaccccugcuguacugcaaagggcaucugagaguaggaccuuauucagaugggaugggccaugugcaguuacgcacauuaauguccaauaauguccaaggugcauggcuguggucacuuauaauugugcaccuugauuguccaaauguaaugaucuuauggagggggcacucccugcuggaagggaaaggaagacugggagugggggugggggcggggggaaggcuuccuugucuaauacacaggaacccagacaaauauaaucacgcacauaacaggccaagaaaaggggccuuggugaucagcaccccugcuguacugcaaaaggggucugagaguaggaccuuauucagauggaaugggcaaagugguuaugcacauuaauguccaagguguaugccuguggucacuuacaacugugcaccuugauuguccaaacguaagcgucuuauggagagggcacucccugccggaagggaaaggaagauuggggguggaguguggcaggggaggcuuccaugucuaauacacaggaaccgggacaaacauaaucacacgcauaccaggccaggaaaaagggccuuggugaucagcaccccugcuguacugcaaaaggggucugagaguaggauuuuauucagauagguugagcuguguguaguuaugcaaauccaugucuaaggugcaugguuguguucacuuaacaauuacgcaccuugacuguccaaaugugagagucuuauggagugggcacucccugcuggaagggaaaggugagacugagguauguggagaggacccuccuuuucuagugcauaggaucccagacgauuauaaucacacacaacaugccaagaaaaggggacugcguuaucagcaacccuucuguauugcaaaaggggucggagaguaggaccuuauucacauggaaugagcagugugcgauuacgcacauaaauguccaagaugcaugcuuguggucacuuacaauugugcaccuagacucuccaaauaaaagggucuuauggggugggcacuuccugcuggaagggaaaaguggggaugaggggagcacuuuccuucucuagugcauagcaaccucgacaaauacaaucacacauauugggaggccaagaaauggggccuuaggugucaccaaccaugcuguccuucaaaaggaaggauacugauguaauugucauuaggcacauuaacaguuugagaaaggggccuuaagugaauaguaccccaugcaauaaagcaaagagggugugauaggucagaaacccaagucuaauugaaggaccauugacaacugcaauuacaugccaucuacaguucgaagagaagggcuuaauauugauuagcacucucugcuuugauaaguacaggaguccugauaaaaggcacaacuguaugcaacugaaaauguguauauaacaccuaagauuaugcacgcuaacuuuacuagucuaagggucuuaaguaguagguacuuccagcugggauguaaauacagugggugggguccuuacaugguaaaaaaguacagcagcaaauauaaguaugcacauuaacaguccaagagagugaauucaggcuaguuagaagcuccugcaguaaugcaaauggagcaaggaagcgggauucuacucuaacauaggggcacaucaacuacugcuaauuaugcgcauuuaagcaguauaagagaagaagcacuagcuaguuagcacuccugcugcuuugccaaggaggugugagggggaugggauuccagggcaauugucuuacuuuuuuuuuuuuuuaauguuggccaggcuggucucaaacuccuggcaguaagggaucuucccaccucagccucccaaagugcugggauuacaggugugagccaccacacccggccucagggcaauuuugcauaauagaaauucaagaaagacuuuaggaaaucaguacccccuucuaugaugcugagaagucaagauauuagcuugauauaaaagcuagauauuagcuugauauaaaagacucaguucuaaucaauuagacauuugaaaugucuuagacaauugaaaucaauuaggcaauugaaaauaugcacauuaagagucauggauaauuagaaauacacauuaagagucccaagagaaggacucuggguuuccagcaucccuuucuauaauguaaaagggguagaauauagguuuaaagggagagaccaugaacauuggaauuuugcacauucauagucccagggaaagguaacauagguaauuaauaucccuugcuguaaaacaaggaggauaaaauggaucugaucugaaagacauuguugugaucaguugccaugguucacauuaacuauccuagugcaaaggucuugacuagaggucauccacugcugaacacuagggaagugaguggggucuuuagugcacaggaagagggacaaaugcaaguagcacauuaacaguacaaaagaaauguccuugugauuagcacccucuacuguaaugcuaagagggugugagcaguugggaucuuaauuuaauggaaaagaccauaauugcaauuaugcgcauuaacagucccaaguacccccugcuguaagacaaaaggaauaugaggggaugagaccccagacuaacagcagauagggaaauugcauuuugcacaucaauaauuucuggaggaggggcauuagguaaccagcacccucuugauguaaagcaaagaugaugcagggaccuugauauaaaagacucaguucuaaucaauuaggauugugcacauaaacuguccuaguacagaggucuugaguaguaaggguccccugcuggaauacaaagggaguggaaggguuagugcacaagaucguggacaaauacaauuaugaacaucaaugcacaagaagaguccuugggugaucagcccacauuguagcgugcaaauaggauacagagucccuuucuaauggacaggacucuggacaauugcaacugugcaaauuaacuguucaagagcuguuauugaauaaucugcacucguuagcaacaucccacagaaggugggauggggugagaauccauuuuuauugcacagaaccaugaauauaugcaauuaugcauaucaacuguuuaagagaaggaaacuuggguagucagaacucagcagcaauggcaaagaggacauccuagacuaaugagugggacuaugggcaauuaguguuuuacauauuaaugcaaggugguagguaguucacacuaucuaggagcaaugauaaaggcauacacauaagugggucuucucuguuacgcagaaccaugaauaauuacuauuguauccauuaauauuccaagggaaggggcucuaagaaugagucagucccacugcuguuaugcaaagauguuugcaaaggccauaguguaacuaacagaacuauggauaauugggauuuuacucaauaauuuaagaaacucuuaaaucucagguagucagcgcugccucaaggcaaaugcaagggcgacugguagucuucaugauuaaugggugagacaauuagcaauuacuacuuuguucuuuaauuguccaagaacagcaggauucuccagaagcacagcaaaaagcgcaguagggugccuuuguuuaauaggcaaagcuaugacaauugggacugagcauuuuaacuguccaacaaaagacggguugucugcgacccccugcugaaugcaaaugggguucagagugcugucuaauccaauggguaggauuauuggcaauuagaauuuuacucaaugcaaagaguuuuagguggccaacacaguacacaagaaaagaucacuacucaaaauugggacugugacuacagaagcaaugacagagaaaugguuucuccuuuaagggcaggggaucgagaaaaugauaaguaacucaaauugugggcaauaaugcucugauagaaagcucucaauugacauucccuaacuucaacguaccgaguaaggaaauucuuuguccugagaucacagacaaaugggauuguaugcauuaacugaaaauggucaaggagucaguacugaagaucagcaaugccaaggguaaacggaauaucccaguauaauaggauaagcaauggacaacuuauuuugagcacugaaucaaugaaaauuagagugacuuucgagagaagcugggcgggacugaggaacuaggacugggacuggggcuagggcugggggguuaggggacuggggcuggggcagggcuggggcggggugggaguagggcuggggcuagacuagggguuugcugggagcagggcuggggaggaacuggaugcuaggcaggcaggauacaacgaaaaauugaaauacuccaauauaauaagucugaauagaggacaccagaccacagcaauucaaguuuccugucugauaaguaggugauuagucaauuagugcagcaucaaggaugggaacaaagcaaggccuggaccuguguaaaccuucaaacacucuuuuuuacauuaggucaugaaguuaaauuuuuuacuguuucugugcuacagacucuucaaaggaaaauaguuaagucaauuucaaagaaaaugaccagcacauuuuuaaaacauuagaaaugauuugacuuugacuaucuacugccaaaaaaagguuaaggaauuuguaaugagaagcuaaaaacuuuaaggaauuuuaaggaacucaaaacaaaaacucauuaaauguaauuaaagugaauucuacaaauaaagccucuuaauacauuucuauaauagucacuuaagacuuaaauucaaacacuagcaaaccacaaaaucagacuguaugacugacauccaaaagauaaauauaaaucaaaauccgaccccagcauuagccaagggguagguguuccucuugaggaaggcaggaauuccucuucugccaccuguuggccaacgaucaucugugauccauucugguccuugccacggcucaccaccauguccacaccaagcaggccuggagcacugcccauggcaacagugcagugcagggcagaccagagggggguagggggguagggggguagggggguggggagguggggggugggggguggggguggggaguuggggggguugggggguggggggggagguauacuuagccuuaggugaggcaccaauacagaggaauggagggagguucagaccacacagccagauauccagcacugcaagaggcagcacuggacaggaggggacaaauaagaggggacagagguggaaaggcuaaauguccuugaaaagaccuugaaaacaccugguguaccgcccacugggagacauacacguggccccuccacuucuuucuccugacuggcuaaagacagcugcgaagugccaugcuaauucacccaggucuucgcugaguagcuggacagugugucaucagucuaauuccaucuucugcucuaauuggcugugaucaauuccacccccauuucuaauugguuggguuaugcagcaauccagcacuguccaucccaccuuuucucccgcucugcguggcacuaggcggcaaaacccgccaucuuuaacaaugcggcaagcccgccaugauguccacgugacaaaagccaugauauacauaugacaacgccugccauauugucccugcggcaaaacccaacacgaaaagcacacagcaaagacaaagaggcccgccauguuuuacacugcggcaagaccuucagccgccaucuuuuccugugugaccgcacauguccaccaccaugcuaaccacuuaacaaagccucgcccaucaugauguggccuucccgccacuugaacacugcgacagaacuggauccgccauuuuggacaaccuaacaaagcacagcccgccaugcugagcaaugccgcaaugucaaaaucgccauuuuaagcccugcaccuuagucuuuccuaaccuuccauuuuuaacuagucccuuguacugauaaaagaugauucuuacugccucccgauacaacaaucacgcaaagcuccuaacaagccccaaaucaauucauucagauagguuuagcucaugcaaugcacaugacuuccucugccugaccugcuaucauccaucuugccucccuaguuuaacuuagcacaaacgacuagcccuaagccgaguuaugcggcaagucuaaaauggcggccacuuuuccuccacaaucugaacacgcccuuagcuuaacugcagagucauucucugccaaagcgguagguacacucacacaccaccaaaugaucagcagcaaaaaaaaguguagauauuccagagagugcaacaacccacaaaaccaacauuuuuucauccauaaaaagcaccgaugggcgaugaaaaaaaaaaaucaaagcagguauccgcggccccgaugggccagaaaaacaaaaauuaaagcagguauccgaggccccgaugggcaaggaaaaauaaaaaaaaaaaaagcagguauccgaagccccgaugggccaaaaaaagaaaauuuuuaaaaagcagauauccgucaccccgaugggccagaguguuggggguucagaggggaagggaaucagcagguauccgauaccccgaugggcuaaggaaaaaaaaauaaaaagcagguauccgcggccccgaugggcgaauaaaaaagaauuaaaaggcagguauccacggccccguugggcaaagaaaaaauaauaaaaccagguauccgcagccccgaugggcaaaauauagaaaagagaguggaagaguaaaaaacugauccacaaaaaacagagaugucaaccaaaaaugauuccaaagaaaaauuccuuaaauauuaaaaauugccucaaaauauuccaaauacuuucuuuaaaaaaauauggaggacgugucaagaagacacuaggagaaaguauagaauuuaaaaaaauauuuuauggaauuuaggugauuuuuuuaaagaaauacgccauaaaggguguugggggacuagaaaauguucuagaaagaaccccaagugcagagagaucuucagucaggaagcuuccagccccgagagaguaagaaauauggcugcagcagcgaauugcagcgcuuuaagaacugaagg

SEQ ID NO: 192885 - RNA, 32094 nt, Homo sapiens
ccuucaguucuuaaagcgcugcaauucgcugcugcagccauauuucuuacucucucggggcuggaagcuuccugacugaagaucucucugcacuugggguucuuucuagaacauuuucuagucccccaacacccuuuauggcguauuucuuuaaaaaaaucaccuaaauuccauaaaauauuuuuuuaaauucuauacuuucuccuagugucuucuugacacguccuccauauuuuuuuaaagaaaguauuuggaauauuuugaggcaauuuuuaauauuuaaggaauuuuucuuuggaaucauuuuugguugacaucucuguuuuuuguggaucaguuuuuuacucuuccacucucuuuucuauauuuugcccaucggggcugcggauaccugguuuuauuauuuuuucuuugcccaacggggccguggauaccugccuuuuaauucuuuuuuauucgcccaucggggccgcggauaccugcuuuuuauuuuuuuuuccuuagcccaucgggguaucggauaccugcugauucccuuccccucugaacccccaacacucuggcccaucggggugacggauaucugcuuuuuaaaaauuuucuuuuuuuggcccaucggggcuucggauaccugcuuuuuuuuuuuuuauuuuuccuugcccaucggggccucggauaccugcuuuaauuuuuguuuuucuggcccaucggggccgcggauaccugcuuugauuuuuuuuuuucaucgcccaucggugcuuuuuauggaugaaaaaauguugguuuuguggguuguugcacucucuggaauaucuacacuuuuuuuugcugcugaucauuugguggugugugaguguaccuaccgcuuuggcagagaaugacucugcaguuaagcuaagggcguguucagauuguggaggaaaaguggccgccauuuuagacuugccgcauaacucggcuuagggcuagucguuugugcuaaguuaaacuagggaggcaagauggaugauagcaggucaggcagaggaagucaugugcauugcaugagcuaaaccuaucugaaugaauugauuuggggcuuguuaggagcuuugcgugauuguuguaucgggaggcaguaagaaucaucuuuuaucaguacaagggacuaguuaaaaauggaagguuaggaaagacuaaggugcagggcuuaaaauggcgauuuugacauugcggcauugcucagcauggcgggcugugcuuuguuagguuguccaaaauggcggauccaguucugucgcaguguucaaguggcgggaaggccacaucaugaugggcgaggcuuuguuaagugguuagcauggugguggacaugugcggucacacaggaaaagauggcggcugaaggucuugccgcaguguaaaacauggcgggccucuuugucuuugcugugugcuuuucguguuggguuuugccgcagggacaauauggcaggcguugucauauguauaucauggcuuuugucacguggacaucauggcgggcuugccgcauuguuaaagauggcggguuuugccgccuagugccacgcagagcgggagaaaaggugggauggacagugcuggauugcugcauaacccaaccaauuagaaauggggguggaauugaucacagccaauuagagcagaagauggaauuagacugaugacacacuguccagcuacucagcgaagaccugggugaauuagcauggcacuucgcagcugucuuuagccagucaggagaaagaaguggaggggccacguguaugucucccagugggcgguacaccagguguuuucaaggucuuuucaaggacauuuagccuuuccaccucuguccccucuuauuuguccccuccuguccagugcugccucuugcagugcuggauaucuggcuguguggucugaaccucccuccauuccucuguauuggugccucaccuaaggcuaaguauaccuccccccccaccccccaacccccccaacuccccacccccaccccccaccccccaccuccccaccccccuaccccccuaccccccuaccccccucuggucugcccugcacugcacuguugccaugggcagugcuccaggccugcuugguguggacaugguggugagccguggcaaggaccagaauggaucacagaugaucguuggccaacagguggcagaagaggaauuccugccuuccucaagaggaacaccuaccccuuggcuaaugcuggggucggauuuugauuuauauuuaucuuuuggaugucagucauacagucugauuuugugguuugcuaguguuugaauuuaagucuuaagugacuauuauagaaauguauuaagaggcuuuauuuguagaauucacuuuaauuacauuuaaugaguuuuuguuuugaguuccuuaaaauuccuuaaaguuuuuagcuucucauuacaaauuccuuaaccuuuuuuuggcaguagauagucaaagucaaaucauuucuaauguuuuaaaaaugugcuggucauuuucuuugaaauugacuuaacuauuuuccuuugaagagucuguagcacagaaacaguaaaaaauuuaacuucaugaccuaauguaaaaaagaguguuugaagguuuacacagguccaggccuugcuuuguucccauccuugaugcugcacuaauugacuaaucaccuacuuaucagacaggaaacuugaauugcuguggucugguguccucuauucagacuuauuauauuggaguauuucaauuuuucguuguauccugccugccuagcauccaguuccuccccagcccugcucccagcaaaccccuagucuagccccagcccuacucccaccccgccccagcccugccccagccccaguccccuaaccccccagcccuagccccagucccaguccuaguuccucagucccgcccagcuucucucgaaagucacucuaauuuucauugauucagugcucaaaauaaguuguccauugcuuauccuauuauacugggauauuccguuuacccuuggcauugcugaucuucaguacugacuccuugaccauuuucaguuaaugcauacaaucccauuugucugugaucucaggacaaagaauuuccuuacucgguacguugaaguuagggaaugucaauugagagcuuucuaucagagcauuauugcccacaauuugaguuacuuaucauuuucucgauccccugcccuuaaaggagaaaccauuucucugucauugcuucuguagucacagucccaauuuugaguagugaucuuuucuuguguacuguguuggccaccuaaaacucuuugcauugaguaaaauucuaauugccaauaauccuacccauuggauuagacagcacucugaaccccauuugcauucagcagggggucgcagacaacccgucuuuuguuggacaguuaaaaugcucagucccaauugucauagcuuugccuauuaaacaaaggcacccuacugcgcuuuuugcugugcuucuggagaauccugcuguucuuggacaauuaaagaacaaaguaguaauugcuaauugucucacccauuaaucaugaagacuaccagucgcccuugcauuugccuugaggcagcgcugacuaccugagauuuaagaguuucuuaaauuauugaguaaaaucccaauuauccauaguucuguuaguuacacuauggccuuugcaaacaucuuugcauaacagcagugggacugacucauucuuagagccccuucccuuggaauauuaauggauacaauaguaauuauucaugguucugcguaacagagaagacccacuuauguguaugccuuuaucauugcuccuagauagugugaacuaccuaccaccuugcauuaauauguaaaacacuaauugcccauagucccacucauuagucuaggauguccucuuugccauugcugcugaguucugacuacccaaguuuccuucucuuaaacaguugauaugcauaauugcauauauucaugguucugugcaauaaaaauggauucucaccccaucccaccuucugugggauguugcuaacgagugcagauuauucaauaacagcucuugaacaguuaauuugcacaguugcaauuguccagaguccuguccauuagaaagggacucuguauccuauuugcacgcuacaaugugggcugaucacccaaggacucuucuugugcauugauguucauaauuguauuuguccacgaucuugugcacuaacccuuccacucccuuuguauuccagcaggggacccuuacuacucaagaccucuguacuaggacaguuuaugugcacaauccuaauugauuagaacugagucuuuuauaucaaggucccugcaucaucuuugcuuuacaucaagagggugcugguuaccuaaugccccuccuccagaaauuauugaugugcaaaaugcaauuucccuaucugcuguuagucuggggucucauccccucauauuccuuuugucuuacagcaggggguacuugggacuguuaaugcgcauaauugcaauuauggucuuuuccauuaaauuaagaucccaacugcucacacccucuuagcauuacaguagagggugcuaaucacaaggacauuucuuuuguacuguuaaugugcuacuugcauuugucccucuuccugugcacuaaagaccccacucacuucccuaguguucagcaguggaugaccucuagucaagaccuuugcacuaggauaguuaaugugaaccauggcaacugaucacaacaaugucuuucagaucagauccauuuuauccuccuuguuuuacagcaagggauauuaauuaccuauguuaccuuucccugggacuaugaaugugcaaaauuccaauguucauggucucucccuuuaaaccuauauucuaccccuuuuacauuauagaaagggaugcuggaaacccagaguccuucucuugggacucuuaauguguauuucuaauuauccaugacucuuaaugugcauauuuucaauugccuaauugauuucaauugucuaagacauuucaaaugucuaauugauuagaacugagucuuuuauaucaagcuaauaucuagcuuuuauaucaagcuaauaucuugacuucucagcaucauagaaggggguacugauuuccuaaagucuuucuugaauuucuauuaugcaaaauugcccugaggccgggugugguggcucacaccuguaaucccagcacuuugggaggcugaggugggaagaucccuuacugccaggaguuugagaccagccuggccaacauuaaaaaaaaaaaaaaguaagacaauugcccuggaaucccaucccccucacaccuccuuggcaaagcagcaggagugcuaacuagcuagugcuucuucucuuauacugcuuaaaugcgcauaauuagcaguaguugaugugccccuauguuagaguagaaucccgcuuccuugcuccauuugcauuacugcaggagcuucuaacuagccugaauucacucucuuggacuguuaaugugcauacuuauauuugcugcuguacuuuuuuaccauguaaggaccccacccacuguauuuacaucccagcuggaaguaccuacuacuuaagacccuuagacuaguaaaguuagcgugcauaaucuuagguguuauauacacauuuucaguugcauacaguugugccuuuuaucaggacuccuguacuuaucaaagcagagagugcuaaucaauauuaagcccuucucuucgaacuguagauggcauguaauugcaguugucaaugguccuucaauuagacuuggguuucugaccuaucacacccucuuugcuuuauugcaugggguacuauucacuuaaggccccuuucucaaacuguuaaugugccuaaugacaauuacaucaguauccuuccuuuugaaggacagcaugguuggugacaccuaaggccccauuucuuggccucccaauaugugugauuguauuugucgagguugcuaugcacuagagaaggaaagugcuccccucauccccacuuuucccuuccagcaggaagugcccaccccauaagacccuuuuauuuggagagucuaggugcacaauuguaagugaccacaagcaugcaucuuggacauuuaugugcguaaucgcacacugcucauuccaugugaauaagguccuacucuccgaccccuuuugcaauacagaaggguugcugauaacgcaguccccuuuucuuggcauguugugugugauuauaaucgucugggauccuaugcacuagaaaaggaggguccucuccacauaccucagucucaccuuucccuuccagcagggagugcccacuccauaagacucucacauuuggacagucaaggugcguaauuguuaagugaacacaaccaugcaccuuagacauggauuugcauaacuacacacagcucaaccuaucugaauaaaauccuacucucagaccccuuuugcaguacagcaggggugcugaucaccaaggcccuuuuuccuggccugguaugcgugugauuauguuugucccgguuccuguguauuagacauggaagccuccccugccacacuccacccccaaucuuccuuucccuuccggcagggagugcccucuccauaagacgcuuacguuuggacaaucaaggugcacaguuguaagugaccacaggcauacaccuuggacauuaaugugcauaaccacuuugcccauuccaucugaauaagguccuacucucagaccccuuuugcaguacagcaggggugcugaucaccaaggccccuuuucuuggccuguuaugugcgugauuauauuugucuggguuccuguguauuagacaaggaagccuuccccccgcccccacccccacucccagucuuccuuucccuuccagcagggagugcccccuccauaagaucauuacauuuggacaaucaaggugcacaauuauaagugaccacagccaugcaccuuggacauuauuggacauuaaugugcguaacugcacauggcccaucccaucugaauaagguccuacucucagaugcccuuugcaguacagcagggguacugaaucaccaaggcccuuuuucuuggccuguuaugugugugauuauauuuaucccaguuucuguguaauagacaugaaagccuccccugccacaccccaccuccaaucuuccuuucccuuccaccagggaguguccacuccauauacccuuacauuuggacaaucaaggugcacaauuguaagugagcauaggcacucaccuuggacaugaaugugcauaacugcacauggcccaucccaucugaauaagguccuacucucagacccuuuuugcaguacagcaggggugcugaucaccaaggccccuuuuccuggccuguuaugugugugauuauauuuguuccaguuccuguguaauagacauggaagccuccccugccacacuccacccccaaucuuccuuucccuucuggcaggaaguacccgcuccauaagacccuuacauuuggacagucaaggugcacaauuguaugugaccacaaccaugcaccuuggacauaaauguguguaacugcacauggcccaucccaucugaauaagguccuacucucagaccccuuuugcaguacaguaggugugcugauaaccaaggccccucuuccuggccuguuaacguaugugauuauauuugucuggguuccaguguauaagacauggaagccuccccugccccaccccacccucaaucuuccuuucccuucuggcagggagugccagcuccauaagaaccuuacauuuggacagucaaggugcacaauucuaagugaccgcagccaugcaccuuggucaauaauguguguaacugcacacggccuaucucaucugaauaaggccuuacucucagaccccuuuugcaguacagcaggggugcugauaaccaaggcccauuuuccuggccuguuaugugugugauuauauuuguccagguuucuguguacuagacaaggaagccuccucugccccaucccaucuacgcauaaucuuucuuuuccucccagcagggagugcucacuccauaagacccuuacauuuggacaaucaaggugcacaauuguaagugaccacaaccaugcaucuuggaaauuuaugugcauaacugcacauggcuuauccuauuugaauaaaguccuacucucagacccccuuugcaguauagcuggggugcugaucacugaggccucuuugcuuggcuugucuauauucuuguguacuagauaagggcaccuucucauggacucccuuugcuuuucaacaaggaguacccacuacuuuuuaagauucuuauauuuguccaaaguacaugguuuuaauugaccacaacaaugucccuuggacauuaauguauguaaucaccacaugguucauccuaauuaaacaaaguucuaccuucucacccuccauuugcaguauaccaggguugcugacccccuaaguccccuuuucuuggcuuguugacaugcauaauugcauuuauguugguucuugugcccuagacaaggaugccccaccucuuuucaauagugggugcccacuccuuaugaucuuuacauuugaacaguuaaugugaauaauugcaguuguccacaacccuaucacuucuaggaccauuauaccucuuuugcauuacugugggguauacuguuucccuccaaggccccuucugguggacuaucaacauauaauugaaauuuucuuuugucuuugucaguagauuaaggucauaccccaucaccuuuccuuuguaguacaacaggguguccugaucaaccaaaguccuguuguuuuggacuguuaauaugugcaauuacauuugcuccugaucugugcacuagauaaggauccuaccuacuuucuuaguguuuuuagcagguagugcccacuacucaagacugucacuuggaauguucaugugcacaaacucaauucucuaagcauguuccuguaccaccuuugcuuuagagcagggggaugauauucacuaagugccccuucuuuuggacuuaauaugcauuaaugcaauuguccaccucuucuuuuagacuaagaguugaucuccacauauuccccuugcaucaggggcauguuaauuaugaaugaacccuuuucuuuuaauauuaaugucauaauuguauuuguggaccuguguaggagaaaaagacccuauguuccucccauuacccuuuggauugcugcugagaaguguuaacuacucauaaucucagcucuuggacaauuaauagcauuaauaacaauuaucaagggcacugaucauuagauaagacuccugcuuccucguugcuuacaucggggguacugacccacuaaggccccuuguacuguuaaugugaauauuugcaauuauauaugucuccuucugguagagugggauauuaugcccuaguauccccuuugcauuacugcaggggcugcugacuacucaaaacuucuccugggacuguuaauaggcacaauggcaguuaucaaugguuuucucccucccugaccuuguuaagcaagcgccccaccccacccuuaguuucccauggcauaauaaaguauaagcauuggaguauuccaugcacuugucuaucaaacagugguccauacucccaacccuuuugcauugcgccaguguguaaaaucacagguagccauggugucaugcuuuauauacgaagucuucccucucucugccccuugugugcccuuggccccuuuuuacagacuauugcucacaaucucagguguccauauuugcagcuauuagguaagauugugcugucucccucuucccuucccucugcccugccccuuuugccucuuugcuggguaauguugaccagacaaggcccuuucucuuggacuuaaacaauucucaguugcacuuuccuuggucccacccauuauacaugaaccccucuacuuccuuucgcauugcuucugaguaugcugacuacccaaagccccuucuguguuauuaauaaacacaguacugauugucccauuuuucagcccaucaguccaagaucucccuaccacuuugguguguuggugcaguguugacuaugaaaagcaggccugaacuagguggauaagccuucacucauuuucuuucauuuauuaaugauccuaguuucaauuauugucagauucuggggacaagaaccauucuugcccaccuguguuacugcuuuacugugcaaaauacugaaggcaagucagacccagggagcuggauugccauccuuuauuuuguguuuccaguguacacuauaaaauugucuccccaggaaggaagguuggcacuuucucugcauucuucuuuccagagcagauugccugguuaagaaucucuuguuguccccuuuguauauuguuauuguaaagugccaaaugccaggauacagccagaaaaauugcuuauuauuauuaaaaaaauuuuuuuaagaaagacaucuggauuguaggguggacucgauaaccuggucauuauuuuuuugaagccaaaauauccauuuauacuauguaccuggugaccagugucucucauuuuaacugaggguggugggucuguggauagaacacugacucuugcuauuuuaauaucaaagauauucuagaguggaacucuuaagaccaguaucuuugugugggcuuuaccagcauucacuuuuagaaaaacuaccuaaauuuuauaauccuuuaauuucuucaucuggagcaccugccccuacuuauuucaagaagauugcaguaaaacgauuaaaugagggaacauaugcagaggugcuuuuaaaaagcauaugccaccuuuuuuauuaauuauuauauaaaaugaagcauuuaauuauaguaauaauuugaaguaguuugaaguaccacacugaggugaggacuuaaaaaugauaagacgaguucccuauuuuauaagaaaaauaagccaaaauuaaauauucuuuuggauauaaauuucaacagugagauagcugccuaguggaaaugaauaauaucccagccacuaguguacaggguguuuuguggcacaggauuauguaauauggaacugcucaagcaaauaacuagucaucacaacagcaguucuuuguaauaacugaaaaagaauauuguuucucggagaaggaugucaaaagaucggcccagcucagggagcaguuugcccuacuagcuccucggacagcuguaaagaagagucucuggcucuuuagaauacuguaaguacuacuucguagcuauuaaguaaucuuuuuccuauucuauuuucuuucucuuagaugccaccuauagaaaagucagaggguccaguaaguuucuuuccuucuucccaccucaucugcaauauauauauauagagagagaaauagauacauacauacaugcauaaauacacauaugugaguuaaccagcagaacuguagaauuaauauuguggacccagcucuaugcuagguuacacugauaaccuggguaggaaugauaucauccuauauaauuucauuccugagaugauuuuaucguugaggagcuaaugugagcacauuugaaauaacuuuagaaaauaauaagugcuguuuugugugaaucauaaguaguaguuuuaggaagggaacccacaaggauuugaaguugauagaauaaacuuaaggaaguggguuugcuuuuucucuuuaagccaagauaggauuaauauugcagccaucuggauaguccaguugguuuauuuuaauuucauuuguuuuuuaccucuuuuggagccauggaaagagaugaaagggauagagcauagccauuguguuuggcuauuugcgaagguuggcaaauuagugauugcuaaaucucauaagcuugaguauuuuaaaguucagagauugagggcauaaaucuaauacuucggcuccuuccacaauuuuacuacauuucugcccaagaacagaugaccauggauaaugcauaucguagauacuuuuuaaguuuggaaccuuuuugccaagaggguaguggagaagugaagucaaaaccuugaccuuccuugccuacuuuaugcuguaguuuauauaccuucuuuccucccaccuuucguaaagcuaaaagaagcuuagccuccuuaauguuuuccagcugacaaaauauuguuuaacauaacauucgaaacuuuuuuucuggugcacauucaugcaucacagcaggagcaacaagaaccauauaagugaacuggcuucacuuauagcccguuuuaauucauauccauauuuccucagggcuuguuuccaugccucccagccccacuccauaugcuuaacaacauugucuggcugacugaggguuauauacaucauggucuugaaccuucuuggaaacauggucugugccauuguuucucaaacccaaguaaugcuucaugaugaaacaccuucuaaaggaacaaaauuuucugagauccuaaaaaaauguguuuugaggaacacugacuuaacaaagauauuugaaauguaaauauguuuuccaauuucacguugucuuugucaaagauguguuuuauauaacuuauguagaacuuggggauccauuagaauauauucacaaauccccaggguuaucaccccaauuugagaaacccuggucuaugcuuaugaaaucuucuauugguaauuaaauugucauucauugucaacauacaauuauaauuauuauuggaauuuguuuuaaaugaaugaauuuggaggugauucuguaccuuaagucaagaggaaggauggcuugauuuuagguggauugauuauacuagauagcauccaaaggugaaucuugaagcuguauuuaaauucauugcuugaaauaauuuccacccuuaagaaaaaucucuagcaauuguaaaaagggaugcucuggaaaugugggcaucuucaaaauagagauaauucuuguguuaguucaacaaauauuauuguaccaggugcuggaauaaauagcaaaaccaaagacaggauuuauaucaaggaauuugcuuucuuauggaggaugcagaaggaaaucauuaugguuuugggcagaaaugcuuagacuuuaguccuggcucugaguuugguucagaucaccaucaaucugaccaucucgagacugcuagugaaauaagauaggggcuuauaucaaauaccuaaaucccugaaaaugacauuuugugauuuggaaaauuuucaaaagucuaaugaaggaaacuuuuuuggcauuucuuuaaaugauuauugucauuucuuuucugacuuuucccuuuauaaaaccuuaacauguaggauuggaggaaguuuucugaccauuuucucauauccucuuucagcuuuaucuuucuguaacuuccauuucucuagccaccucccuaaauuacagaagacugugagacccagggcugcugugauuaggcauucauaauuucuuuucaggguguuugugcccugauuaucaaauguacagcuugaagggaguucaugucuuaaaguaaugaauuaagaguugaccuuuguugacugcuaaaauauucuuauaugugaaagcauccuggaaaaauacguuaccagcuuaaagagaaagaaacuaaugauuauaucugaacugagcuaaugccucuucucuucccccaaaccuuaucaguuuggauggcaaagaguaaugaugugucaguuaaacagagcuaaugccuuccucugccuugucuuaaagacuggauugggagaaaauugauauucucacuaccauauuuugggcuguaggcaaguagcauuuuacacagguuuccuucaaaaauccaacucaaguuggagcucauguauuuaagacauagcuggccugcugaauuuaacaaguuaaacuucaguggccauguacaguuauauaucacuauauauauguguauuaggcugucgaguuggucauguuuuuguuggugacuuaggcuuuacuugauagcucuuccuugaccuuuccaaauugaguacugauacauggagcuugggcuucuucugcaucuuauacaaaugaguuugguaaagaagccucuccuuuacuguuuugauguuuauauuagaaauaacuuuugauuauuuuuuuucauguuaggaugagaaacugaaacaaaauguaaauuugaccggugcuagacuucuuaaauuauggguagacuuaaaguauuauuuuccuuaaccaauuagaaugcuagucuucuaguguucccggaaacaugagagguuaugcaguagacccaagcaauacccucuuauuacauaaucaagugcguauaagaauuuaaaaauagggauaugacuggaacaucacuguacuuuaccaggucccauuauaaaauuaucuauguuacuuuacccauagcuuugaaaacuaguggcauaguauauuuuauaguaugcuguuagugugauuggcauugaacagugaugggauauaaucacucuacaaucuauauguuauuaaaguuuuccagccuuauagaucucccuugacugaaaauuagcuacuaacuuacgacuuauuuuuuacagcagauugacuaggucuuuccaggaaaucuguugauguacaaaaacaaaguuuaauugcuaauguuuuuuuaaaaaauaacuuuuugauauuacggauaccugguuauuugggccuuguauauuuuaacaucaaaauuaccuauuauaaauccauauaaacagaaaagaaagagaguaagucuuuagaucagaucugcaaacaaugaugguacguacuguagaaaaaucuggaacauagacuuaccaguucuuagguuccauuuugcuugcuuuuuaaaaacugugucuuauaagucuucagcaacugguugggagauuuuuagaaaaaauaaccuuuuaauguuagaacaguguagagauuuacagaaugauucugaagauagaguuucuguguacuucacacccaguuuuucccaguguuaacauuuuacauuaguuugguacauuugucacaacaaaccaauauugauacauuauuauuaacuagaguccauauuuuauucagauuuccuuaguuuuuccuuaauguucuuuuuguguuccaggaucccauugaagauaccacgcugcauguguccuuaguagucaugucuccuuaggcuccucuugguaaugacaguuucucagacucuuuguuuuugaugaacuucacaguuuugaggacuaaugguccaguauucuauagaaugucucucuauuggaauuugucugauguucuucucaugacuagauuggguuuaugaguguuuaggaggaagaccacaaagguagagugccauucuuaucacuuaucaagaguacauacuaucaacaugacuuaucacuguuuauguuauccuuaaucaccugucugagguacuauuugucagguuucuccagcguaaaauuagucuuuauuucuccauuucccuacuauacuguucacauaggaagucacuaugugcagccagcacuuaaggaaugggaaauuaccuuccaccucauugagggcagaguauuuacauaaauuauuuggaauucuuuugcacaggaugucuuuucuccacaauguauuguguuuauucagucauuuauaucaguaugaucucagggauauuuuauacucuggguuauaauacaguauuacuuuauucuguuguucaaauuguuccagcuuuggccauugggaggucuuucauuuggcuuugauauaaccccaugaauguggguuuuuuguuugagcacuuucuuauuuuuggaacuacaacaugcuucagacucauuugcauaucuccugccuggaccuaaaaugauguauuucugcaaggagccuugauacuuuuuauuggagaguaauauuagaaaucaagaagugaaugcuaggugcgcucauuacuacuggagugucauuccuucaagaccuuuucaguugacaagagcaaggagauauauauuugcauucuaacguguguauaugcacauagcuauaaauauauauaaccaucuguaucuauauuaaacuaaauguguuuauaccuacgucuccaacucuaaucauugccacauggaucauuauagucucaccuccuugcuuaucuguuaccucccauuucuacagugagaaaccuggcuugguugggaaauuuuucuguuaauauuacgguagugaguguuugacauuugcuucuaugguuaaguuuagggagaguuuagcuguaggguauucuugaaacuagaaaugacccuucugcccuaaauguuucugccaguuuugaaacguaaaauagguugcagaaacaaacuuuaucuuaagaaccagaauuuacuucaauccacauuuugacauugauuuucagauuaaauuauucugauaucgccagguaagcuguuccuuggguaugcauuucuucuuuccguuuuuuucuaagagcuaaaggacccugagaacacuggaggugggaaaggaagggaaaggcauguucacacgugggauaggaaagguucauuuacugaccuccagcuagccuuccaaagugccuauuuaagacccaaggaguagaugucuuccuuggcaauuguaacccaaauauaauuuuuaaccuuucaauuuuagucaagaaaguuggugugcuguuacaaaaagugcccugauuaacagcauugucaugugcauugcauauuaaucagcaauuuaaaauaacaugaaauuauguugaguauaauuuuaauauuuuauauuagauauuaguuugagacaguguuucucaagucuguauaauaaguuugauaguagggagguuuucucucaagaaaagaauuauucagugugcaccuacauaaucacugcuuagauucuacaauuaauauuuugcuauauuugauuaaacguuuucuguaaaagaaaaauauuauuauguacuauuuagguuuaugggaauaauuguuaaguuaaaguguaugaacaaaccuggaaugaaaucuguuugccuacaucuauaauacaacuauaaaacauagcagauguacaaauuaguaguuaauagauaacuaaaaugcaaauauggcacuacuauuauaguauuauaguuucuuuugaguggcgugucuguaauaucacaugcuguguugaugcacuucaccaaacugcuguuuucaaacugcuuuaaauccugccauuauagcacauagcaaugcuauuucacuuucauuuggcacaaaacacauuuauauauuguuugcuucucuucuuuucuguaauccccaggcaacaaaacuagaacauuugccacuaaucuggcaacgugguccuauauuaugaaguagucauauagcugaucuaaacuauccuuacagugaaaugagaguauugugaaaguuuuguagaaagcuccccauauguccugagaaucuaugcacagaccccacaguuaaaagaccuuugaauugugggaagacauggguuuaaguaucacuugguuaccuucuauuuguguaacauugagguaguuucaucuucuggguucccaguuuccuuagagaaugaaaauguugaauuaugugauuuuuuuuuuuuuuugagacggaguuuugcucuuucgcccaggcuggagugaaguagcacgaucucgacucacugcaaccuccuucccccaugaucaagcaauucuccugccucagccucccaaguagcugggauuacaggcacccgccccccaccccccgcccccagcuaauguuuguauuuuuaguacagauggaguuuugccguguuggccaggcuggucucgaacuucugaccucaggugauccacucgccuuggccucccaaagugcuaggauuacaggcaugagccacugcgccuggccuaugugauuauuaauaucacgucuagcugugacaauucugucugaugcuggaguauuugaaccagauggcuggcugugccacucaguuauucucuccauaagacuuugauauuuuguuggucugcaagaugacggauucucaaaauucuugucagugaauauugaacccuagugaaauguaugguucuguaucaguuccaaaauguaaccacuuucucuagccuuagauucccaguuccaaaauguaaccauuuucucuagccuuagauucccguuaagggaaagggaaugcucuuugaguaugucaucaccauaguaacaggcaaaacuagagggcuuugaugcuaaagcaagauacuccauaaauaugcuuaagaagacuuggggagacuggaauaguuguucccuuuuagaugccaguguauaaaugaauuugagcuaggauccguuuauuuaaaauuucuuuagguguauuugcuugcauauggagugcacauuuacucucauuaauggaguuuuaggaagcaguagaguaaaugcauaaacauguaugaaccgccauguuuaacuggaagccugcauuuggaagucaaguaucuaaucuuagauuaaauuaggauggggaaggauguuggcaagagauuuugaagcuuguucugcuuauauugagaacaucauagaacaguuuggccuuuuuaaagcuagagaauaguguugaauaagugauguuccauauauuccuguuugacauugacauaaagguuuccucaugauacaguaaucccugaucagggaucuggaagccuguauucauuuaagguacucagguuuaacauacugggugcuuuucacaccauacuauacaguaccaugcaaagugcuuucaagacugcaaauuuggcuuagauccccuuuagugagcuccuaugcuauaguaaagguagauagccaauuauuaaaaacagucaagacaauugcaccucuaagcaguaguagcaguugccacaccaccuugaaucuugaaguauuuucagcaacaggaugaccauuagccacaaauuuagugucagcccuuaaggucgguauugguuugacccauauuuucauguaguucuuuuucuucacuugucuaaucuucccguguacugccagggcuugucauuagaggacuuuagggagaccaagcaggcuagaaaguagagacaggagauaccuaugucuaaugcuucaguuuauacuuccuagguuuuuuucauugggguuuuuguaacucuuuugguauccuaccggugcuuugguagccuacugaacccugucuuucuucuuaaggacauucugagcaugugagaccugaggacugcaaacagcuauaagaggcuccaaauuaaucauaucuuucccuuugagaaucuggccaagcuccagcuaaucuacuuggauggguugccagcuaucuggagaaaaagguaguuuggggaauuuauuguuguagugcuucugucuuuggauugaacuucccacaacucuccuuuuuaaagcagaacacagcugggcaugguggcuccugcuuguaauuccagggcuuugggagguugagguggggggaucacuugaggccaggaguugaagacccaugucucuacaauaaaauaaaauuaguugggcauggugguacgugccuguaguccuaccuacucuggaggcugaggcagcaggauugcuugagcccaggaguucaaggcugcagugagccaucauuagccacugcacuccagccuagguggcagagcgggacccagucucuuaaaaagaaagaaaagcagaacgugagccaguuuucaucaauuccuauacuuuuucuuuugcauguacacauacauuuuaacuuuacauaaugaguucggccuguuucauuuaucccucagagcugggcuccagugaggucuguaagggcaagcauacuugauccccaaugaagaaugagagaugcaaagcacuaaauuauuucuuuucucaccacacagcaagauagauuuaaugaacuuaacaccuuuugauuaguggccuuuuaaauuauucccacuuuccuuuggcagauggguauuaaguucucaggauuuguuuacaaauaagacuaacuucaucuguauuagcucaguuuugguaggccuaauuccauuaucacugccauuuccuuguuuuaagaaaucaaaauuucuuagcuugaaaaacaauugaaauuguuaaaaaguggaauaggagagccccgggggccuguauaaggaauuuacugaaucccugguuuucuguaccuuguuuuuccuucugcauagauuugcuuaacuguuuuuguggcguguauuuuuuuuuuuucgcaguuucgcucuuguugcccaggcuggagugcaauggcgcaaucucagcucacugcaaccucugucuccuggguucaaguuauucuccugccucagccucucgaguagcugagauuacaggcaugcgcgaccacgccaggcuaauuuuguauuuuuaguagagacgggguuucuccauguuggucaggcuggucucaaacuccugaccucaggugauucacccgccucgaccucccaaacugcugggauuacaggcgugagccaccacgccuggccagcuguuguuauaacuggaguucuaugugcuugugaccauucuugguuucuccgaauauccuagaacuuugguggcgcccuauuauacagguuguugaagaaauguuaccauguggauugaguaggaaacaauucucuuuaucuuggcaauauuauggcauggcacuacuuaaaguacaaauuaaaagagggggaugcuacagaacuagcugacaggcacuuugauagagguggauuucucaguucuuaaaauagcucuuuauaaaggaagccagaggcauuguggaggagaauucuuacauaacucauaggguuagaccacauccgaccuuuucuguguggcuucauggcucucuugguugagaaagcauuaguuucuccuuccauuaguuucaaccucuugauuucuugaccccccuacuauauuuugugcugagaacacaaggguauuaacaacccacauuguagaggaucgcucaguaauaaagacuggagaauaaaaugcagcaugggaauauuggcaauuacucaguucuaaauuucucuuggaaaugagggaaagcauacagaauagagcuggaaugaauaggauaauuuuuuuuuuuuuugcuaaguugguagccagaauauaacagcuccgcacaacuguaaauguccacucuucaauccacaugaagaaaaggguaaaaauaugguugaacucaaccacuaguugcccauuagaacagacuuucccaguguacugcauuucaauacuuuuucuuuuaucucuuuucagaucuuccucagaagaauaggcuuguuguuuuacaguguuagugauccauucccuuugacgaucccuagguggagauggggcaugaggauccuccaggggaaaagcucacuaccacugggcaacaacccuaggucaggagguucugucaagauacuuuccuggucccagauaggaagauaaagucucaaaaacaaccaccacacgucaaggugcguaagcugucccuaaaagcauaauaaguagucuuaauuuugauuuuguuuuccaguauacauugcacuuaguguuucacugaggucguauucaucauuauucugcauaugauuugguaaaaacagcuuccuaacuaaccugggaagcaacugggugugagauuaacugguuaaagugaugauguaaagaggguagcggguugcauguguucggguguuuggagugggacuauagcacguggcagaggcuuacagcuaaguuguucuuuuaggagaacauggacaacugucacaucagugacauugaucacaugggcaaaucauucuguuccaugugguccccaaagucucucuuaaagccuuacagaagaacuuugccaaucauuuacauacuucaggauggcuugggaugccaugguguauaauacaacaagugagaggugugucuuuuuaugcuaugguugcugauugauggaagccgcauaaauacaaauggaaaccugacuaaaaauggcacaaaguuaucugucaucaggcaggagcuaaagaaccaggacccuacauucucuaggucaguguugggagaggcugauuagcgagugagaauuggcagauaaaggugaccauucggugcaauaaauccugaacguauaggcuuugcccagcauucuucguaaauaguggguagcuauaaauuucaugaaauauuuucauggguaagaacucuugaaauguuauaauugacuagaaaucucuguagauuuagaaauagagaguuacuaacaaauuguuagaaagucuaggaacuagaaagcuaaguugagaguuaucuaggaagaucuaucuauuguacucauaaucuuuagauaaauucuccuagggccaguagucuaugugaauuuucuuuuucuucuucuucuucuucuuuuuuuuuguauuuuagcugcaauguuaaacaaccuaugugaauuuucuuauugugagaauauuugccuuccagagugacucaccuuuaucucaaagagcaauauugugaguuuugaaaaugcugcucuaaggcuguguuuuguuaguccugagccaggagacuuaaagcaaacuugaggggucuuaaaacaucgaagugagccuuaaacauugggaagaccuuauguuuuucccucucauaucuauuauuuuugugaucucaguuauuaaucauuuaaagggacucuuuccuagcugauuggcacuuaaaacaggauggaagucuuuuuuuuuuuuuuuuuuuuugagauggaguuuugcucuuguugcccaggcuggagugcaauggugcaaucucagcucacugcaaccucugccucccggguucaagcgauucuccugccucagccucccaaguagcugggauuacagucaugcaccaccacgcccggcuaauuuuguauuuuuaauagagacgguguuucuccauguuggucaggcuggucucaaacuccugaccucaggugauccgcccaccucaaccucccaaagugcugggauuaugggcgugagccaccgcgcccggcaguucuggucuuuaacuaagguauaaggcuaugacugguaguggugucucuagugacucaucaagugauauuuggcaagacauuuucccauuuaugccaguuuccuauucuguugaaugaggaaauuuucucucuaaagaccuaaaaguuuugacuuuauagguuucaaaguucuguggaaacauuuucuauugcuuauuaauuugaaucuuauguaacucuagcacaguacucaauauuuauggcauuuacaugguuuaucucauguuuuuuuauagcucuucauuguuccuaucugccaaaucauuauacuuccuacaagcagugcagagagcugagucuucagcagguccaagaaauuugaacacacugaaggaagucagccuucccaccugaagaucaacaugccuggcacucuagcacuugaggauagcugaaugaaguaaguuguugauguugcaguccugugaggaucacuucagaacuguuauaacagcuguuuuuugggagcugguguuggaugggguguguuggucuaaugugaaguggggcuaaaugugagauggaaagaugaccagucuuccauauuacugacuggguucacugaagcaacucaaagacauuauggucuucuuaccaguuguaucacagaagaauuuagccuuugcuuguguguucuaugucuucacuguauaggcccucugucauucuuagagccuuaaacguugagaagcuuaaaacaccauuucugcuuucugcugaaaggguaacccuuucucaucuccguuugugagagacucugucgucaguuaagauuaguguaaaaagaaaacuaaacucugaaguagccauuauaaaagugugagaaugaagucaguuuucuaaagaguuggggaaaggugaugcuaaaggaggggauugagcaaguccuaucaaagagccuuuuaugaaaauacuuagucaucugugacaucccauuuggcucuuccagaaauccuaguaaauaguuguaacaggauguuaagaggcauacauuguguguuuuaaauccucugcuacucauuagguauaugaccuuugacaacuuaaagucucuagacuucucuguuugugaggguuaaaugaaaucauguauguaaagugcucaccuauugcagugccuggcacaugucaaguaaaagguaacccaagaagacucauaaguucauuucccacaauauaagugaccacuagcacuaucagguagcaggcagaguuggcaugcuuugguucuauguaagaaaucccuaagguaaaaguuuauaaauagaagagcaucuguguugguauuggugguuguuauuauuguaguacuauaaguaguauucguaguaacaauaguuuauuauaauuacuaaugacacuuuuugauuuuuuuuaucuuucugugaugcuuuucaugccucuugugccccucacuguaucuugccucuucuacuacuuacuuccucugaaugucugccuuugcuuaucucuugcacucaaguguguauuucuuugucucuuucuuucuugucuuugcucuuuguucucuaucuaaagugugucuuacccauuuccauguuucucuugcuaauuucuuucgugugugccuuugccucauuuucucuuuuuguucacaagaguggucugugucuugucuuagacauaucucucauuuuucauuuuguugcuauuucucuuugcucuccuagauguggcucuucuuucacgcuuuauuucaugucuccuuuuugggucacaugcugugugcuuuuuguccuuuucuuguucugucuaccucuccuuucucugccuaccucucuuuucucuuugugaacugugauuauuuguuaccccuuccccuucucguucguuuuaaauuucaccuuuuuucugagucuggccuccuuucugcuguuucuacuuuuuaucucacauuucucauuucugcauuuccuuucugccucucuugggcuauucucucucuccuccccugcgugccucagcaucucuugcuguuugugauuuucuauuucaguauuaaucucuguuggcuuguauuuguucucugcuucuucccuuucuacucaccuuugaguauuucagccucuucaugaaucuaucucccucucuuugauuucauguaaucucuccuuaaauauuucuuugcauaugugggcaaguguacgugugugugugucauguguggcagaggggcuuccuaaccccugccugauaggugcagaacgucggcuaucagagcaagcauuguggagcgguuccuuaugccaggcugccaugugagaugauccaagaccaaaacaaggcccuagacugcaguaaaacccagaacucaaguagggcagaagguggaaggcucauauggauagaaggcccaaaguauaagacagaugguuugagacuugagacccgaggacuaagauggaaagcccauguuccaagauagauagaagccucaggccugaaaccaacaaaagccucaagagccaagaaaacagaggguggccugaauuggaccgaaggccugaguuggauggaagucucaaggcuugaguuagaagucuuaagaccugggacaggacacauggaaggccuaagaacugagacuugugacacaaggccaacgaccuaagauuagcccaggguuguagcuggaagaccuacaacccaaggauggaaggccccugucacaaagccuaccuagauggauagaggacccaagcgaaaaagguaucucaagacuaacggccggaaucuggaggcccaugacccagaacccaggaaggauagaagcuugaagaccuggggaaaucccaagaugagaacccuaaacccuaccucuuuucuauuguuuacacuucuuacucuuagauauuuccaguucuccuguuuaucuuuaagccugauucuuuugagauguacuuuuugauguugccgguuaccuuuagauugacaguauuaugccugggccagucuugagccagcuuuaaaucacagcuuuuaccuauuuguuaggcuauaguguuuuguaaacuucuguuucuauucacaucuucuccacuugagagagacaccaaaauccagucaguaucuaaucuggcuuuuguuaacuucccucaggagcagacauucauauaggugauacuguauuucaguccuuucuuuugaccccagaagcccuagacugagaagauaaaauggucagguuguuggggaaaaaaaagugccaggcucucuagagaaaaaugugaagagaugcuccaggccaaugagaagaauuagacaagaaauacacagaugugccagacuucugagaagcaccugccagcaacagcuuccuucuuugagcuuaggugagcaggauucugggguuugggauuucuagugaugguuauggaaagggugacugugccugggacaaagcgaggucccaaggggacagccugaacucccugcucauaguaguggccaaauaauuugguggacugugccaacgcuacuccuggguuuaauacccaucucuaggcuuaaagaugagagaaccugggacuguugagcauguuuaauacuuuccuugauuuuuuucuuccuguuuaugugggaaguugauuuaaaugacugauaauguguaugaaagcacuguaaaacauaagagaaaaaccaauuaguguauuggcaaucaugcaguuaacauuugaaagugcaguguaaauugugaagcauuauguaaaucagggguccacaguuuuucuguaaggggucaaaucauaaauacuuuagacugugggccauaugguuucuguuacauauuuguuuuuuaaacaacguuuuuauaaggucaaaaucauucuuaguuuuugagccaauuggauuuggccugcuguucauagcuuaccacccccugauguauuauuuguuauucagagaaaauuucugaauacuacuaguuuccuuuucugugccugucccugugcuaggcacuaaaaaugcaaugauuauugauaucuaggugaccugaaaaaaaauagugaaugugcuuuguaaacuguaaagcacuuguauucuacugugauaagcguuguggauacaaagaaaggagcaagcauaaaaaagugcucuuucaaaaggauauaguacuaugcagacacaaggaauuguuugauaaaugaauaaauuauauguauauuugaggccaauuuguguuugcugcucugguaauuuugaguaaaaaugcaguauuccagguaucagaaacgaaaacacauggaaacugcuuuuaaacuuuaaaauauacugaaaacauaagggacuaagcuuguuguggucaccuauaaugugccagauaccaugcugggugcuagagcuaccaaagggggaaaaguauucucauagaacaaaaaauuucagaaaggugcauauuaaagugcuuuguaaacuaaagcaugauacaaaugucaaugggcuacauauuuaugaaugaaugaauggaugaaugaauauuaagugccucuuacauaccagcuauuuuggguacuguaaaauacaagauuaauucuccuauguaauaagaggaaaguuuauccucuauacuauucagauguaaggaaugauauauugcuuaauuuuaaacaaucaagacuuuacuggugagguuaaguuaaauuauuacugauacauuuuuccagguaaccaggaaagagcuaguaugaggaaaugaaguaauagaugugagauccagaccgaaagucacuuaauucagcuugcgaaugugcuuucuaaauuauaaagcacuuguaaaugaaaaauuugaugcuuucuguaugaauaaaacuuucuguaagcuagguauugucucuacaaaauucucauuguauaguuaaaccacagugagaaggguucuauaaguaguuauacaaaccaaggguuuaaauaccuguuaaauagaucaauuuugauugccuacuaugugaacucacuguuaaaggcacugaaaauuuaucauauuucauuuagccacagccaaaaauaaggcaauaccuauguuagcauuuugugaacucuaaggcaccauauaaauguaacuguugauuuucucacuuggugcuggguacuagguuuauaaaauuguaugauaguuauuauauugugcaaauaaaguaggaaaauuugaauaacaaugauuaucuuuugaauacgcauacgcaagggauugguugucugaagaaugccacuauaguaguuaucuauugugugccaaucucauugcuaggcauuggggaugcaaagauaaaccaucuuuauugugucuuggguagcagaagaaaauauguguaaaaucaauuuauaauuuguaaacugccacccauauauaagcuauaucugcugaaugaucauugauuacucuuauccuuagagauaacaacugggggcacaaacauuuauuaucauuauugaaccuacaacagagaucuauguguagauuuacaaagccuacaguucuauacagauaggaaugaacuauuggcuuacugaauggugauuacuuucuguggggcucggaacuacaugcccuaggauauaaaaaugauguuaucauuauagagugcucacagaaggaaaugaaguaauauaggugugagauccagaccaaaagucauuuaacaaguuuauucagugaugaaaacaugggacaaauggacuaauauaaggcaguguacuaagcugaguagagagauaaaguccuguccagaagauacaugcuuccuggccugauugaggagauggaaaauuuuugcaaaaaacaagguguuguggucuuccauccaguuucuuaagugcugaugauaaaagugaauuagacccaccuugaccuggccuacagaaguaaaggaguaaaaauaaaugccucaggcgugcuuuuugauucauuugauaaacaaagcaucuuuuauguggaauauaccauucuggguccugaggauaagagagaugagggcauuagaucacugacagcugaagauagaagaacaucuuugguuugauuguuuaaauaauauuucaaugccuauucucugcaagguacuauguuucguaaauuaaauaggucuggcccagaagacccacucaauugccuuugagauuaaaaaaaaaaaaaaaaagaaagaaaaaugcaaguuucuuucaaaauaaagagacauuuuuccuaguuucaggaaucccccaaaucacuuccucauuggcuuaguuuaaagccaggagacugauaaaagggcucaggguuuguucuuuaauucauuaacuaaacauucugcuuuuauuacaguuaaaugguucaagauguaacaacuaguuuuaaagguauuugcucauuggucuggcuuagagacaggaagacauaugagcaauaaaaaaaagauucuuuugcauuuaccaauuuaguaaaaauuuauuaaaacugaauaaagugcuguucuuaagugcuugaaagacguaaaccaaagugcacuuuaucucauuuaucuuaugguggaaacacaggaacaaauucucuaagagacuguguuucuuuaguugagaagaaacuucauugaguagcugugauauguucgauacuaaggaaaaacuaaacagaucaccuuugacaugcguuguagagugggaauaagagagggcuuuuuauuuuuucguucauacgaguauugaugaagaugauacuaaaugcuaaaugaaauauaucugcuccaaaaggcauuuauucugacuuggagaugcaacaaaaacacaaaaauggaaugaagugauacucuucaucaaacagaagugacuguuaucucaaccauuuuguuaaauccuaaacagaaaacaaaaaaaaucaugacgaaaagacacuugcuuauuaauuggcuuggaaaguagaauauaggagaaagguuacuguuuauuuuuuuucauguauucauucauucuacaaauauauucgggugccaauagguacuugguauaagguuuuuggccccagagacaugggaaaaaaaugcaugccuucccagagaaugccuaauacuuuccuuuuggcuuguuuucuuguuaggggcauggcuuagucccuaaauaacauugugugguuuaauuccuacuccguaucucuucuaccacucuggccacuacgauaagcagguagcuggguuuuguagugagcuugcuccuuaaguuacaggaacucuccuuauaauagacacuucauuuuccuaguccaucccucaugaaaaaugacugaccacugcugggcagcaggagggaugaugaccaacuaauucccaaaccccagucucauugguaccagccuuggggaaccaccuacacuugagccacaauugguuuugaagugcauuuacaagguuugucuauuuucaguucuuuacuuuuuacaugcugacacauacauacacugccuaaauagaucucuuucagaaacaauccucagauaacgcauagcaaaauggagauggagacaugauuucucaugcaacagcuucucuaauuauaccuuagaaauguucuccuuuuuaucaucaaaucugcucaagaagggcuuuuuauaguagaauaauaucaguggaugaaaacagcuuaacauuuuaccaugcuuaaguuuuaagaauaaaauaaaaauuggaaauaauuggccaaaauugaaaggaaaaauuuuuuuaaaauuucucuaaauguaggccuggcugggcuuugaccuuuuccguuuuuaaaucacucacagagggugggacaggaggaagagugaaggaaaaggucaaaccuguuuuaagggcaaccugccuuuguucugaauuggucuuaagaacauuaccagcuccagguuuaaauuguucaguuucaugcaguuccaauagcugaucauuguugagaugaggacaaaauccuuuguccucacuaguuugcuuuacauuuuugaaaaguauuauuuuuguccaagugcuuaucaacuaaaccuuguguuagguaagaauggaauuuauuaagugaaucagugugacccuucuugucauaagauuaucuuaaagcugaagccaaaauaugcuucaaaagaagaggacuuuauuguucauuguaguucauacauucaaagcaucugaacuguaguuucuauagcaagccaauuacauccauaaguggagaaggaaauagauaaaugucaaaguaugauugguggagggagcaagguugaagauaaucugggguugaaauuuucuaguuuucauucuguacauuuuuaguuagacaucagauuugaaauauuaauguuuaccuuucaaugugugguaucagcuggacucaguaacaccccuuucuucagcuggggauggggaauggauuauuggaaaauggaaagaagaaaguaacuaaaagccuuccuuucacaguuucuggcaucacuaccacuacugauuaaacaagaauaagagaacauuuuaucaucaucugcuuuauucacauaaaugaaguugugaugaauaaaucugcuuuuaugcagacacaaggaauuaaguggcuucgucauuguccuucuaccucaaagauaauuuauuccaaaagcuaagauaaauggaagacucuugaacuugugaacugaugugaaaugcagaaucucuuuugagucuuugcuguuuggaagauugaaaaauauuguucagcaugggugaccaccagaaaguaaucuuaagccaucuagaugucacaauugaaacaaacuggggaguugguugcuauuguaaaauaaaauauacuguuuug

SEQ ID NO: 192886 - RNA, 140536 nt, Homo sapiens
uugcauccaaaauauuuuaauaguaaagaauaaagaaugacccucaauaaugcauucuuagcauucaaaggcuaacuuuacaaauuugaaaacuuaguaaaaacaguuuucaugaauacaagaaaaaguaacaacaauauauaaucaucuaauuaucugaauacaaugacagguuuccagacaauauguaguuaacauuuaggcuaaaaauauaaagaaacacaaaucauucaugcaaguauuuuuuaagucucaacuuccagauaaaauuuggcucuggcaaauaagaacaaaauauuaacuauaaguuucacguuauuaggcuccuuaacuacacugauucucugaaauuaaacaaauaacuuuucagcuucuuuuaguuuuuuuuuucuauccauuuuagcaauuacagcccaacgguccucccgcauuuuucuuauagcuccaaacuucaguguagauccagggguuguuagagaugaaggggccugaguacaaaauaaaauuuaaaaaucauaacauguuuaauuuuuuaagugcagcuuuuaaaauuugcuuucugaaauaaaauuuaaaagcuaccuuuuuugguguuuugacacaaagaugagaagcugguggauuauuguuccuauacaguguuuucaaugucucuucuucugaaaccaugcucuugaagaaaaauaaaaaaauaugauguuggguuuaccaucauuaauauuauauuauuaacauuuugucaacauaucacaugugaggagaacaaagaguagaaagaggaaggauguagaagggagaagggcaaagggaggaggaaagagaaagaagauuauagagagaagaaagaagaccaaacaaagaaaacaguaacaaaauaaaucaauuggccaagaaaggaccuagauuuuuauucuauuaacuguauuacugaaaggcuaugugaaauacaagacauguauagcgaguagcauuucucuacugauuucuauuucaguuucagagucuuuauaaugccaucuuguccuccuucccugaccccguuuauucaaacucacauuuauagcuuauaacaaguauuuauaauucuaaaaaaacuuauaauauuaucuaugauccagcaauuccacuucuggauauauacucaguagaauugaaagcagagucuugaagagauaauuguacacccauguuaauagcagcauuauucacaauaguuaaaacauggaagcaacccaaguauccauccguggaugaauaaauaagcaaaaugugguguauacauacaauggaauauuauucagccucaaaaaggaagaaaauucugauauaugcuacaacauagauaaaccuugaggacauaaaugaaaaaaaaaauggucacaaaagaacaaauccuguaugauucuacuuauaugagauauuuaguguagggaaaaucauagagacagaaaguagaauggugacugccagggccugggggaaaguggaauaaagaguuauuguuuaauggguagaagguuuuaguugugaugaagaguuauggagcuggaugguggugaugguuacacaacauuauaaauguauuuaauaacauugaacuauauaauuaaaaagaguuaagaugguaaguuuuauguguauuauaccaaaauaagaaauaaauauaauguugucacuuaauuuacaauuauuguaauucucccaaauaaugauagcuaacacuuauuuaguacuuucuaguaccagucucuauuuuaaucacuuugcauauuuuaauuccuuuuaaucuucauaacaauuuuauaaaguagguauaccauuauccccauuuugcaagugagaaaacucaggcauacaaauauuaaguaauguacccuagauuauauagcuaggaagagguggaaggaaauucaaauucagguaaucuggcuccagaaucccuucucuuaaugaauaugaaacacaauuuagucauguaagcagucaguucacacaauuuuuucaugcucauuaaagccacauuuaacaaaaacuucagaagcuuuguggaugagaaauuucaaacagauuuuuauaaaucuaagauuucaacagaauucaauaaauaagucauagagcuaccuuugcagauauacucagaaucaguguguaccaacugaccagcuuaaacaagauaaauuaucuuuaaaaucaugugguuuaaacuaucauuacaauuuuacuuagugcaagguaauugauuauucaucaugagucuccauauaaaaaugauuaauaaguuaauucaauuuaaaacaacaaaaccuuaucaucuguccucaugacucuucauagcauucaucuuuucauguguuuauaggccauuuauguuucaucuuuggagaaauggcuauucgaaucuuuucuccccacuuuucaauugggacuuuuugugguuauuaauugugggaguucuuuauauauccuagauaucaaucccuugucauauauaugauuuuuaaauauuuccucucacuauuuaccuugucuuuucacuuucuugauagucuccuuuaauucacaacaguucuuaauuuugaugcaguccaauuuaucuuuuuuucuuucauuaccugugcuuuuggugucauccauaaaaguugcugccaaauccagugucaugaagauuuugacaguguuuucgucuauaguuuuauaguuuuagcucuuaaguuuaggucuuucauccauuuugagucauuuuuuauaugauauaaaggauccaacuuaauucuuuugacauguggacaguuuucccagcaccauauguugaaaaaaauguuccuuccccauugaauggucuuggcacucuugucaaaaaucaacugacuauguaugugaggguuuaucucuaggcucucuauucuauuccauuggucugccugucugaccuuauacaaguacuaugcuguuuuaauuacuagcuuuguaguaaguuucaaaguuaggaacugugaguccuccaacucuauccuuauuuuucaagauuguuuuagccuuuuggggcccuuugcaauuccacauuaauuugaguauuuuuuccauuuaugcaaaaaaaauuguuggaauuuuuauagaaauugcauugaaucuggagauuuggguaccacugacaucuuaacaauauuuagucuuucuaucaauaaacauaggaugucuuuccauuuauuuaggucuuucaaaauuucucucaccaguguuuuguaauuuucaguguacaaguauuuuacuuccuugguuagauuuguuccuaaguauuuaaauucuuuuagaugcuauugugaauagaauuucuuucuuaauuucauuuuuugauuguucaucgcugguauauaaaaacauaaucaauuuuuguauguugauauuguacccuacaacuuugcugaauuuauuuauuagcucuaauagcuuucuuaaagagucuucgcaauuuucuaugcauaagaucaugucaucugugaagagaggcaguuuuaccucuuccuuuccaucugaaugccuucuauuauuuuucuuuuauaguaucucuaguuagaauuuacaguacaauguugaauagcagcagugaaagugggcacccugccucauucuuaauauuaggggguaagucuuucagucuuucaccauugaguaugauguuagcuagggguuuccauaaauacccuuuaucauguugaggagauuucccucuauuccuaauuuucugagagguuuucuaccaugaagcauguuggauuuugccagguaccuuuuuuugcaucacgaugaugauauggcuauuuuuuccuuugcucuauuaaugugguuuauuacacuguuuuauuuucuuauguugaaccucccuggcauuccugggauaaauuccacuuggccauggcaaauaauuuuuaauaugcuauugaauuugauucgccaauauucuguugaguaguuuuacaucuaauucauaagagauauugguccguaauuuuccuuucuuguggugccuuuauaugcuuugguaucaagguaauuaaugcuggccucauacaaugaguuaggagguguuccuucuucaacuuuuuggaagaauuuaagaagaauugauguuaauuauuuuuaaggucuuaacauauaugucaaauuuuuauucugagaaguuuuuaccaauuuauacuccucuaucaguguauuuggauucaagcuuccaauaauaauaaucacaauuuuaauauuaauugaucauuugcccugugccagaugaucugcuaaacauuuuauaagcauuauuuaacuuauucucaaaaagccgugaggugauuacuaauauuaucuguaugcaagggauacagauaaagagaugcguagggcaagguaugggggaaggugcauggcacuuucaugccuuucuugggugugccacccugugggaaauucccuguguucaguuauccagaagcucuaguguuaauucuuuaaauauuugguagaauuuaucaaugaagccaacugguccagaacuuuucuuuguugagguuuuugauuaccaauuuaaacucuuuacuuguuacaggucuauagagguuuucuauuucuuuuugaguucaucuaaggaauuugugaguuauaaggaauauuuccauuuauucuggguuaucuaauuuguuggcauacaauuauuuauaguauugucuuaugauucauuuuaucucugaacggucaguaguauccccacuuucauuuuuaauuuuguucucucucucuagcuaaaggugugccuauuuuguugaucuuuucaaagaaccaacuauuuuugguuucauugacuuucuuguuuucuauucucuaacuuagcucuguucuaaucuuuauuauuucccucaaucuacuagguuugaguuuaguuugcucuuuuuuuucuaguucuuuacuaagguauaaaguuagguuauugauuugagaucuuucuuaauaggcacuuauaacuacaaauuccucucugagcacuguuuuugcuguaucccauaaguuuagguauauuguguuguccuuuucauuaaucucuaaguauuuucuaauuucccuugugaauucuucuuugacccacugauuggcuaagaguguguuguuuaauuuccacaaauuuguaaauauuccaguuuuccuuaucuuauugauuucuaacugcaucccauuguggucaaauaaaauaucuuguguaaugucuauccuuuaaaaccuaugagauuugugaccuaacauaugaucuauccuggggaaugucucaugggcaccugaaagaauauguaugcuguuguuguuggguagaauguuauacaugucuguuagaccuaauuagcuuauuguguuguucaaguccucuaucuccuuaucuucugucugguuguucuauucauuauugaaaguggguuacugaaguguccaacaauuauuuuagaacugucuguuucucccuucaauucuaugaaguuuugcuucauauauuuagaaggucuguuauuaggcguggacauguuuaaaauugucauaucuucuugcuauauuaaacuuuuuauuauuaauguccuuuguguuucuugcacuuuuuaauuuaaagucuauugugucugauaguaguauagacacuucagcuauuuuuugguuacuauaugcacagaauaucuuuuuccauucuuucacguuuuaucaauuuguggcuuuggaucuaaaaugagugucuugaaaacagcauauaguuuucauguuuuuaaaauauauucugccaaucuauaucuuuugauaggagaguauaaucuauuuacauuuaaaguaaugaucuauaaggaaggacauagcucugaauuuugcuauuuguuuucaauaugucuuauaggguuuugucuccauuauuauaggguuuugucuccuccauuacugucuuauuuuccauuuaggugacuuuuguacuugaacauucugauuccauucucauuucuuuuuguguauauuauauaauuucauuguaguuaccauggagauuacauuuaacuuccuaaugcuauaacaaucuaauucaaauuuauaccaacugaacuucaauagccuauaaaaacucugccccuacacagcuccaucuucccuguuuuguuuuugggguuuuuuuugguuuuuuguuuuguuuuguuuugacaggaucuaauucugucacccaggcuggaggucaguggugugauuauggcucacugcaucccugaccucccaggcucaaaugauccuuacaccucagccuccuaaguaccugggucuacagaugugcaccacaaugccugacuaauuuccauauuuuuuguagagacaggaucucauuguguuacccaggcuggucucaaacuuccaccugccucagccucccaaaaugcuggguuuacaggugugagccacugugcccagcccauuuucuguuauugaugucacaaacuacaucuuuauacauugugcgccuaguaacauaaauuaaccauuuauaugcauuugucuuuaaaaucauauagaaaauaaaaacugaaguuacaaaccagaauaacaauacuacuagcuuuuauaaauugcccauguauuuacguuuaccagagauauuuauuuauucauacagcuucacugucuagcagccuuuccaucugaagaugucccuuuaguacuuuuugaagagcagguuuagugguaacagacucuuuauggcuuuuguuuaucuggaaauaucucaauuucuucuucauuuugaaugacaguuuugcuggauauaaaauucucaguugauaauuuuggucuuucagcacuuugaauauauaaauucacugucuucuggcaucuaacauuucugaugaaaaaucagcugauaauuuuguugagaauaacuugcauguaaugaguugcaucucucuugcugcuuucaagauucauuuuuucucccaacaguuugauuauaaaaugucuugaugggggcuuuuuggaguuuguugagcuucgugaauuuguauauucaugucuuucaucaaaauuugggaaguuuuuagcauuuauuucuucauauaacucuuuccaccucucucucucuuuuucucucucugucuacccccccaccucuuccucucucccucuucuccuucuggaauuccuacaauguauauauuggcccagcugauggugugcuacaagacucugaggcucuguucacuuuucuuuucuuuucuuuuucuuuuuuuuuuuuuuuugccguuuaucagacucaguaacuucaauugucuaucuuuacguucaccaauucuuuuuucugcuuacucaaaucugcuuuuaaaucccucuaguggguuucucauuucgguuauuguacuuucaguuccagaguuuuuuucugguucuuuuuauaauuucuaacucucuaucaauauucucauuuuauucacacaaaauuaggguuuuuuuuucuuuguccaugucuuccuuuagcaauuugagcuacuuuaagacagcuguuuugaagucuuugucuaguaauuccaaugucugagcuuccucaaggauaauuucuguugguuuguuuuguuccuuugaauggaucauauuuuccuauuuauuuguaugccuuaugauuuguuacuauuggucuuuugguuuaaaaaaauuuuuagagacaaggucucacucugucaccuaggcuggaguguagugacauaaucauagcugacuauaacuuugaacuccugggcucaagugauccuucuaccucagccuccugaguaguuagacuacaggccaugugccaccacaccuggcuaauuuuuuaaauuuuuguauagagagggucucacuguugcccaacuuagucucaaacucuuggccucaagaaaccuuccuaccuuggccucccaaaguggugaaauuacaggcgugagcuauugugccuggcccuuguuguugaaaacuggacauuugaauauuauacuuugguaacucuggaaauaagauuuucccucuuccccgggauuuucuguuuuuguuuguguucuguuuucuuuuguuuuacuguugaaagucugugccagggaucagccugagauaaaagcuuauggucuucucccgucuuuuuuaagccucuuugcuuaaacaugugcuauagcuaaauuccuuuuugcuuugcuuuugaauauccuaauccuuaaaugccuggcuucccaaaggguaaagauggaaaaagagaaaaggaaaaaaaaaaaaagauagaugugcuucauguaaauuccuggaaguugcuucagccaguggggguugaaacacugaacucugauguuugaaggacaaguccuauugcccccucuggcaccagcaagucacucagggaacaugagcauggcuuccugacacaggacuguaggcuggggagacugguagcugcuaucauauuuuaggcugaaaucaaccuaaauuaacugcaauuuaccagcuaaccuuuccccuggaagcuauaaacauucaaauaagacugcauacuuauaaaauaguuacuucagacaguuucugccaguauacuuuuugucuagguagagagauggauuccuggcacuuccuacuccaccaucuuccugaggucaugcucaacaacccauuuuuaaaucuuaauuuuuauaauuugaauguucaaaauuuaacuacauaagcuaagaaaauuacaaaaugacuaauagguucauauaauaauuauaaccaggaaacugauugugaaauguguuuuuagacuaguuugaacaauugugugcaauucuauaauacuguaauauguuuauuguguugcaaguuugugaugcuccuuuuagaaaugaaaugaaucauguugaaucauucugaaucucagaucagcuaagaaauuggccuaaacucaaacugcuagaauaauaacagggauuacaauccuagaauguuuaauucuaaagcucauuuucuuucuaauucucauuacauuuuuauauaucuggacuacauuuugaauuggcaguuaucaugugcaaugacuuacauagucuaugaagccagacuguguucaaauuuugguuccaugucuuacuaacuaugugaucuugaaaaauauacuugugugacucaguuuccucaucuguaaacuggaaagaacaguauauacugugaucucuuaguauccaugggggauuggauccaggaucccuccaugcaugccaaaaucuguggauguuuauguaaaaugauauaauauuugcauguaaccuauguacuuccuccuguauacuuuaaucaucucuagguuacuuauaauacccaauacaauguaaacacuauauaaauaguuauguuguauugcuuucuuauuuauauuauuuucuacugaauuguuauuuauuuuuuuuuuuuucaaauuuuuuggccuguaguugguugaauacacagauguagaaccugugaauacagaaggccaacuguauuucuaaaggcuggaauuguuauaagaaauaauuaaaguaaucuucguuguauaaaguguuuacaauaguaccugguucacaguuuuaauuguuaagauguugauaauuaucuauaaaacaaagggguucugaaguagggacucuauauguuaacuucaauauuuaggguuuuaagacuucaacuacucauuauuccagaaaaaaaugaaaauagaaggucccaaaguaguagaaaagcuugaaggaucuucuaguuauaagugggaauaauaaaacaaaugaauuuaacugggauuuugucauuaagaauuuuuggugcauugcuccauuuacucugguaugguucaccuuuuuaaaaaaauuaaaugaaucuaagcuucauuauucucaauaaaccauuauuaugccuucagaaaacagugguauaugugaaugggaguaauuagugauacaaagugcuagaggaaauagccugcuuaaacaugcuguccuuaauacauuaacuucuuuagagugauggaaauguuauaguugucaaccaauaccuugauauaaauaucaaccagugauguaaaaggagcauguauaauaugcaaaauagaggggacgccuaaauaacagauuuggcacaguaaaauauucacuccaucucucuuuuuaaaaauauaguaagaacuccuuuaugacauucuucuagaaaacaagacaaugauuaaucauaucguaugcccauugugcuauaucaaguauuuucaaagugccagguuuucugaaauuuacagggaaauuauuugaacccuaauuuuucugaaaugcugcaaaagcacaaggaucugcauuuuagcagagcuccacuguauaucaguauugcaaugguagguacuauguaaauauauuauacauguauaucaaggaaaauaguauacaaauaaguaauauaaauaaauacuaaauauuauuuguaaaauuuuuaccaaaagaucaguaguuucugaacuaucugaauuaauaucaaauucaaaggccauuuuucucuuuuuuuuacuuucuucaauggguauauucaaguuuucucuuugcuguaguuuugguuuuguuggugucuucacuguauaugccuauccaaaaauaaaaaaccauacauuaucauaucaaauaaaauaugcauuauuaauaaaggguuucacaaauaauuuuaaggcaauuugaguccuuagcaaucagaaaccuccauuauuauuggcaaguauaugaggcaaaaauuuuggauaagaauuuaauucaaauguuuuugauacuauaaguugucuuucuucaaaaauuuacaaugguagacuuucucugccuuuccuuuaacuugcugaagaaaauaagaaagagaaagagugaaacagagagacagacacacuccagauucagcaaucaacaaucuuaggggccuuaauauuucuaaucaugaucgaaaaaaauaacugagugagcuuugcucucucuacaaaacaccuuauuacauugugagaaaauaugcuugcuuauuuuuauauugguaaaguaauucacauuagucaauguuucacauucuauacuaucuuguaauuuuuauaauuuguaaaaguaucuuuaaaaaguaaggucaaaagccaaguacaguggcuuaugccuguaaucccagcacuuuggaagaccaaggcaggaggauugcuugaggccaguucaaaacuagacugagcaacauagcaagaccccaacucuaaaauuuuuuuuaauuaaaaaaacauagccagguaugguggcccaucccuauagccucagcuacucaggaggcugaagcaggagaauugcuugagccaggaguucaagguagcagugggccaugaucaugccacugcagcccagcccaggcaacagagcaaaaacaaaaauuaaauuaaauguaauuuaaaaaguuaaggucagagacaucaguacaaauggcagaguaaugagcucuaaaaauucacuccuccauaaaagccauaaaaauauugguaaaaacuugucggaaucaguuuuuuucagaacucuggaaauuaaccaaaggcuugcagccaccuggagagugcuuauucuuuaaaaaaauaaaauaaaauggcuaaaccucuuuaggaaacccaaacuucguggugucuuaacuuccccagucccauccccugcucuagcucuauguuauccuuaaagaauaacagcccacguuccuggggcagccuggcaaccaccagacagaacagaacagaacagaacugaagcucuuucaaagcuuuauucccaaagaauugucaguauuugauuugucuggugagucucugcaagaucccacuuacaaggcugauagcugauuacauucaaccugagggcucacuagugaaaaaaugccuucuccuuggugugugugugaaguagggggcagaauuugucaaaaacaacaaacguuuuaacuuugcagcaacgugaagcagugaugaauaguugggacaaacaaaagacuaaccaaaaaccuugaaagaaaagcuaggaaaugaaauauccauggggaagcuuugaaaagccuugauauauuccuggaaauauagaaggccacgcauauguguagggcuaucuauaggcucaggaagguccugaaaaggcccuaaguuuucaccacuggcuaaucuugagauucucuacaagcaggaauggaaagcuaaggcagaguugucaacuaccuggcuaaguguugaaagcaugcccuuauacacauauaauagagaccuuugacaaagauugggaaauuuauucauucuaggcauuugaagaaauuuguguccaaacauuagcuaaaaacuaagcuaaucaaggagaaccuuuaguggcacucacaacaaaaaauacaaacuuuacagaauuagucuagaaaagucacaaaacaaacaauaacuacaacaaguagcaacaacaaaucaugggaauaggagagaaucugauuuccagaguuguuauauuuuuaaauggccaguuuaaacaaaaaauaugagacaugcaaagaaagaagaaaguauggcccaaauagaaaaguaaaagaacaaacaacagaaacucucccugaggaagccuugacauuggacuuaacuagacaaagauuuaaagucagcuauuuuaaauauguucaaagagcuaaagaaaauuaugucaaagaaaugaagaaaagcaugaaaacaacaucucacuaaauggaauaucaauaaaaagaaauaaauuaucaaaagaaccaaauagaaauucuggaauuaaaaaauacaauagcugaaaugaaaaauuuacuagaagggcucaauagcagauuugggcaagcagaagaagaauccaugagccugaauauaauucaacugauauggaauagaaaaaaaaugaagaaaaacaaagucucagagacuugcagacaccuugcagacaccaucaaacacaacugggaaacugagaaggaaaaggcguaacauuuaaacuuagugggauggagacaauugagauccuuuucaacucccaagacaagugaggcaggaacuccaagagcaucuuuauaaagaauauuaggagugcuuccaagaaagaaagacuggcaucucauucccuaguuagauaugaauguaggcagcaaauuuguuugucuuuguaucuagcugaggagaggaaaaggaaacgagagagagguaagagagaucaaaaguaaagcaucugcacugccauuuagcauggaaaaguuguaugaauuccccauggauuaaguggcuauaugaaagacagucagaacugagccacuuugcuagaggcaucugcuccaagaugacugccaaggacuacagaugcaagaugauugggguaaacagcaaagggaaguaguaacuguggugaugcuauaaaaugucaagucagaaucagauuuccugugucagggccuuaaacacugauaaauaacuauuaaguuaugaaaucugcccaagaugacauuaaguuguggacagugaucgaaaaaaaugaaacaauuucauguugaaggccaggcacaguggcuuacaccuauaaucccaauacuuugggaggccaagacaggaggaugaguuaaggccaggaguucaagaccauccuaggcaacacagcaagaccuugucuuuacauuucaugcugauaccacaaaaaaaauugaaacuuucaagaaacuaguuauauaugugugcgugaugccagauauauggugauaacagaacuuuauuuauuuauuuaaaaaauuacuacuaacauggaaaauuuagacacaaaccuuuggcaaugguguagauaaaguauuuuuggcagauguccacagauagucucuuuuaucuuuggauaugccaugaucaacugaugugaaauuucgagauacaguuugugaaggaacugcuuuagaauccaauuuccaauaaauuucagguguuuccaauaaaaauguuuguguuuucugcauugaacaacaagaaugaauaaaaccaucacuaaaugucacauuaauuauuuauuucuuuaauuaaagugcagcaacuaguagaauucacaacaaaauaagcaaauuuaucccuaaauuuaucacugacuagauaaguuugaauaaguuacaguuaucuucuuugucacuuuacuuguccauuuaagaugcaaauguuaucugccccugccugucuucacagagccucuaugaaaacaaauaagauauccuggaggucguuauucuuagcaaacuaaugcaggaacagaaagccaaauaccacauggacucauuuauaagugggagcuaaaucaugagaacacauggacacauagagggagacaacaaaacacacuggggccuaugggagcaugcaggaugggaggaggaagaggaucaggaaaaauaacuaacggguauagguuuaauaccugggugacaaaauaaucuguacaacaaacccccaugacagaaguuuaccuauauaauaaaucuguacauguaccccugaacuuaaaauaaaaguuaaauuuuuaaaaaugaaaacaaauaagauaucucaacucucugaccaaaaguugaggauucucuuuaaaaaauaaaaaaaaaucuuuacuccugguggcaaaaagcccuaaucuaugguucauuacaauagccuaaaagucagaaggaaaucuauucuaacuuucauucguucucuuucauacauugauacuucuucuuuuucaccuauaaaaauaucagccuuuuccuauccaccagccuaacuugccuccaaaagcaaggagaauaauuaugaaaguaaagaaugagaaaaauuuucagggaaaaaaacugagaaaauggcuauuugcuucaauucuaaauaaauaaauugcaaguuuacucuaaauacuugacauuuuuucaacucaguuuccucaguucucuuucacucuaccuuuguauacagcuucuuuuagcaccugaccuaacuuucuaguaaaagcuaguaauaguugcuuuagugggauucuacaugaaacucaugcucaucacuuucuauuuuacaguuucuuuggucaccaccaucuccacgaauacaaucguggcaauuauucauaaggaaauuguaaggaaauugaggcauguuaauuuacucaauuccacagcuaguuagcugugaaacucaaauuccccuuuuucuagaaucguguucuuucaguucuccuacugccuuucauuguagagcccuccuuuacaggaccauguucuucugagaacaucucuccuuucucugaauucucuagagcacacacacacaaaaagggaauacaaggacaaaauuugaaagcaugguggcugaacuuucagugcguuuaaauuagaguauaggauaaagaggcaacuacauguacuauaaaaaaaucauugaacuaggagccagguacaucauauggucuuuucuccuagaucuuuccuaucuuuccggauuauuuaaguaaaucuucaaguaucuccaagcuuaaauuuauucaucuauaaaucaagaggcuaaaugagauggcuuauaucuuuccugcguaauucuagugaucugucauuucauaauccuuuuucuagcaaguaugaauuuuuucagaauugcauuucuguauccuuuucccuacauauuuauacaucauaguugaugacaaaauuuugaugagagcaauuuuuuuacugcucucuggauucaucagggguaaacuuuggaaccgccaaaauguaacugcuuuaauggacaaauuguuccucccuacagguaggagaaugacaauuuaaggucacugcaccaccuuguggccauaucuggaauuugacauuucgcugguagccuaaagaaaauucucaugugacaauacugaacuaucccuuuccagaaaauucacaauuuucucuguuguauuuuucaaacaaacauuuauaaggcaugugcuaugucccaagcacuauuuuaaauguuuuacaaauaccaucucauuuaauccucauaacaacuuuaggaaauagguauuauuauuaucccuuuauagaugagaaaauugaaacacgaagaaguuaaguaacuuguccaaacucagaaacguuugguaaauuuaacaagccuuauguuucaguaguguuggaauaaagcacagcaaaaaaaaaaaaagccuaguuaaauuucuucauucaucauuuuucucauuuuccaacauauauaugguucauuuuccaacauauauaucuagacucucagauaaaauauauggcauuugcuaaucuacuugauaauggaaacauauagaauuguacaugaaucaaaauaucucuauaagaauaugugauacauacuuucauaauaugaagacauucuaaauuuaaaaaagaauauuggagauuaaccaauuugcuuauauucauuagauacuuccuuaagucuauaucuaaccauucugcauaauuuuauuaugauuauaauuucuucagauauaauguuuucaagugucuagcacagugucuggaacauacaaagcacucaguauucacucacagguucagugcaucuuuccuuuauucucuuuuaacucaaguguaauaaaauauaaugaacuguucucaaacuacucugagugucauuuccuuccaguuuaacuauaaucagagcaaccucugugggaacuuaggagauuauaucacuauauguaaagaaaauucuuaaucauuuuaaccaaaaauuugcuaaaucaaaauucuucugcaaugauccuauauuaucaaauagguuagaagcugagggguauucuucuucucuaugacugauguuuccuuccauauguagggaguaccacuaggguaacauuccaaaccucuuccugauuccuuaggggagaaaaaauuacuuaaugugauuggugaauuuaaagaaaaggagaagcuggacacauacagcucagccucuuccuuauuacuccccuugagaacuauuagaauuacacauaaauucugcucuucuccuuuauacccuaaguuuuacaagagcagaugaucaaguggguagaccuaugcuagucaagcucuacuuguggcagaagauaaauuugucuaauuugggauuucaagauuaagagauccuauugccuucaaauauaaacugcauucuccaguauuuaaaauauugauacuuuuuaauaaagucuucaauaauaaaaauauuauuuuuauucucccuugucuuucucaauugguucagaauauaagugaggaaaacaggaugucauuuauuaagcccccucaaaacccaaaauuagacauaaucuaaauaaacuuuagaauuguuuaugaaaauauuuugccucuaacauuaaaaaauucuuaagagagaaacacagagguaccuaauuaaauuaaaacuauaauaagaauuguagagaaagacugaaaccuucuuuuuuucuucuuuuuuguuucugcauuagacugaaaccuucuccaaaucuccaaaugacaaaauuuugaaauuuuuagcuaaaaugcuuuugaauuaauaaauagcaagaaacaauuuagaaaaugaaauuguaugauauauguaaaauguuauuuuccuacuuauaaacaaaaaaucauuucuaaguagaaguuagaaaaugaauugguauuuuaaaacuaugagaauuauaugcucuuaccuugucuuuuuuuucuuuaagaguagcuguguuuucuuuugccucucuuuugaguuuuuccuauuaaaaauaaauaucaaguacaaguaacauaaacaucacaaugaucacaaaugaauauuaucaaaaucuuuccuaguaaguauuaacaaagaaagaugacgaaccucucaaucuuauaaaguaauaaaaagaaaaaaaagaaaaguuaguuccuuucuacagagguauuauuugguuuugauuaucucuuccuuuauucuaaucagucucuaguguauaucuguggacuuuugaauaagucucuuaaaacucugaaucucagcuuucuuauuuguaaaauaaagcuaauggaacaaauuacagaaugagagauacgcacaaguaacuaagcugugaaaaguugcaaaaagaucuaaaauauugugagccuuuacaggcagaauuagauuuuucuaugcauguugagaaaaggugcaguucaguuagacuuuggguauguguauagucaagauaaaaauggaaaggagagcuguggucagaauggaaagagugauaugcuaauaucauuagauagaauuuauucaguaagauaaaagaaaagccuggccuacauaaaugaauauguagggugccuguaauaugacaaccaucugaagcacaaaauuuuuacaacuccagggaguauuagaggucuuagaaaguaaaaaucuccaagugugcagaauuuuaggcaguaaaacucgcccaugaugucuaugccaguaucuauccucacugaauaccuugcauacaccauguuaucucucccauagcauugcuccuaaucacagaacucacuucacuaugaaagaagcuggcuguaaacugaugcaauaguauuuacuguucuuauuauguauccuauaaccuaccaaugguugaucuucaguuauagugacaauuggagucuacucuaaggggcuggaaugcugucuuuuaggacaaagcacauuuucuaaaccagcaauaucguaaugacucucagaauauguaucuuggcuucuagaggacagacgggagaaaccaucgccuacaacugcacugucucugcaauucugacuuuuccucgucuggagaucuugguaaagucucuucuaauauaauauauguuuccaagguaugaaacagcucauacaagaaugcguaucuuuagugguagcuaaauaaucaucaguucccuuaaaccaaagagauggccagaccacuaagguuccuauuuaaucugaauaaguaagauauuccuauaauacggccuggcaaacagagaguugacuugaucaccagaguagagaaugacaaccuuguaaccaaauuuuggaucuaaauaaacguaucagccuauagccuuuugaauaaaaaggaagccugguacucuaguggaaaaguucugaaauaauaucacaaauacauacugcauccuuccuacuaucuugugcaccaaggauuaaaauauuaagacauggguaauugcacaucaacuaacauuaauuauugggaaucuauaaugccacuauuuuuucacuggucagagugcaagcauaucagcaucaagcaauaauuagaauuuuaucagagucuacuucauggugagcccauggaaccauaaaccuaucuugugcucauuuuuuuagauucuaagaauauaguuugaacaaacucaauaaaaggaauaauccccauguuuguucugaccacagagucacagaguaagagauuuuaaaguugaaaggaccaacuuugaaucucucucuccauaucaagauaguaaacaaauuucacauugcuaggcagagauuaaggccccaucaaauuaaugaaagauauaggaaaaaugauuuaucauaaucccaaaaagccaaucuauuuuaauuagaaguuaagacagucaucuaguaacaguuuccuauaccaaugggcuuauagguaaaguggggauugucauauugacugagaacuuggaaaaaaguugcauauaaaagaugagcugaaucuauguaaauauaaagcucaaguuaaagagauacaggaaucauagugaaauaauagaauauacauuuuuaucaaucuugacaauguaaaauaauaaauacuaaaauuguauauguagggcaauaugaaacaggagacaguauuagauacauuauuuuaaaauauaaagguaaucaauaaacuaauuuaaaagacuacauauaccuuccaaaucaaccaaaguaagacacacacacacacacacacacacacuuacuuuagagaauaagaaagaaaauauguagugaauauguagugaaaaauaagaugacaaaaacauuauuaagauauauaaucaaugaagaguuaauauccagaaucauaaacaacuccuacaacucaacaacacaaaaauuggauuaaaauuauuauuaacccaauucaaaaaugggcaaaagacuugaauaaucaaaccaccaaagaagauauacaauguccaacaggcauauuaaaaauagucaccauugcuaaucauaugagaaaugcaaaucacagccacaugagauauugccuacacacauuaggauggccacuaucaaaugaauaggaaauaacaaaugcugauguggauguggagaaauuagaauccuuaugcacugcugugugggaaugucaaaugguacagucacuacagccaauauagagguucucagaaaauuaaugauacaguugccauaugaucuaagaaucccacuucuggaaauauauccaaaagaauucaaagcaagauuuuaaagagauaguugcacacucacauucauuacagcauuauucacaauagcaagagguagaagcaacucaaauguccaucaaaagaaaaauaauaaggaaaagaugguauacacauauaauagaauauuaugcagccuuuaaaaagggcauccuguuacauacuacaacauagauaaaccucgaggacauuaugcuaagugaaauaagccagucacauaagcacaaauacuguaugauuccacucauauaaaguauucaaaaucagaaacaggaugugcaaaggugguugccaaggacugggaggaagaggaaaagggaauucguguugaauggguauagacuuuuaguuuuacaagauggaaaacuacuagagaucuguugcacaacaggaugaauauacuuaacacugcugaacuguacauuuaaaaaguguuaagauggugcacuuaauguuauauguuuuuaucacaauaacaaaguuaaaguacaaaccauucaacuuaugcauaucaacauaaaagugcuaaauaaaauauuggccagcauuaucuaacaucacauuuuaaaaauacaucauaaccaaauagaguuuauuacagaaacacaagaauaaaucaaaacugauacauaucauaucaacaaauacaaucaggaaaacuagccuauuagucaaaaaaagacucuuggauuacagauucaaucaagguuaauaaaaaguagacaaaaacacaggagacaaauacaagaagaaagugagggucacaauaugaauaccagauaaagcugacuuuggggcaaaaauacaaaaauaaaguauacuauuuccaaaaaaaacaaugaauuaguauaaacuuuuauacaacaaauaguauucaucaaaauaugcaaugcaaaauuaguagagaauucaaaaggaagagaaagauaauaguaauagaacccuuaacuccuuuuagcucaugacugaucaaacagaaaaaauauauaagaaauuugaaguacacauaauugaaauaauacaguaaaucaaacuucuugguaaagaugguaaagccagcuuacaaaaucuuccuucuccuaaacuaacaacaacaacaaaaaagcaagacaggaagagaggaaagaaacaaaaguaguuaaaaacuggcaaaaauacauucaacaacaaaaacauacaaucucaugcuauaaucgguaauacuagugaggcucaguaagagagccacaauauacaaaugugcucauuucacccuacucacuguggcuccucacccuauuacuacuuguauaguauuggugaaagaaaaugaaaacauauaauaaugaaaguaaaggucacuaauauaccugaauuuuguaagaagagauuugaggacauaaauaggcaauccaggaaaaagaugccuagaaaaugcauaaugagugaucagcaggaaaaaaccacuuaaguuuauauuuuggucucucucgauuggagaaaggaagcacaaccacaaccauaaagaauuaguuauccuugccaauaaacagaacauacuagacauaaagucaaaagauaaacuucuuaaacagaagauuccucuaaaagaauacaaagcacaaaaagagacucacuaagagcaccagguaaauuuuaucuuuuucucugggcuccuuucaucacccuguaagcagaauaucccaaaucauauuuauaucuuuucacucacaaagcugugcaagugacauaacaagagcuugaagagacguaaaauggcaaaaauaaauaaccacggcuuauccuaucagauagacacacaggccccagggcucuacacugagcugguaaaaagaucugaagccugagggaaauacauaacaagaaaacuacgaaacacuggacuuaaucugcacuauagaccaaauggaucuaauagauauuuauaaauauuucauccaacaguugcaaaauaaacauucuucuccuaagcacaugaaucagucuuaaggacagaccauaugcuagccacaaaacaagucuuaaacauucaaaaauggaaaucacaucaaguaucuucucugacaacaaugaaauaaaccagaaaucaauaacaaagggaauuuuggaaacuauaaaaucacauggaauuuaaacaauaugcuccagaaugaccagugggucaaagaggagauuaaaauggcaaucaaaaaauuuauugaaacaaauaauuggaauacaacaacaaaaucuaaaggauacagcaaaugcaguacuaagagggauguauauagcuauaaacaccuacaucaaaaaggaagaaaaacuucaaauaaccuaaugaugcaucuuaaagaacuagaaaagcaugagcaaaccaaacccaaaguuaguagaagaaacaauaaagaucagagcagaaauaaaugaaauugaagaaaaugauacaaaagaucaacgaaacaaaaaguuuacuuuuuugaaaagauaaacagaaugacaaaccguuagccaggcagacuaaggaaaaaaagagagaggccucaaauaaauaaaaugagagaaggaaaaggagacauuacaaucaauaccacagaaauucaaaggaucgcuagagguuacuaugagguaaauauaugccaauaaauuuuaaaaccuaaaaauaaauaaauuccuagccacauacaaucuacaaagauugaaccaugaagaaauccaaaacuugaauaaaucaauaacaucuagcaagauugaagcuauaauaaaaagucucccagcaaagaaaaaccuaggacccaauggcuuuacugcaaaauuuuaccaaacauuuaaagaagaauuaauaccaccccugcucaaacuauucugaaaaauagaggagaggggguuacuuccaaacucauucuaugaggccaguaguacccuuaaaccaaaaccagacacaaagacacaucaaaaaaagaaaacuaaaggcccauaucccggaugaacauugaugcaaaaauccucaaaaaauacgagcaaaccaaauucaacaacacauugaaacaucauucaucauggcugugugauuuaucccauggaugcaagaaugauucaacauacacaaauaaaucagugugauauaucauaucaaaccauaugaucauuucaauugaugcugaaaaagcuuuugauaaaauuuaacaucccuucaugauaaaaacccucaauaaaacuggguauagaaggaauguaucucaacauaauaaaagccguauaugacagacucacagcuaguaucauacugaauggcgaaguacugaaagcugcuggagcaagaucucagcccuacacacuggaggucuggauauaaauuuggcucuguuggcuguugugggaguacagagggagugaaacuggccuugcuggcugugugggagcugggugaggccugucaaugccaacuuucccccuacuucccuggcgaacuguacaaagcaucagagggagccauaaucccccuuggaacauaacuccauuggccugagaaccacuaccccaccccucacaguggcagcagcaagcccugcccaaggaaagucugagcucagaaacgccuaacccugcccccaccugaugguuuuucucuaccugacguaguaacugaagacaaaagacauaaauucaugggagcucuauggcucugcccauuaccugagaaaccugaauacuuauccaggugauguuaggccaaguuuguaucccuccacacuaccaucgauguugcucucuuaaagacaacaccauguggcuggaagccaaccaacucaaggcauuacagcaacucauaacagaccaacccuacuccaaggaaggggaaaacaacaucuaauuccaccggcuguaacacccuggcuaaccagagguccugaacuuguucacaucacaacuucacugccagcauaaccagcauuugagaaaaccagcauacuaaacaaaacuacaaccaaggacucucauagagucugcuucacugcccugccaccuccacuggagaaggugcugguagccacggcugagagaccugaagaugaaucacaucauaguacucuucacagacacuccccacuaccagccuaaagccugauagcuccacuggguagcuagacccagaagagcaauaacaaucacugcagucaugcucucaggaagccccaucccuaggggaagagggagagcaccacaucaagggaucaccccaugggacaaaagaaucugaacagcagcccuugagucccagaucuuuccucugacauagucuauccaaacuagaaaaaaaaaaaacaauucugguaauaugacaaaacaagguucuauaacaccaucaaaagaucacacuagcucaccagcaauggaucaaaaccaaggagaaaucucugaauugccagaaaaagaauucagaaggucgauuauuaagcuacucaaggaggcaccagagaaaggugaaaacaaacuuaaagaaacuuaaaaaauaauacaggauaugauugaaaaaaaaucucugaagaaacagauaucauaaaaaaaaaucacagcuucuggaaaugaaagacaugcuuacagaaaugcaaaauacacuggaaaauuucaacaauagaaccgaacaaguaaaggaaaagacuuuagagcucaaagacaaggcuuucaaauuaauccaauccaacaaagacaaagaaaauauggggacagggggcuggcaagauggucaaauagaacagaucuggucugcagcucccagugagaccaaugcagaaggugggugauuucugcauuuccaacugagauacccaguucaucucauugggacugguuagacagugggugcagcccacagagggcgagcagaagcagggguggguguugccucaccugggaagugcaagggaccggggaacuccaucuacuagccaagggaagccaugaggaacugugccaugagggauggugcuaccuggcccagauacuauguuuuucuuaugguuucugcaacccacagaccaggagauuccauugggugccuacacaaccagggcccuggguuucaagcacaaaacuggguggguguuugggaagacaccuagcuagcugaagguguuuguuuuuguaccccaguugcacaugaaacuccaaugagacagaacuguucgcuccccuggaaaaggggcugaagccugggagccgaguagucuugcucaguagaucccauccccauggagcccaacaagcuaagauccacuggcuucaaauucucacugccaaaacagcagucuaaagucaaccugggaugcuugagcuuguugggggagguggaggggaguccaccauuacugaggcuucaguaggcgguuuucccuucacaguguaaacaaagccacagggaaguucgaacuaagcagagcccaccacagcauggcaaagccacuguagccagaccaccucucuaguuuccuccucucugggcagggcaucucugagagaaaugcccuggaacaaagcaccugggggaaggggcaccugugggugcagcuucagcagacuuaaauguuccugccugccagcucugaagagagcagaggaucucccagcacagugcucgaguucugcuaagggacagacugccuccucaagugggucccugacccacgugccuccuguuugggagacaccucccagcaggggccaacauacaccucauauaggaagacuccagcugguaucuggcgagugccccucugggaugaagcuuccagaggaaggagcaggcagcaauauuugcuguucugcagccuccgcuggugauacccaggaaaacagggucuggaguacacccccagcaaacuccagcagaccuacagaagaggacccugacuauuagaaguaaaacuaacaaacagaaagcaguaucaucaacaucaacuaaaaggaugcccacgcaaaaaccccaacugaaggucuccaacaucaaagaccaaaaguagauaaauccaugaagaugaggaaaaaccagugcaaaaaggcugaaaauuccaaaaaccagaaugccucuucuccuccaaaggaucacaacuccuugccagcaaggaaacaaaacuggauggagacugaguuugaugaauugacagaaguaggcuucagaagguagguaauaacaaccuccuccaagcuaaaaaagcauguucuaacccaaugcaaagaagcuaagaaccuugauaaaagguuacaggaagugcuaacuagaauaaccaguuuagagaacagaaaagaccugauggagcugaaaaacacagcaugagaacuucgugaaacauacacaaguaucaauagcugaaucaaccaagaggaagaaacgauaucagagacugaagaucaacuuaaugaaauaaagugugaagacaagauuagagaaaacagaaugaaaggaaugaacaaagccuccaagaaauaugggacuaugugaaaagaccaaaccaacauuugauugguguaccugaaagugacagggagaauggaaccaaguuggaaaacacacuucaggauauuauccaggagaaauuccccaaucuagcaagacaggccaacauucaaauucaggaaauacagagaacaccacaaagauacuccuagagaagaacaaccccaagacacauaauugucagauucaccaagguugaaaugaaggaaaaaaucuuaagggcagccagagagaaaggucggguuacccacaaagggaagcccaucagauuaacaguggcucucucugcagaaacccuacaagccagaagagaguaggggccaauauucaacauucuuaaagaaaagaauuuucaacccagaauuucauauccagccaaacuaaccuuaaagugaaggaaaauaaaauccuuuacagacaagcaaugcuaagggauuuugucaccaccaggccugccuuacaagagcuccugaaggaagcacuaaauauggaaaggaaaaacugguaccagccacugcaaaaacauaccaaaauguaaagaccaucaacacuaugaagaaacugcaucaacuaaugggcaaaauaaccagcuagcaucauaaugacaggaccaaauucacacacaacaauauuaaccuuaaauguaaacaagcuaaaugccccaauuaaaagacacagacuggcacaguggaugaagagucaagacccaucggugugcuguauucaggagacccaucucacgugcaaagacacacauagacucaaaauaaagggauggaggaauauuuaccaagcaaauggaaagcaaacaaacaaacaaaaagcagagauugcaauccuagucucugauaaaacagacuuuaaaccaacaaagaucaaaaaagacaaagaagggcauuacauaaugguaaagggaucaaugcaacaagaagagcuaacuauccuaaauacaugcacccaauauaagagcacccagauucauaaagcaaguuuuaagagaccuacaaagagacuuagacucccacacaguaauaguaggaaacuuuaacacuccacugucaauauuagauagaagaaugagacagaaaauuaacaaggauauucacgacuugaacucagcuccggaccaaacagaccuaauagacaucuacagaacucuccaccccaaagcaacagaauauacauucuucucagcaccgcauagcacuuauucuaaaauugaacacauaauuggaaauaaaacacccucagcaaaugcaaaagaacggaaaucauuacaaacagucucucagaccacagugcaaggaaauuagaacucaggauuaagaaacucacucaaggccgagugcaguggcucacgccuguaaucccagcacuuugggaggccgaggaaggccaaucaccugaggucagaaguucaacaacagccuagccaacauggugaaacccugucucuacaaaaaguacaaaaauuagccagguaugcuggcacaugccuguagucccggcuacuugggaggcugagacaggagaaucgcuugaacccaggaggcagagguugcagugagucaagauggcgccacugcacuccagccucaguggcagagcgagacuccaucuaaaaaaaaaaaaaagaaagaaagaaaaaagaaaacaggaauucacucaaaaccacacaacuacaugaaaacuaaacaaccugcuccugaaugacuacuggguaaguaacaaaauuaagguggaacuaaauaaguucuuuaaaaccauugagaacaaacacacaacguaccagaaucucugggacacagcuaaagcaguguuuauagggaaauuuguagcacuaaaugcccacaucagaaagugggaaagauccaaaaccaauacccuaacaucacaauuaaaagaacuagagaagaaaaaacaaacagauucaaaagcuggcagaagacaagaaauaauuaagaucagagcagaacugaaggacaucgagacaugaaaaacccuucaaaaaaaucaacgaaucuaggagcugguuuuuugaaaagauuaacaaaauagauagacugcuagccagacuaauaaagaggaaaagagagaaaaaucaaauagacacaauaaaaaaugauaaaggggauaucaccacugaucccacagaaacagaaacuaccaucagagaauacuauaaacaccucuacacaaauaaacuagaaaaucuagaagaaaugaauaaauuccuggacacauacacccucccaagaccaaaccagggagaagucaaaucccugaauagaccaauaacaagcucugaaauugaggcaguaauuaauagccuaccaaccaaaaaaagcccaggaccagauggguucacagccaaauucuaccagagguacaaagaggagccgguaccauuccuucugaaacuauuccaaaaagaaaaagagggacuccugccuaacucaguuuaugaggccagcaucauccuuauaccaaaaccuggcagagacacaacaaaaaaggaaaauuucaggccaauaucccugaugaacaucgaugugauaauccucaauaaaauacuggcaaaccuaauccagcagcacaucaaaaagcuuauccaccgcgaucaauuccugggaugcaacgcugguucaacauaugcaaaucaauaaacauaauccaucacauaaacagaaccauguaaaagccacaugauuaucucaauagaugcagaaaaggccuucgauaaaauucaacaccccuucaugcuaaaaacacucaauaaacuagguauugauggaacauaucucaaaauaauaagagcuaauuaugacaaacucauagccaauaucauacugaauaggccaaaccuggaaguauucccuuugaaaaccagcacaagacaaggaugcccucucucaccacuccuauucaacauaguaugggaaguucuggccagggaaaucagguaagagaaacaaauaaagggcauucaaauaggaagagagcaagucaaauugucucuguuugcagaagacaugauuguauauuuagaaaacccuaucaucucagcccaaaaacuccuuaagcugauaagcaacuucagcaaacucaggauacaaaaucaauguacaaaaaucacaagcauucuuauacaccaauaacagacaaacagccaaaucaugagugaacucccauucacaauugcuacaaagagaauaaaauaccuacgaauacaacuuacaagggaugugaaggaccucuucaaggagaacgacaaaccacugcucaaggaaauaagagaggacacaaacaaauggaaaaacauuccaugcucauggauaggaagaaucaauaccaugaaaauggccaugcugcccaaaguaauuuacagauucaaugcuauccccaucaagcuaccauugacuuucuucauagaauuagaaaaaacuacuuuaaauuucauauggaacaaaaaagagcccauauauccaagacaauccuaagccaaaagaacaaagcuggaggcaucaugcuacgugacuucaaacuauacuacaaggcucaguaaccaaaacagcaugguacugguaccaaaacaggauggaacagaacagagcccucagaaauaacaccacacaucuacaaccaucugaucuuugacaaacaugacaaaaacaagaaauggggaaaggauucccuauuuaauaaaugguauugggaaaacuggcuagccauaugcagaaaacugaaacuggaccccuuccuuacaucuuauacaaaaauuaacucaagauggauuaaagacuuaaacuuaagaccuaaacccauuaaaaacccuagaaaaaaaaccuaggcaauaccauucaggacauaggcaugggcaaagacuucauaacuaaaacaccaaaaacaauugcaacaaaagccaaaauagacaaaugggaucuaauuaaaugaaagagcuucugcacagccaaagaaacuaucaucagagugaacaggcaaccuacagaaugggagaaaauuuuugcaaucuauccaucugacaaaagacuaguauccagaaucuacaaggaacuuaaacaaauuuacaagaaaauaacaaacaaccccaucaaaaagugggcaaaggauaugaagagacacuucucaaaagaagacauuuuugcagccaacaaacaugaaaaaaaagcucaucaucacugaucauuagagaaaugcaaaucaaaaccacaagaagauaucaucucacacgaguuagaauggcaaucauuaaaaagucaggaaacaacagaugcuggagaggauguggagaaauaggaaugcuuuuacacaguuggugggaguguaaauuaguucaaccauuguggaagacaguguggugauuccucaaggaucuagaaccagaaauaccauuugacccagcaaucccauuacuggguauauacccaaaggauuauaaaucauucuacuauaaagacacaugcacacauauguuugcugcagcauuauucacaauagcaaagacuuggaaccaacccaaaugcccaucaaugauagacuggauaaagaaaauguggcacauauacaccaugaaauacuaugcagccauaaaaaagaauuaguucauguccuuuacagggacauggaugaagcuggaaaccaucauucucagcaaacuaacacagaaacagaaaaccaaacaccacauguucucacuuguaaguggaagcuggacaaugagaacauacaggcacagggaugggaacaucacacauuggggucugucagggguugggggcaaggggagggacagcauuagaagaaauaccuaauguagaugauagauuggugagugcagcaaaccaccauggcacauguauaccuauguaacaaacuugcauguucugcacacguaucccagaauuuaaaguauaauaaaaaagaaaaaauacuuuuaaaaaaaugaacaaagccuccaagaagcuugggauuauguuaaacaaaccaaccuaagaaaauuuguguuccucaggaagaagagaaaucuaagacuuuggaaaauuuauuugagggaguaaucaaggaaaacuucccugaccuugcuagagaucuagacauccaaauacaagaggcucaaagaauacccaggaaauucaucgcaaaagaucguaaucuaggcacauagucaucaaauugucuaaagucaagaugaaggaaagaaucuuaagagcugugaggcaaaagcaucaagcuaaccuauaaaggaaaaccuauuggauuaacagcagacuucucagcagaaaccuuacaagcuaguagggacuggggucuuaucuuuaggcuccuuaaacaaaauaauuaucagccaagaauuuuguauccaguguaacuaagcuucaaaaaugaagaaaagauaaagucuuuuucagacaaacaaaugcugagagaauucgccacuaccaaguuagcacuacaauaacugcuaaaaggagcucuacaucuugaaacaaaaccuaaaaauacaccaaaauagaauuuccuuaaagcauaaaucuuacaaagccuauaaaacaauaacacaaugaaaaaaaaucaagguauucaggcaacaaauagcacaaugaauggaagaguaccucacaucucaauacuaauguugaauguaaauggccuaaaugcuccacuuaaaagauacagaauggcagaauauauaagaauucaccaacccaaguaugugcugucuuuaagggacucaccuaacauaacacauacagacucacauaaacuuaagguaaagggguggaaaaagauauuccaugcaaauggacaccaaaagcaggcaagaauaguuauucuuacaucagacaaaacagacuuuaaagcaacaacaguuuaaaaagacaaaaagagacauuacauaaugauaaaaggacuuguuuaacaggaaaauaucacagaccuaaaaauauaugcaccuaacacugguucucccaaauguauaaaacaaugacuaccagaccuuaaaaaugagauagacauguugggugcaguggcucacaccuauaaucccagcacuuugggaggcugaggcgggcuggaucaccugaggucaggaguucgagaccagccuggccaacacagcgaaacccugucucuacuaaaaaaauacaaaaauuagcuggguguugugccggcugccuguaaucucagcuacucuacucaggcggcugaugcaggagaaucacuugaaccugggaggcgaagguuuuagugagccgaaauugugucacugcacuccagccugggcaaaaagguaagacuccaucucaaaaaaaaaaaaaaaaaaagauagauggcaacacaaauaauagugggggacuucaauacuucacuggcagcacuagacaggucaucaagacagaaaaucaacaaagaaaaaauggacuuaaucuauacccuggaacagaugcacuuaacagguauuuacagaacauucuaccuaacaacugcagaauauacauucuauucaucaccacauguaacauucuccaagacagaccauaugaaaggccacaaaacaggucucaaugaauuaagaacaucgaaauuauaucaaguacucucucagaccacaguggaauaaaauuggaaaucaacuccaaaaggaacucucaaaaucaggcaaauacgugaaaauuaaauaaucuucuccugaauggucucugggucaacagugaaaucaagauggaaauucuuaaauucuuucaacuaaacgauaauagugacacagccuaucaaugccucugagauacagcaaaagcagugcuaagaggaaaguucauagcauuaaaugccuacaucaaaaagucugaaagagcacaaauagacaaucuaaggucacaucucaaggagcuagaggaacaagaacaaaccaaacccaaauucagcagaagaaaagaaauuacaaagaucagagcauaacuaaaugaaauugaaacaaaaaauacaaaagauaaaugaaacaaaaagcuaguucuuugaaaacauaaacaaaauugauagaccauuugugagauuaaccaagaaaagagaagauucaaauaagcucaaucagaaaugaaacaggagauauuacaacugauaccagagaaauaaaaaagaucaaggcuacuaugaacaccuuaacaugcacaaacuagaaaaccuagaagagauggauaaauuccuggaaauauacaacccuccuagauuaaaccaggaagcaagagaaacucugaacagaccaauaacaagcagcaagacugaaaugguaauuuuuaaaaacugccaauaaaagaaguucaggaccagauggauucacaguugaauucugucagacauucaaagaauuggcaccaauccuacugaaacuauuccaaaagauagaguaagagaaaauccccccuaaaucauucuaugaagccaguaucacccuaauaccaaaaccaggagaggacaaaacgaaaaaagaaaauuacagacaaauaucccugaugaacauagaugcacaaauccucaacaaaauacuagcuaaccgagucuaacagcauaucaaaaagauaauacauuucucaaaagaagauauaccaauggcaaacagguauaugaaaacguacucaacauuacugaucaucagagaaaugcaaaucaaaacuacaaugagauaucaucuuaccccaguuaaaauggcuuuuauccaaaagucaggcaauaacaaaugcugacgaggacguggagaaaagggaacccucauacacugcuggugggaauguaaauuaguacaaccacuguggagguuccucaaaaaacuaaaaauaggcugggcgugguggcucacgcccguaaucccagcacuuagggaggccaaggcgaguggaucaccugaggucaggaguucgagacaagccuggccaacauggcaaaaccccaucucuacuaaaaauacaaaaauuagccaggggugauggugcaugccugugaucccagcuacucgggaggcugaggcaggagaaucacuugaacccaggagguggagguugcagugagccgagaucacaccacugcacuccagcaugggcaacagagcaagacuccaucucaaaaaaaaaaaaaaaaaaaaaacaagcaaacuaaaaauaaucagcugcuauagacuguaugauccagccaucccacugcuagguauauacccaaaagaaaagaaauccauuuaccuaagaaauaucugcacucccauguuuacuguaacacuguucacaauagccaagauuuggaagcaacccaaauguccaucaccugaugacuggguaaagaaaauguggugcauacacacccugaacuacuauucagccauaaaaaagaauaagauccugugauuugcagcagcauggguggaacuggaggucauuauguuaagugaaauaagccaggcacagaaagacaaacuuuccauguucucacuugucuguggguacuaaaaauuauagccauugaacucauggagauagagaauagaaggaugauuaucagaggcugggaaggguaguagggaggaggggaggggguguguggggaaaggagaaugguuaauggauauaaaaaauagaaagaaugaauaagauauagcauuugauagcacaauagggugauuauggccaauaauuuaaguggacauuuuaaaauaacuaaaaguauaauuggauuguuuguaauacaaaggauaaaugcuugaggugauggauaccucauucacucugauaaaauuauuacacaauguaugcuucuaucaaaauaucccauacaccccauaaauauacacaccuacaauguacccacaaaaauuaaaaauuaaaagacagaaaacuauagcucaauagcucucauaaauguagaugcaaaaaauucucaacucaaaaugcuagcaaaccaaauccagcaaaauaaaauggggauuauauaccaagaccaaguagaauuucugccaagaauguaaaguugguuucacaucugaaaaucaauuacuguaauacauaauauuaauggaauaaacggagaaacccacaugaucaccucaacagacauggaaaaagcauuucacaaaucuaacacccuuuuaugguaaaacaaaagagaacaaaacaaccuuuaaacuaauuaggaauagaagagaacuuucucaguuugauaaagggcaucuagauacacugaauuucaucaaaaugaaaacuuuuguguugcaaaugauaccaacaagaaacugaaaaaacaacccacagaaugagagaaaauaucugcaaauaguacaucauauaaagaacauguaucugaaauaaagaacucuuuuuuuuuuuuuuuugagacggagucucacucuguugcccaggcuggagugcaguggcacaaucucggcucacugcaagcuccaccucccagguucaugccauucuccugccucagccucccgaguagcugggacuacgggcacccaccaccaugcccggcuaauuuuuuuuuuuuuuuuuuuuuuuuaguagagacaggguuucaccguguuagccaggauggacucaaucuccugaccuugugauccgcccgccucagccucccaaagugcugggauuacaggcaugggccaccgcacccggccugaaauaaagaacuuuuaaaacugaauaauaaaaagauaaauuacuaaauaauuuuuauugauauauaauaguuguacauauuuugggaguacaugugauauuuugauaucuguauaugauacauaauaaucaaaaucagaguaauuaggauaucuaucaucucaaacauuuaucauuucuuuguguugggaauauuccaauucuucuccuauagcuauuuugaaguauucaauauuuugaaaccuacacuagcccuauugugcuaccaaacacuggaacuuauaucuuuuaucuaauuguauauuuguacccauuaaucaaucccucuucaucccucccuccccacuacccuucccagccuccaguaaccaccgcuguauuuacuaccuccaugagauaauuuuuuaagcucccacauaugagugagaauauuuaacagcuguuuuucugugccuagcuuauuucacauaacacaauauccuccagcuccauccauguaguugcaaaugacaaaguuuccuucuuuuuuauggcugauuaauauuccauugcauauggaauguauaccacauuuucuuuauccaaucacuuguuaaugaacacuuaguugauuccauauuuuggcaauugugaauagugcuacaguaaacaugggaauuuagaucucucuucaauaugcugauuuccuuucuuuuggauauauacucaguaaugggauugcugggucauaagguagcucuauuuuuaguuuuuugaggaaccucuagacuguuuuccauaauggcuguaccaauuuacacucccagcaacaguaaacaaggguucccuuuguuccacauccucaucaacacuugcuaucuuuugacuuuuagcaacagccauccuaauaggugugagguuauaucucauuguggugguguugauuuguguuucccugaugauuagugauguugagcauguuuucauauaccuguuuccaucuguaugucuucuuuugagaaauguuuuguccaauuuuuaaucagauaauuugggguuuuuugcuauugaauuguuugaguuucuuauauauucugguuauucaucucuuguuggauggauaguuuccaaacauguucucccauuccaaggguugauuuuucucacuuugcuguuuccuuugcugugcagagacuuuguagcuugauauaauccuguuuuauccauuuuugcuuucauugccuaugcuuuuugaggucucacucaaauaaucuuugaccggaccaaugcccuguagcauuuacccaguguuuucuuucaguaauuucauaguuucaggucuuacaucuaaguaaacuuaauguuuacuuaaggaguucaagaccaguuuaggcaacauagcaagaccccugcaaaaaauuuaaaaauuagcuggguggggugguggucacuuguagucccagcuacuuaguaggcugagaccacaggaucucuugaacccaggaguuggagauuccagugagcuaugauuguaccauugcacuucauccugggcaagagagagaaacccuguuucuacaaaaacaaacaaacaacaacaacaacaacaaaaccuggccauuucuaauucuuugagagaucacacauuuccaucaauuuagggucagucucuggcaccuuauuuugucuguuuggugagguuauauuucccuuaauguucuugaugcuuguggaugugugacaaugucugcacacugagagauuaaguauuuaauuguaggcacagucugccuuuguuugugguucucagugauucuagugauucuaagaagucugguuguuguguuuccugagccugugaccacugcagccaucucagcacuagaggaugcucuaaguccacacuugccaugagucuugcaaggacuccaagguugacaugccauuccagcccagauaagccugggaaagauccaaggaggguacuagagcuguaugggaaugcugaccagggaccugaguucagaagauuguccgaguggcugagauggacaugccucccagcaggucucugcaugggcaagauaggaugucaagugcagcuugaggggcuggaguugaccauaguuccccucaggaucugcuguggguuggaggcugaagagccuaaucuugguggcugagagaacacaugucuccuaggagaacccugcacagacaauaguuuccuaaguguagcaggauggacuggagcugagaauuagcucccucaggauuauugugagauagagguuggaaugccuaucccauuggauuagaggaguguacaucucucagcagggcccugcacagacaggauaguucccugauugcagcaggaaggacuagaccugugacuguccccccaccacccauccaagaucugcugggggacacaggcuggagagcccaucuuguuagcccaaacagguacacaucucccagacaagauagaucucagagacagcacaaggaaagagguuggugauccuauucaggauggcuuagacuccucagcugcgagguaugggugagucucccucuggguccuuguguuagcagcucucagcugggaccucagauaaagugggcuagggaagugccacaaaacaacuauuauguucacugccaaaaccaauaucagcaagcagacaagccuuucuaucaaggcacuaauagugugauucccccggacucuuuggcagaugguuuugauugcaagcucagggacaaagagggcuauagccaagccacuuagaggacugggccauuccugggcuugaaccugggagcaaacucaguaggucagccaccuguaaccuacugucagucugcacucucaaaaugacccuccaagugcugucagucugcacucucaaaaugacccuccaaggucuuugguuccaugaggguuucagagacucccucuugaguccugaggcucccaaagugagauuuugacuggauaggugcagaauucuuguuguuuugaggagauaagaguggguuaauggugacccugaaacagccuaauuaaccauuacagaaauugaauuuauuguuuaaaaguccuuuucagaaaucuacaagccuggauaguuucacuggagaaggcuaccagucuaccaaacagaaagaaaaauuaacaccaauuuuauacaaucucuucccgaaaacagaagcaaggaaaacacuuccagacucaugauaucauaaccagacaagauaguauagagaagaaaacuacagaccaauauuucucaugaacuuauauuuuaaauccucaacaaaaaauuagcagauuaaaucuagcaagugcccucucucucucucucccuguuucucacucuccauauguauaugucauacaccaaaugggauuuauucuagggaauagcauucaaaaaaucaaccaagguaauccaccauaucaacaagauaaaaagaaaaauaauaugauaauaucaaucaaugcagaaaaagcaucugauaaaauccaguaccaauucacgauuuuuaaaaacucuaauuaaauuacuacagggagauuacaucaacuugauuuuuuaaaucuagaaaaaaucuauagcuaacaucauacuuauugguuaaaaaauugaaugcuuuucucccuacauuuaucaauacugcaagcauguaugcucucgccacuuaucagucuaccacaugguacuggaaguucuagucauucacuguaauaagucaagaaaaagaaauaaaggccaggcgcgguggcucaugccuguaaugccagcacuuugggaggccgaggcaggcggaucgcgaggucaagagauugaggccauccuggacaacauggugaaacuccgucucuaguacaaagacaaaaauuagcugggcauggcggcgugugccuguagucccagcugcucgggaagcugaggcaggagaaucucuugaacccagaugguggagguugcagugagccgagaucacgccacugcacuccagccuggugacagagcaagacuccgucucaaaaauaaauaaauaaaaaauaaauaaauaaauaaauaaauaaauaaauaaaaagcauacugacuggaaaggauaaaauaaaauauaauuaauuauuauuguauuuauuaauauuagugcuucauccuuuccaaucauccugaagaugacaaaugucugcacagaaaaucacaaagaauaaaaauaagcauuguagagcuaauaaauaaguuuagcaugggcacaggauacaaaauaaacacaaaaaucaaucauguuucuguacacuaaugauaagcauauaggaaacaaaauuaaaaacacaaucuauugcacugcaugaugaccaccacuaauaauaagauauugcauauuuuaaaauugcuaaaagauuuuuaauguucucacgucaaaaaaaugauaaguuggcaaggucauagacauguuaauuaguuugauugaaucuucuauaacguacacguacguauaucaacaugucagauugcaccucauaaauguacacaauuacuauuugucaauuaaaaauuaauaaaaauaagaacaaaugucuauuuuuuucaauugcaugaaaggaaaugaaauagauauacauuuaacaaaacagguuuagaggcuauauaaugaaaauuaugaaauucuuaugaaagaaaucaaauaucuaauaaauggagaaaaauaccaugcuauagauuugaaaacucaacaaaguaaagaugucaauuuuccucaaacugugaucuauagguuuaauaaauuuucuaucaaaaucccagcaagguuuuuguaaaaauaaauuuauucuaaaauauauggaaaguaacagguacuaaaacaucuaaaacaaucuugacagagaaaaauaaaguaggagaaucauuuuacuugauauuaaggcuuaguauaaaguaagcauggcagugauauuggugaagagacacauagaucaauggaacagaauaaagaccauagaaauagauccauaagaacaugccuaacuaguuuuugacaaaaguuugaaaguaauucaauggagauaaagcagucuuuucaacagcuggugacagagcaaucugagauccauaggcaaaaaacugaacuucacgcuuuauauaacaauuaacucaaaauggaucacagauguaaguauaaaaaauaaaauucuaaagcuuuuacaaaaagacacaggccaaagucuuugggaucuagggcuagggaaagaguucuuagacuugggaucaaaagcacaauccauaaaaggaaaaacugagaaauuaaaauuuaucaagauuaaaaacuuguucugcaaaaaaacuguuagaauaaaaagacaagcuauagacugggagcauacacuggcaaaccacauaucugaugcuaugguuugaauguuuguacccuccaaaacucauguugaaauuugguugucauuguggcauuguuaggaaguaggacauuuggaaggugauagggccaugagggcucugcccuuauggguggcaggaaucccaucauaaaaagacauguuuggcccucuuguuauucuuugccuuuuuaucuuccaccauaugaagacaggucauuucucucucuggaggaugccacaaaaggcccucaccagaugcuggcaccuugaucuugaacuucccauuuuccagaacugugagaaaaauacauuucuguucuuuauaaauuacccagucucaaguauucuguuauagcaacacaaauggaauaaguccucugacagaggacuaauaauuacauuauauaaagaauucuuaaaauucaacagguaaaaacaagucuaauuagaaaauuaguuaaaaauaaaaacacagauacaaaucucaucuugaauuguaguucccauuauccccacauguugugggagaguacccagugggaaguaauugaaucaugagguugguuacccccaugcugcuguucucgugacagugaguucucacaagaucuaaugguuuuauaaggggcuuuucccccuuugcuuggcauucauuauccuuccugcugccaugugaaggacauguuugcuuccccuuccaccauaauuguaaguuuccugaggccuccccagcccuguggaacugugagucaauuaaaccucuuuucuuuauaaauuacccagucucagguaugucuuuauuggcagcaugagaauagacuaauacacuguucaacagcagaaaaacgcaaauuagaaccacaaugaauuaugacuacaaaccuacaggaauaacuaaaauaaaaaauagcaaguugcugcugguaaggaugcagagaaacuggaucauuuauacagugcuuaugguaauguaaaaugguaccaccacuuuggaaaauaguuuggcaguugcuuaugaaacuaauaugcaacugccauacaauuuagcaauuguauucuuagguaguuguuucagaaaaaugaaaacagguucacaccaaaaccuguacacagauguucauaacagcuuuauuuauaauagcucaaaacuagaaacaacuagguacccuugacugggcaaacucuuaaacugugguaccuccauaccacagaauacuacuuggcaauaaaaacuaaaaaaaaguauuuacauuuuucuaucugcuuuccaacuuucuauauacucagguuggacuaacaacuuggauaaaucuccaagaaacaaagcuguaacaaagguuacauaguguaugaauccaucuagauaacauucucgaaauggcaaaauuauagaaauggagaacauguuagugauugccaggggugggggagggagguggauguggcuauaaaagggcaauaugaggaaucuuuauggagauggaacuguucuguaucuuaauugugucaaugucaaaauccugguugugauauuguccuacaauuuguaagaugugaccauggggggaaacuuaauaaaggauacaugggaucucucuacauuauuucuuacaacugcaugugaaucuacaauuaucucaaaauaaaaagcuuaauuaaaagaaacuacacuggcaccuacaacuuuccucccucuucaaaauguuuuucagucuguuuucuucacccuagaaucucagcccuuucaagaacuauuaaauauuuuguaaagaaauaucuaucuuaaguuuaauaauaauucugcaauuccaauuucaaauuauuuuuuccgauaaauucaaauauaauauguauauuuuaguuuaaaguagcuaauauggcauuuuuuucaaagguauucuuucuuuaucuuucuugauauguguaaguguaucugacuaugguucuuuuuguuuauguuuuuguuuuuucauaaaggagccauaugaagugauacacgcccaaaauagauaaaaguuauucugggauguaagcucuagaauuccaucaacauuuuccuuuacauuuguauguauuacuuacauucuuaaaauguguauaaaaguguaauuuaggccgggcgugguggcucacgccuguaaucccagcacuuuggggggcugaggcgggcggaucacaaggucaggagauugagaccauccuggcuaacacagugaaaccccaucucuacuaaaaauacaaaaaauuauccaggcgugguggcagacaccuguagucccagcuacuagggaggcugaggcaggagaauggcgugaacccgggagguggagcuugcagugagcugagauugcaccacugcacuccagccugggagacagagugagacgugagacucugucucaaaaaaaaaaaaagaguguaauuuaacauaauuauguauauauguauguauaauuagcauucaucauuagcuagauaaucagucuauagauuauaauuauaccuucauuuuauguccucauguacauucauaaauacugacuauauuuuacagcauaaagaaaaugcuaaagaaauuucaaaaaaguaacaauaguauagacaaugcaauaaaaguggacauuuuuuaaauagaagaagaacaccuaaagguauuaucucuauaacuguuaguccaaucucaguauauagaaaguuggaaagcagauggaaaaacaguaaacucugagauauggguuuguaggcuauuuuuacccuuuuuguauuuuucuguauuaauauuuuauaaaauauaaacauaauguguuuuuauuaaacaauauaaauuuagguauacaauaaauccuuauaucaaugagcuuagacuaaauuacacuguaguaacaaccccagaucuuaguggauuacaagagaaguuuauuucucaaccacauuacaugucaauuauagacugguuucuacccuacuccuuguuaucuccaggaaucuaggcugaagaagcaacuucuacgucagucucaaggccaaaagaaaagagaggcugggaagacgauguggugucucuuaaagcauccucucagaaaagccacuuuugcucacauuccauugggcaaaacaaaaccuuuggccaaaucugaagucagcgagguggaaauacauaauucuuccuuugggagggacccuaauagaaaagggcagcauacauuuugaauaaaacaaucuaucacaagcccaaauuuuuuauaucuaucuauguacaggcauauuugugugugugcaugugugcacauguuuguguuuauauauuuuuucauagaugaucagaaagaaacacaauacgauguaaauggagguccuaaauuauuuuugauaugcaaauaaaaaagaagcccuuaaauuuguuaauaaggaguucagugugacccaagacaagaaagcaguuaggccaauagcuaaauuguaauaggugaggagauaagaccugaaaaaacagacuaauacuuaagaaaagaacagaauaguauagcagcuuaagcaguuuaaugguuuaaguuuuuauaagaugauagaaaugagacaguauagggaagggauugagcccugguagaccacagacauaguaaucaagaccccaugggccucacauaucaaggcauauucucuccccuaccuuccugucucccuuaauaagcugacccaagucacauagcagaaggagggccucuccuaacuuagcugacuaggcugaauucuuaacuaucaaaagaagaaacuaauuguuuaucuccuugaaguaaugucucccaagguuacuaaaagugggacucuagcauuccugauaagaaccugaccaucuuucaagguuagugaggcucuggcauucccgauaagaacuggaccagauccagucugcugaagacaagacagacuccaacacugaccuuucacugauuuuuuccucauuauaguaucauuuuaauacuaaaaucuccacccaaggcagggcuuauccaccauuuucugaucaugcaauguaugucagagcaugaugccccauugcgcaaacacaaagaaaauuucgccuaaacaugcuuguacaucauuucauuuucugccucagcuucuaaaaugacaggagcugagccucagggagcuagcacggagaucccuuugccguaaacugcucccuugcuuugauugagccacaagccuauuaaaccuucccugagaaaaaugucucuuuggccugguguuaauuucuacuuaugugagagccaaagaacuugagauacaagcuacaguaacagaauucuuauucuuauuuauguuuacugacuagaguaaaaaguaaagauugcugaggguuuaauagcaucaagaguuaagccacagaagaauuccucuucuacugaaacaguaggauaaagguaagcaugaaucuuauuauugcagaugaagggaaagccauuuuguuaguccuuuaauugaaaauauaaaaauuucaaagcccuguacucagauaaagggaaaacaaagauaaauaaggcauaauuagaccuugcagagcuugcaauauaacagggggcacagagugaaauaaccauuuuaacauuaaaaacaaagugcuaugagaauacacacauauauaguaagcucacaacuauaagaugaaagaugugugagauuuuccaagauagaaaaggaugaaaggaauuaaaugcaggaaacaaaguaaacaaauucucagaggcuugaaauugaaaguguauguuaccuaagcuguugcagagugauuaagagaauagguuugaagccaugcaaaaauagaccuagguuugaaaucuagucauucugcucucuuacuacguaauccugaauaaauaauguaaccucugucaaaguaaagauaauaauaaauugugggauauaacauugcuguaaagauuaaauuaaauguaaguaggguacuaaacacaguucccaucucauagaaaccaaaaaaaauaguauuugucauuuauagggugaaucaauucaccuugcaaacuguaaaacacuacagagauagccuuuuuuucugaaacaugaugaauagcuucaaaaaaagcauaucuaaauauauaagcauuuuaauacgagauaauauuacucauauacaguauauuuaaaaguguuccaggggguagggauagcauuaggagauauaccuaacguuaaacgacgaguuaaugggugcagcacaccaacaugucacauguauacauauguaacaaaccugcacguugugcacauguacccuaaaacuuaaaguauaauaaaaaaaaaggaaacaugcuagaaggauauacauuaaaaauguuaacaguauuugcagaaaaaaaaggguuccuuuucuuuuuuuuuuuuuuuuuuuuuuuuuuuuuuugagacggagucucgcucugucucccaggcuagagugcaguggcgcgaucucggcugcugcaagcuccgccucccggguucacgccauucuccugccucagccucccgaguagcugggacuacaggcgcccgccaccgcacccggcuaauuuuuuguauuuuuaguagagacaggguuucaccguguuagccaggauggucucgaucuccugaccucaugauccgcccgccucggccucccaaagugcugggauuacagacaugagccacaaaaguguucuuuucuuaaaaguacacuuauauuuacguguguuuugcauuuacauuaggaaauauucuaaauguuucuagaaaaaagcuucugggggaaaauuauuuucucaucccguuauuaaaauuuaucaaauuauuuuauaauaugacauaauucuaaaaaugcaaaguugccccuaaaccuuguaaucauuuuaucuauaaugccaaaaaaccuaccuucucuucucuuucuauuucaaguugcuucuuaacagacaaaaguucagcuuugagauuggauaguucaaucuccuaaagaaaaagaaacaugaaguuuagaagagcuuccauguauuucucaagacaaugaaaauauaaacuagugcucugaguaaauuuaauauuguagagaaauaaauucacucauaaaauguagauacuuuuaaagucaacugauauaaaggcugcuagcuuaacauagcuaaaaaccucauuuaaacaaguuuuugggcugggugcaguggcucaugccuguaaucccagcacuucccugggaggcagaggcaggcauaucacucgaggucaggaguuugaggaaagccuggccaacauggugaaaccccgucucuacuaaaaauauuaauacaaaaauuagccggguguggugaugcacaccuguagucccagcuacucaggaggcugaggccagagaacugcuugaacccgggagguggagguugcagugagccaagaucaugccagugcacuccagccugggggacacagaaagacuccaacucaaaaaacaaaaacaaaacaaaacaaaacaaaaucaaguuuuuuguaguuuucuuuaaagaaaacuucaacacaaaguauaucucuccucguucucucccaguuuaucccacccuccucucccaauuucaaucagagguccaaacuuauuuguuuacuggaguuuauaaaauuucacuugaaaaaauaguuuguuccacuauuucaaaaacuaaauuagaaaaaaacauguaacuagaagaucuauaagaucccuuucagaguuaagacucugauucuauagcucaaaaauuaguuuuacuuaauauuauucuuuaccaccagucacugcugacauuaugaaaacuggccguuacugcaauuuuuucuguaucucaccaaagaugcucucagugaugacuguucuuguucuuugcucuuauaaaguccuaauucugagucucuuucuucaaugaucuuaucauauuggugcuauauuaaacaaagaagacauuuuagauauauuaaaacugaauagauuauaagauugguauccuaacauauuuuaauauuuaauuuaguauuuaauuaauuauuuaguauuuaauuuugcagaaacuuauguuuauaaauucaguaauauauauggguauauauuuuuaauguuucaauuauauuuuuucauucaaacaaccucaauagugaaacacacaacagucuuggaaauaaccaaagagcaaaagauaauucuuuuaucuuuggaaacauugaauuuuaacauuuaaaaauuugccagaaacaccagggcuucuacaaaacugacugauuucaaaucugggacaggaaauacaagccuuaaacuagcauuaggagauauaccuaauguaaaugaugaguuaaugggugcagcacaccaacauggcacauguauacauaugugacaaaccugcauguugugcacauguacccuagaacuuaaaguauaauaaaaaaauuauuacaucaaaaaaagaagccuuaaacauuuugucauaacucaaagaaaguuaucagagaaaauuacaguuaagucaaaaggacuugccacacagcuuaaagaggcuccugcuagccaaaggugggaaaaugugaguuaucaauaaggacagaugcugcacuggauugaaacauaccaaauguguucaaaucuaugaguucacaauguuauuuaaauuauuuuuuaaauccucaccacuucccucauaauaaucucguauuccagcagcuuuuuuuuuuaauugaauagguagguauacccuaccucuucuccaaaucuuaaggggaaugaggcuuaauuccuuaacaaauggauacucuaaaacaacaauuaaaaauauaagacaaaaacacaucaaacacuaaguauuucaucuauuuauuccuuugauaaaaauugauuuagccuauuauauguuagauaucaaugagauacuuauccugguuauguacuuaaaaauauauaagguagaaagugcuauaagagacuauuagcagaauccagaaaaagagugauuacuuccauucaucacagauaacaaagagagauuuccucaaggaugugacacacaggcucaacuuuguaugguuaagaucugaacuugaagaaaugggcaucaaggguauucuagcuauagacagucacuguugcauagacaauaaucuucucugacaaauaagaauacuaucuugauuucaccauuauuuaacagaaauauggcuccaauuaauaauuuucauuauauaagaagaaaaaaauuaccuuauguuuuuccauaagugcuaccauuucagcuauuuuauguugacaucgcuuaucaauuucuuucuguaauuuuacugcuucaucagcuauuacuuuugcuuucucaaccuaucaaauaagcaaaaaaaaaaaguuucuuaaaauaaaugcacaaaaaacaaacaaguguaaaaaguauauguucuacuuaaauaaaagcaaaccucaaacaccaggaaacuggaaaaacaaguagaaaaugcacuguuugggguuuuuucgggguguuuuaugaaguaagaugacacuauaccacuguggcaaucauuuaauccuuucaaaauaauuauauacucaaauacuuagaauagcaaggauacuuuuaguuucuauaaaaacugauaaacugacccuuauauaaauuuacuaacccuuuucuaaaauuguaauuuaauaguuaagauuuuuuuacuuuccucuuaaaauccuaauaaaaauauagauuuuuaguauaauaaguucuuaauacauuaaguuuuucccaccucuuccaaaagauuuucuucugauaucuuuuuguccucaauuucuuucugauaggugucugugauuucuccaaauuucuguuuggcacuuucuaguucuaacucuaauuuauugaccuuuaaguaaagaaaaauagcaugaauauuaguaaaugcuauggauuacuugaaaacauuccauauucauuuugugguuuugugaaucuuagaagauuacuuauucauggaaauuagguuggaucacuuuccuuacauuuucauauggugagaaguguuuuguuuucaaaaaaucuaucuucuccccuaaaauauguauuuuuucuugacaaguaauauaaaauaaacacccaugcauuuauuuuuaaugaauuucucaacaauauuuacauugguuacucucacucaguuuaauacgcuuuauuagaauaaguauuuccauuguacagaaaacucaugugauucaaaggcauauucuuaaugagauuaauuuucuauaaagaagcaacaacuuccauuuauauuauuuucacauacuuuguauaaauauuuacugaguuguguagauauaauucaaauauagaaauuauuaagagggaaggaaagcccugaauuagcacccuucauauucacuuuuaucuuagggcuaaauuaauacuggcaagguguuauacggcagggacaggaauugggaagaggguuauggguaauauaaugaugaaucagacuguauuuuguauccaugagucaaucaucgacuuuaaaauauagaccauuaccaauauugauaaaagcuauuaaaugccccucccucuucauuaguuuuccccuacugcccuuucgagcauaaaaaacauucuuaauuuauauucccuuacucuucuuuauagauucauugcauaauuaugugucccuaaacaauauuucaagauuuuuuuugaacuucauauaaauguuuucauaguacauuauuuuucuggcuugcuuuucucauugaacaguuauguuugagguauuuauguguaaaaauacaguucuuucauuuucacugcugaguaguguucuauuguaugaauauaacacuguuuauguaaucaauuguucagggcacugaguugucuccauuuugggacugguacacacacaauagugcuaugaauguucuuguaaacaccuccuggugcaaauguagaauuucucuauaguauauaccuaggauuggaauugccgggucauagggcagguuacauauucaacuuuaaagaugacauuauuuuccauaugcauuuauaccaauuuaaauucucagcaacaagguuaugacuuuuccugcuucacaacuucaccaagaguugauagugucagacaaaaguauuugacugaaguuuuguuguauaauuugcacuuuccagaaaauuauguaacauguuuaacucuucauauuuucuguucugugaccaucucuguucauauauuuuacucauuuauguacuuggugcuucauuuucuucuuaauuacauuuaauggguucuaauccuuuguucuuuauauauguaaaguugggauauuucuccaauuuugagguuuguuacuuuacuuuccaaguaaccagaaauuauuuuaguauauaugaauguaucaauauuuucaaauaugguuguguuuuuuaaucuuauuuaggaaaucuuucuuuacuaccaggucacaaagauauugucccacaucuucuucaaauguuuugaagcccugcccuucacauuuauuuauauccuuaaggaauuuguguuuguauguaguguagagguagacuuucauauuuuuccauauagauagucaaauguucuagcacuacauaucugcaauaucacuucuguauugugucuaguuaccauguaccccuguaucuuuuucuaggcuucucuuuuauucaauugacuugacaacuucugugccagugucauacugucuuaauuaccuuagcuauacaauuaaucuuuauaucugguagggcacauuuuccuacuuuguucuuaaagauugcuuuaguuauucuuggccuauaugaucauuuuuguuaaauguccgaguguucuugaaaagcauguuuuccucacuuuuuaauauaaaauuauccuuauuucuccaacauucuuaaaagauagguauguugcggacaaaauuuaauguugacaguaaucuucuuagcccaugaaaauacuuucucacuguuuucugacuucuauuguuguuuguugagauguucauggccaauaugucauuucuucacuuucaucuuucauuucucuccagauacuuuuaauacuuuuauguguccaauauucuuuaguuauaccaagucuaaauguggauuucuuuuaauuuuucuugcuugguauaaauuucucuuucuauaucugugaauucaggucuuucaucaauucuaaauauucucaguagagguugaguauuccuuuuccaaaaugcuugggaccaaaaauauuucagauuuaucuaaugagauauccuaaggauaggaccuaugucuaaacacaaaacucauuuauauuuuguauauaccuuacacauagccugaagguaauuuaauacaauauuuuaauaauuuuguucaugaaaaaguauguguuaaguacuugugcauggacuucuccacuuguggcauuaugucugugcuauaaaguuuuggacuugggagcauuuuagauuuuggauuuucagauuagaaauacccuguaauuacugcuuacccccaguucacucuauuuuuucuuucuucuuggacaauacaaaacccuuaggaaaaaaaaucaucaaaguacaugacaacaauaauaguauacuaacauauaaguaagacauaagagauaaaggagauaauguagucuaaggccaaauauaccaguaaaagagacaaagauugucagagugcauaaaauuauaaacucuggcuacaugcuauuuauaagagucauuuaaaacauaaagauagaggauaagaguaaacagauuuaaaagauauaacaagcaaacaugaaacagaauaaaaaaugguauaguuauaauaauaacauaaaaacuugcucuaaggcaaguuuaucucuacuagagauaaaggagguaucuuguuuuaacaacaauuuccauuauauauaaacauguaaaauacauauuaaguauacaguugaacuuugaacaacauggguuugaacugcauccauuuauauguggauuuuuuuucaaccaaauuuaaauggacaauacaguauccacaggauaugaaacucacauauauggagggccaacuucuaguuugcauggguuccacagggcugacuaggggauaugaguaugcgcagauuuugguauuccugggggguucuggaaccaaucccccauguauaaaccaagggaacaacuauacacauaaaguucuaucguauguaauaaaaaguugcacauauucaaaauaauguacacccaauaauauggccuugaaauaaagacaaguuaacagaacugaaauuagaaaacagaaauccacaaucauuguguaaaguuuuuaaacacaucuaucucagucaacuacuuaauaaaacacaaauaaaaaaaagcagagguacagaaugaaaaaaagauacacaaauauaaagaauauaacugguaaucuuuacauaaaggaaacacccaacaacuauacaauauacauuauuuucauguauguaagggauguuuacaaaaagugaccccauauauugggccaucaggcaaauaucaauaaauuucaaaguacuaaagucauaccagagugugcucucuaguaacaauucaguuaugcuagaaaucaguaacaaaaacacaacauguccccuuaaauuuagaaauuaagagauacaggagggcauugggcuaaacaauacuaauuuacuauauaucaaaaccuauaggacacagauacagcaauacuuagugggaaauuuacagcauugaaauguguacauuagaaagacugaaaauuaaugaucuaagaacucaucuuaagauaggucugggcacaguggcucacaccuguaaccucagcacuuugggagacugacgugggcagaucacuugaggccaagaguuugagaccagucuggccaacauaaugaaaccccuucucuacuaaaaauacaaaaauuagccggcauggaggcacacgccuguaaucccaacuacucaggaagcugaggcaugagaguugcuugaacccaggagguagagguugcagugagccgagaucacagccacugcacuccagcgugggugacagaggcagacuccaucucaaaaaacaaaggaaaaagacuucccaaauugacaaacuccuggugacacugauaaagaaaaaaacaaaagaaggaacaaauaaccaacaucagauuaaaaacaggcuauuacuguuuuuaacaguaaaugcuacagacaauucugaaacuguagaaaauguagaugaacuggaugaaacccagaaaaauauuauuuaucaaacuugaagaaauaggacaaccaaguuauacuguaacuaugauuaaauugcuucagaaauuaaaagccuuugcauaaacagaacucuaggcccaguagcuuucgucgaugaguucaacuucaaugagacauaauuuacauauaauaaaacgcaugguuuuaaguguaaaguuuaauaagcuuugacaaauuguuuuuaaaaccauguaauggcaauaccaaccaagacauaauuuccauaaucccagaaaguucccucauaucccuuaacaaacuaauaguaccccacugaggcaaccauuguucuuucugucuccauaaauugguuuuguugauucaaaaacuucauuuaaaugaaaucaugacaaacauacucucuuguauauagguuauucauucagcauauuacaagauucauccauguuccugugacuaucaguaggucuuuuuuacuucugaguaguauuccauuauaugaauauaccaaauuuguuuauccagucucuucuuaaugaacauuuuauguguuuccauuuuuuaucauuguggauaaagccaccaugaauauucuuguacaagauuuuuaguggacauguuuccauuuauuuuaaguaaauaucuaggaaaauaauuguuggaucacacaguagaugcauguuuaguuuuagaagaaaccaccaaaacauuuuccauacuguauggaauacuguauguagaggccacauuuagucuacccauucaucugucaauggacacauggguugcuuccaacuuuuggcuauugugaauaauguugcuaugaacauaggugaacauauaucucuuugagacuaugcuuucaauucuuuuagguauauaucuagaagugaaauuaguggaucauauaguuauuuuaguuuuauuuuuuuggggaaccacaaaauuguucuccacagugacuguaccaucugacauucccaucaacagugcucgagaauuccaauuucuccacaaccucauuaacauguuauuuucuguucuuucauuaguacccauucuaauggguaugagguaauaucucaugagauuuugauuugcaaugauuacugauauuaagcauauuuucauuuuuaugugcuuauuggccauuuguguauauuuggagaaauaucuauucaaguccuuugcccauacuuuauuuuuuuuuccaggccaagaugaauuuauggaugaauccuacaaagcuauugaggaaaaaauaauaccaguucuaaacaaaugguuccagaauauugaagaggaggguauaguuuccacucauucuuuuuuuuccuuuaucaaauuuauuuauguauuuacuuauuuauuuuugauuuauuuauuuuuuuaauuauacuuuaaguucuaggguacaugugcacaaugugcagguucguuacauacauauacaugugccauguuggugugcuguaccuguuaacucgucauuuacauuagguauaucuccuaaugcuaucccuccccccuccccccaucccacaacaggcccuggugugugauguuccccacccuguguccaaguguucucauuguucaauucacaccuaugagugagaacaugagguguuugguuuuucuguccuggcaauaguuugcucagaaugaugguuuccagcuucauccaugucccuacaaaggacaugaacucguccuuuuuuauggcugcauaguauuccaugguguauaugugccacauuuucuuaauccagucuaucauugauggacauuuggguugguuccaagucuuugcuauugugaauagugcugcaauaaacauacaugugcaugugccuuuauagcagcaugauuuauaauccuuuggguauauaaccaguaaugggaucucugggucaaaugguauuucuaguucuaggucccugaggaaucaccacacugucuuccacaaugguugaacuacuuuacagucccaccaacaguguaaaaguguuccuauuucuccacauccucuccagcaccuguuguuuccugacuuuuuaaugacugccacucuaacuggcaugagaugguaucucauugugguuuugauuugcauuucucugauggccagugaugaugagcaucuuuucaugugucuguuggcugcauaaaugucuucuuuugagaagugucuguucauauccuucacccacuuuuugauggggugguuugauuuuuuucuuguaaauuuguuuaaguucuuuguagauucuggauauuagccauuugucagauggguagauuguaaaaauuuucucccauucuguagguugccuguucacucugaugguaguuucuuuugcugugcagaagcucuuuaguuuaauuagaucccauuugucaauuuuggcuuuuguugccauugcuuuugguguuuuagucaugaaguccuugcccaugccuauguccugaaugguaucgccuagguuuucuucuaggguuuuuaugauuuuaggucuaacauuuaagucuuuaauccaucuugaauuaauuuuuguauaagguauaaggaagggauccaguuucagcuuucuacauauggcuagccaguuuuccaagcaccauuuauuaaauagggaauccuuuccccauuucuuguuuuugucagguuugucaaagaucagaugguuguagaugugugguauuauuucugagggcucuguucuguuccauuggucuauaucucuguuuugguacaaguaccaugcuguuuugguuacuguagccuuguaguauaguuugaagucagguagcaugaugccuccagcuuuguucuuuucgcuuagaauugucuuggcaaugcgggcucuuuuuugguuccauaugaacuuuaaaggaguuuuuuccaauucugugaagaaagugauugguagcuugauggggauggcauugaaccuauaaauuaccuugggcaguauggccauuuucaugaucuugauucuuccuauccaugagcauggaauguucuuccauuugcuguguccucuuuuauuuuguugagcagugguuuguaguucuccuugaagagguccuucgcaucccuuguaaguuggauuccuagguauuuuauucucuuugaagcaauugugaaugggaguucacucaugauuuggcucuccguuauugguguauaggaaugcuugugauuuuugcacauugauuuuguauucugagacuuuggggaaguugcuuaucagcuuaaggagauuuggggcugagacaaugggguuuucuaaauauacaaucaugucaucugcaaacagggacaauuagacuuccucuuuuccuaauugaauagccuuuauuucuuucuccugccugauugcccuggccagaacuuccaacacuauguugaaugggaguggugagagagggcaucccugucuugugccuguuuucaaagggaaugcuuccaguuuuugcccacucaguaugguauuggcuguggguuugucauaaauagcucuuauuauuuugagauauguuccaucaauaccuaguuuauugaguguuuuuagcaugaagggguguugaauuuugccaaaggccuuuucugcaucuauugagauaaucaugcgauuuuugucuuugguucuguuuaugugauggauuacguuuauugauuugcguauguugaaucagccuugcaucccagggaugaagccaacuugauugugguggauaagcuuugugaugugcugcuggauuugguuugccaguauuuuauugaggauuuuugcgucaauguucaucagggauauuggucuaaaauucucuuuuuuuguugugucucggccagccuuugguaucaggaugaugcuggccucauaaaaugaguuagggaggauucccucuuuuucuaucgauuggaauaguuucagaaggaaugguaccagcuucuguuuguaccucugguagaauucggcugugacuccgucugguccuggacuuauuuugguugguaggcuacuaauuauugccucaauuucagaaccuuuuuggucuacucagugauucaacuucuuccugguuuagucuuaggaggguguauguauccaggaauuuguccauuucuucuagauuuucuacuuuauuugcauagagguguuuauaguauucucugaugguaguuuguauuucugugggaucacuggugauauccccuuuaucauuuuuuauugcaucuauuugauucuuuucucuuuucuucuguauuagucuugcuagcagucugucaauuuuguugaucuuuucaaaaaaccagcuccuggauucauugauuuuuuggaaggguuucuugugucucaucuucaguucugcucugaucuuaguuauuucuugccuucugcuagcuuuugaauguguuugcucuugcuucucuaguucuuuuaauugugauguuagggugucaauuuuagaucuuuccugcuuucuuuugugggcauuuagugauacaaauuucccucuacacacugcuuuaaaugugucccagagauucugguauguugugucuuucuucucauugguuucaaagaacauauuuauuucugccuucauuucguuauguaccaguagucauucaggagcagguuguucaguuuccauguaguugagugguuuugagugaguuucuuaauccugaguucuaguuugauugcacuguggucugagagacaauuuguuacaauuucuguucuuuuacauuugcugaggagugcuuuacuuccaacuauguggucaauuuuggaauagguguuguguggugcugaaaauaauguacauucuguugauuugggguggagaguucuguagaugucuauuaggucggcuuggugcagagcugaguucaauuccuggauauccuuguuaacuuucugucucauugaucugucuaauguugacaguuggguguuaaagucucccauuauuauugugugggagucuaaguaccuuucuaggucucuaaggacuugcuuuaugaaucugggugcuccuguauuggguacauauauauuuaggaugguuagcucuucuuguugaauugauccuuuaucauuaugcuauggucuucuuugucucuuuugaucuuuguugguuuaaagucuguuuuaucagagacugggauggcaaccccugcuuuuuuuuguuuuccauuugcuugguagaucuuucuccaccccuuuauucugauccugugugucucugcacaugagaugggucuccugaauacagcacacugaugggucuugacucuuuauccaauuugccagucuguaucuuuuaauuggaguauuuagcccauuuacauuuaagguuaauauuguuaugugugaauuugauccugucauuaugauguuagcugguuauuuugcucguuauuugaugcaguuucuuccuagcaucgauggucuuuauaauuuggcauguuuuugcaguggcugguaccgguuguucuuuuccauguuuagugcuuccuucaugagcucuuguaaggcaggccugguggugacaaaaucucucagcauuugcuugucuguaaaggauuuuauuucuccuucacuuaugaaguuuaguuuggcuggauaugaaauucuggguugaaaauucuuuucuuuaagaauguugaauauuggcccccacucucuucuggcuuguagaguuucuccagagauccgcuguuagucugauggccuucccuuuguagguaaccugaccuuucucucuggcugcccuuaacauuuuuuccuucauuucaacuuuggugaaucugacaauuauguaucuuggaguugcucuucucgaggaguaucuuugugguguucucuguauuuccugaauuugaauguuggccugccuugcuagguuggggaaguucuccuggauaauauccugcagaguguuuuccaacuuuguuccauucuccccaucacuuucagguacaccaaucagacguagauuuggucuucuuuucacauagucccauauuucuuggaggauuuauucauuucuuuuuacucuuuuuucucuaaacuucucuucucgcuucauuucauucauuugaucuucaaucacugauacccuuucuuccacuugaucgaaucagcuacugaagcuugugcaugcaugcaucacauaguucucaugccaugguuuucagcuccauccggucauuuaaggucuucucuaugcuguuuauucuaguuagccgucugucuaaucuuuucucaagguuuuuagcuucuuugcaauggguucgaacauccuccuuuagcucggagaaguuuguuauuacugaucaucugaagccuucuucucucaacucaucaaaaucauucuccauccagcuuuguuccauugcuggcgaggagcugcauuccuuuggaggagaagaggcacucugauuuuuacaauuuucagcuuuucugcucugguuucuccccaucuuugugguuuuaucuaccuuuggucuuugaggaaggugacguacagauaggguuuugguguggauguuguuucuguuuguuagcuuuucuucuaacagucaggacucucagcugcaggucuguuggaguuugcuggagguccauuucagacccuguuugccuggguaucaccagcggaggcugcagaauagugaauauugcugaacagcaaauguugcugccugaucguuccucuggaagcuucaucucagagggguacccagccaugugaggugucagucugccccuacugggaggugccucccaguuaggcuacucaggggucagggacccacuugaggaggcagucugucuguucucagaucucaaacuccaugcugggaggaccacuacucucuucaaagcugucagacagggaggauuaagucugccgaaguuucugcugccuuguguucagcuacgcccugcccccagagguggagucuacagaggcaggcaggccuccuugagcuguaguggguuccacccaguucgagcuuuucuuuguuuacccacucaagccucaacaauggcagaugccccucccccagucucacugccuccuugcaguucgaucucagacugcugcacuagcagugagcgaggcuccuugggcgugggacccucccagccaggcaagggauauaaucuccugguguguuguuugcuaagaccauuggaaaagugcaguauuagggugggagugucccaauuuuccugguaccaucagucacggcuucucuugguuaggaaagggaauuccccaaccccuugugcuucccaggugaggcgaugcccuacccugcuucagcucacgcucugugggcugcacccacuguccgacaagccccagugggaugaacccaguaccucaguuggaaaugcagaaaucacccaucuucugcgucacucaugcugggagcuguagacuggagcuguuccuauucagccaucuugcaacccaguuuucccccuuugccaauauuuuaaccaguuuauuuuacagucuuuugccuauuuugaguugagauauuuauuuuuuuauuauugaguuucaagaguuauuuauauauucuggauacaugucaucugucaaauaaauguuuagucaguguuuucuuuuucuuuguaccuugucuauucauuugcuuaauaaugccuuuugauaaacagaucuuucaaguuuugauguagucuaacuuauuugacauguuaagaauauugcuuucuuugcccuaagaaaucuuugcugaccuuggccaugaaaguacccuccuacguuuucuucugaagacuucagaguucaagauuguaugccuauaacccauuuaaaauuaauguuuguauaugaucugauguaagggucaagguuuguuuuuuuucuuucccauaugaauaucugguuauuccaaaucauuuguugaaagacuuucauuucucuccauugaauuuuuuugcaucuuuguugaaaauuaacagucuguacauuuagucuauuucuaaacuuucuauuagauuccacugaucucuuugucuaucuuaaaaauaauaccucauugucuuaauuauuauagcuuuacagcaaaucuugaaaucaggcaaccuaaaucuuccaauuuuguucuacuuucucaaaauuguuggguauuuugauguucacaugcauuuuacaagcaguauguaaaagucuacuaaaaaauacugcuggaauuaucauggugacugaaucucuagaugaauucagugaaaucugacauuuuaaaaacauuaaaacauccaaucagugaauaugguacauauguauuuacuuaggucuucuuucauuggucucaguaauguucaguacuguucucuguaugggucuugcacacauuuuguaaaauuuaucccuauuuaauggauuuuuaugcuacuguaaaugguaucauguuuuaaaauuaauuuuucaauuacuagcuguuagcauauagaaauaaaauugauuuuuggccauugaccuuguauccagugacuuugucaaauucauuuacuaaucuuguagugacuuuguagaaaccuuggaaauuuccauguagauagucaugucauuuaugaagagacaguuuuauguauuccuuucucauuuguauauauuuauuuuuguugccagagccuccaguacaauguugaauaggugugguaagagcagacauugcucuugacacugccuuucaucaguaaauaggaugcuaacuguagguauuuuguagauguucuuuaucagauuggagaaguccuuaucuauuccuaguuugcuggaaguuuuuuuuuuaaucaugaauaaguguucaauucugucaaaugccuuucugcaacuauugagauaauuauauuauuuuucuccuuuauuacuugguacaguaaauuacacugauagcuucaaauuuuaaaccaaccuuacauuucugauaaaucccauuccugauaaauuguuugauguaauaugguuuuuaucauguauuaaaaucuagauuagauuuacuaauacuuuauuaauaauuuuauauuuauacucauauucauagggauauuggccuguaauuuucuuuuauucagauggauauuggucuguaauuuucuuuuauuauaaugucuuuguuaggauuugguaucaaaaaccuacuugagaauuguuuucacucuucuauuuuuuguggaagacugguauuauuucuuccuaaaguguuugacagaauuuaccagugaaaucauccagaucuggauuuuucucuaggagauauuuuaaugacaauuucaacuucccuaaaagauacauaagaaauuugcccauuuuaucuacauuucaaauuuacuggcaugaaguaauccaucacaguccccccuuucuuaucuuuuuaaugcuuguauuaucuaugcuaauuauguacucuuucauucuugccugcagugaauuuuacuuucucucccuuuuuuuguggucaguucugcuagggcuuaucagcuuuauugauauuuucaaauaaucaacuuuugacuucauuuaauuguuucuccuauuuauuugauaugucuuauucuaauuauuuccuuuugucuacuuucugugaauuuaauuugcucacuuuuuuaguuucuagauaaaaaccuagaucacuucuucuuuucuaaaauaaacauuuaaaacucuaaauuucccucuaagagcuccuuuauuuguaccuuacaaauuuuuauguuuuaugucuaucucaucauuccguuuaaaauaauuuaucauuuuccuugugauuucuucuuuggcccaugaauuauuuauuagucugauguuuaauucucaaauauccgggcuuuuccagauaucuuauacuuaccuacuccugauucaauucuacuggagugagagaacauauucuguaagacuucagucuucugaaauauauggagacuuguuuauggcucagcauguagucuauuuugguaaacauucuaugugaauuucaacaauuuauaguugcagauauaguguucuauaaauaucauuuaaaucaagguaguuaauagugauguucagauuuucuacauccuuauagauguuuuaauaguuguucuaucaguugcugaaagggggauauuaugaguauaguauuuucuauugcucauuuuaucaaguuuuugcuucauuuauuuugaagcuuuauuauuaggugcaaagauauaccuaauuaauuguuauaucuuuuuaaugaauugacaacuuuaucauuauaaaaugccccuacugaucuuuaauaauacuacuugucuuauauuuguuauuaaaauugucauuucuuauuaaaauugucacuccacuuucuuaugcuuacuauuggcaugauaguauuucuuuccuucaucuuuuuccuuuaaaccucuuugugucuuuauacuaaauacaauguaucucuuguaauaguauaugguuugcccuugauuuuuuuaaucuagcaugaccauuucugccuuuuuauuaaaacauuuguccauucacauuuaauauaauuauugauaugcuugaguucagaucauuauguuauuugucuucuauucauaucuguuuuuuuguuucucugcccucccuuuggaguuuaucaaaguuuuuucauauuccacuucauuucaauuccucuacugacuuuuuugcuauuguuauggacuagauauuuguauuccccuaaaauucauauguugaaauccuaccuccagugugauaguauuagaagguagggccugugggaagugauuaggucauaaggauggagccuucauuaaugggauuagugucacguuguaaaaaggaucccagagagcucucuugucccuucugccauuugagacacaaugaaaaguuggcuguuuaugaaccaggaaucagggucccaccagacacugaaucugccagugacuugauuuuuuaauucccagucuccaguacuguaagaaauaaauguucauuguuuauaugccacccagucugugguauuuuguuuuagaaaccuaaacuaagacagcuauacuucaguugcauuauuuuguagggguugcucuaaggaggauaguauguaucacuaacuuaccaaacucuauuuaaguguuaauauuguacuauuucacauguaauguaaaaaugcuacaacaaaauaguuauauuuacuccccuguccuuuguguuaugguagucacacagauuauaaacucuauaauagcaauuuguuuuccuuuaagcagccauauauaccguuuuaaaauuaaaagaaaaauauaucgccuuuuaaauucaucucaauauuuacuauuuccagugcuuuucauugaucaguuuccaucuaaugccauuuuccuucaacuugaagaaauuccuuaaguauugcuuaggguacagcuuuugaagucauguugucuucauuuaauaaagcuuuuugcugcauacagaauucuggguugaugguuuauuuuuguuagcauuuuauaaaugucauuccuuugucaucugaccuucacuguccugauacaaggucagccaucaucugugucacuguugugcaaugugacauuuuuuucugucugccuuuaaaaguuucuuuuuaucuuugguuuuagcacuuugacuaagauaugacugccuacauaugguuuugugccuaucuugcuuuggauuugcugagggccauggaucugcaaguuuguuuuaagugugauaaauuuuugagaaauuucucaauuaauuuuuucugcccaggucaggcacagucacucacaccuguaauccuagcaauuugggaggcugaggcagguggaucacuugagccuaggaguuccagaucagccugggaaacauggcaaaaccccaucucuaccaaaaauacaaaaauuagcuggaugugauggcauacuccuguagucucagcuacucaggaggcugagguaggaggaucaccugaguccaggagaucgaggcugcggugagcugugaucacuccacugcacacuccagccuuggugccagagugagacucugucucaaaaacgaaaauuuuauuugcccuauucucucucucuucuuacuuggggacuccaauuacacacuuaaaaauacuuguuauuguucuacaggccaccgaggcacuauuccuuucuuuuaaaaacucuucuucuguguacuucugacuggguaauuucuacuuacccaacuuccaguuuacugacacuugauucauuuguauucaaucuacuauuaggaccauuugguuuuuguuuugguuuugguuuuuaaagacauuuuacuuuucaguucuaaaacuuccauuugauuauuuucaguuuccauuucuucacugacauuccccaucuagucuuucauuaugaccauauuuuccuuucugucuuugaagauguuuauaauagcugcauaaaagacuuuaucugcuaauucuaacaucuggguuauuucaguguuauuuuuuauugacugauuuuuauacuauugguugacauuuuuguugucuucuguuuggggauaauacaaagaauguugcugugaauauuuuuguaccuuucuccuuacucuaccuaggaguagaagagcugaauuauaagauauaugaaucugcuacuuuuauauagaauaucaaccauuuaugaaaauccuuacuuaauuuuuaaucacauuuauauauuuuuaauuucaaauauuauuaaaauaagguauaagauuuuuauguuuccuuccaaaaagcacauaauuaauacaaugagaaaugcuguuuuccauucauaauucaaaaacuauuuauugaauacuuacugucagucauuguucaaagacauaggaauaagauuacaaaauauggcucuaauaucaggagcuuacacuguaaggcuuuaauuuguuuuauacaaguaaaugguuuucaaucccuuucugcagcaggauaaucacacauagagcuuuuuaaaauguagauuccaagaauccauuccacuuacucaauuucacuuuuuaauauggaaguagggaauaugaccacacacaaagagcucaugcaugcacauauauucuuaagcugcuugaauccaagcuuaagaauauaugugcaugcuaaaucacagauguguacucuauuacaacuaaaagaguugaucuccucuauuuaaaaagauaacaaccuuucaacuuuucaauugauacuguuaugguauaaauugaauuuauacuguauaaacaaguggaauaaaaugucuaaauucucaucuaucuauuaguauuuaaaaaacaaaaauaaagaugccaaauaccuuuaucucauaaacauucaguugcuugcuuucugcuguaccuuuuuuuuucaaggccuuauucuguuaaaauuaaaaauaauuauauuuaguacuaaaguuauucaaacuuaccuugcuacugacuuagacuuaaauuacuaaaggaagggaaagcauuauucucuaaaacuguggugaaaauaucaguuugauuuugagaauauuuauaaaaaauacauaccuccugcugaaguucuucaauauacuuguuuuuauuuucaacuuguuuccuuaaauuguuacacuaaaaaauugugagaaauuauagcuauuuuauucaguauaccaguugaaacaggcaauuucagacuaauaaaaauauugcauaaaguacugauaaaggucacuucaaaaucaugguaauuccauuaauauaaaaauuauacuaaaaucacaaauuucaauaaagaucaucuaaauacaaaugcaaucauagcucacugcaacuuccaacuccuggguucaagugauccucucaccccagccucccaaagugcugggauuacaggugugagccacuauacucagccucaguaucucuuuuuuuaaaaaaaaaauuaucuuuguaugugaagugaugaauauguuaacuagcaugauuuaaucauuucacaauguauacauauaucaaaacaucacuuuguauaccauuaauauauauaauuucucucaguuaaaaaaaucauuuucauguuacuuauaugucaacauucaucauucuuaucuuugcaauguuuuaucagcuuucccaguuuaucucgaauuuuuuaaauugucuuguacauaaauguuuauaauccccuaaauauagcuuucacaaacauuuauuaauucugaacuuugcaacaauccaaugagauagaaaggaucgguauuaucuccauuugagagaugaggaaacuaaggcucagauagauaaaauauauauaaaauaaaaaaugucugaacuaagguagcagauugggggaagaaaaguguaaugaaauucaaugucacacaaaauaucugggaaauauuuacaaccuggauucuuucugggaaacuguuuuaacagguaaguugaaauccaaauauggaaaacugaaauaugcuaaaaauuugucaugcauuuaauuuuuuuccuuaaaucgucacuaauauuuucuauauuggcaaaauaaaguaugucuuaaauucuuaauggaggauuuuauuuuacauuaaaaauuaaauucauguuuuucuccauuaacaaacaacaggcuuaaugaucugcaguggccucugauacaaauuuuaaaguagugaauuacauaccaaguauuuagcacauuaaguucauuuuuuucagguugaauuuaacuaauaaauaugaacuaaaggaaaaauagcuuuucagggaggaaaauguguuauaauuuaaagaauguagaagaccaccucuacuaccucuuagucauguaaccuuuugaagguuuuuauccuuuggaggucugauuucccaauuuauaaaauaagagcaauaaugacuucuaguuaaguaagauaauacauagaaagaaccuagaaugcaccuggucuauuguaagcccuuuaaaaugguaccuuauuucauccuugaacuauuccaauaguuuuacagcucucaaaaguguaaauauaauuuuaacaaucuucaugucaaaauucuucaaugaccucaaacucuuaaauguagcuuagguggccuuaaaugauccacccucauuuuuccccaccuucaucucuccaugcuuaccucucccuacccucaucuuuccucacucugcccucuaccaccacuaccuuaaacuccaucuuuuaguuacaaugaauuuuuuguaguuacuuaaauaugccaugcucugauacuuucaggcuuacccauauaauguuuauguuuuuuuaacuuagaauauuauccucccugcuauacuuguauccaccaccuguccuccacuaaucccuauuaaucuaaggcuucacauugaaugugacuucuuucaggaagcacgcccuagcucaaguuuggauuagauguccuuucuauagacucuaauaguauccagauagagaaccuauguuuggucuggccagcacccuuucuugcaagaauuccucuacuauaaaauccacaguaguccugcuggcuaacucuaucucuaugagucgacaugcagcucaggcuuagccagguuacucuauccccuagccacagugauugacucaggaauaagugugaacugaacuaggccagaguccucuccaagauuuuuuuagaacuuucaagaugacuuuuaauagcuuuccaacugauuccaaugccuuuuaucucuccccauuccauucucaaauauuaaaaggugucaccugcucaauaaaaaacuuuaauuagaucacuacucucuaccaaauaaaugaaauccaaacguaacacccagaacagugccuggcacauaguagguggucaauauuuguugaaugaaugaaaaaacacaaucaaagaccucaaaaucuagaucaauuuuccacuuuggcagaauuuucuuccaaucuguauaauauauacuauaaucaugucacauaucuuguacuauuccauuuucaugacacucuucccuaaacaccuuauuaucuuaauuugauaucauauucaccaaagcaugacacaaacuuauuaaauaauuugucauccauauauuuuauauuacugaaguaugagccuuuuauuuugccuaaaaaauguuaagucuacauuaaauauuuaacacguuaaaagaaaaucagaauuaugccacuauuucuucuagauauagauaucaauaguaaaauaauccaaccuuuccuagauauuuaagguugauggcugaugacagucucuagaucacuauuauuuauacaacaguauacuucccuuuauuuuaguuuagacauaugguguugcuuuuauaauuugaaauuuugugauacgauccauuauuaaauauaacauacauuuucuucacucuuguccaauuuacauuuaacuucaucucuuuucuguuuuagcucuucucucacauauucuaguucauuucuaaaagaaaauggaagagugacauuauacuaaaaauuauuaggccuauagaagaucucaaauaacucaaaauaaggaagucuuaaagaccacauucuuuaaccaaauguaaaaaaccaaaacugaauacuucauaauauaaguacaaacaagagcccccaaauauguggaauucaucuaggcuacuaauggauuaaacagaaacuuaaaauauaaaaacaaguuguuuagaaaauaaugaacauggaaacacuacauaucaaacacuauaucauaaauucaucauuguguucagaaguaaauugauggcuuaaaauguuuuuauaguuuuaaaaaagagaaacuaaauaucaaaauacaaagcaacaggggcagagcugcccaaggccuuaggaguccacccuuugcagcaguguucccugaaugugguauauagagucaaaggagauuauuuuggagcuuuaagauuuaaugacugcccugcuggguuuuagauuugcauggaaccugaacucaauucuucuggcugauuucuccauuuuggaaugggaguauuuaucaauuguaucuuggaaguaauuaacuuguuuugauuuuacagguggaggggauuugccuugucucagaugagauuuuggcuuuuggauuuuugaguuaaugguggaaugaguuagacucugggggacuauuuggaaggcaugauuguauuuaggaaugugaaaaguacaugagauuugggugcggggaagugcaaugauacaguuuggauauuugcucucacccaaauuucauauugaaauguaaucaccaauauuggagguggggccuggugggagggguuuggguugugggggaggaucccucauggcuuggugaugccugcaauagcgaacucuugcaacauuuggauguuuaaaaguguguccuccccaccacucuugcuccugcuuuugccaugugaagugccuccuuugcuuucuaccaugaguaaaauuucccuaaggccuuccaagaagcugagcagaugccaucaccaugcuuucuguaugaccuauggaacuaugaaccaauuaaccucuuuucuuuagaaauuacccagucucagguauuucuuuauagcaauacaagaaugccuaguagacaugccuacaagaucuagaaaacagccucaaaagggcaaaucuaagagucauuggccuuaaagaggagguagagacagagauaaggguagaaaguugauucaaggggauaauaacagagaacuucccaaccuagagaaagaucuaaauauucaaggacaagaagguuauuagaauaccaacuauauuuaaaccaaagaaggcuuccuuaaggcacuuaaaaaucaaacucacaaaggucaaggauaaagaaagaaucccaaaagcagcaagagaaaagaaauaaauaacauauaguaugucuggcagcagacuuuucaauggaaaccuuacaggcccagagagggucaugacauauuuaaagugcugaaggaaaaaacuuuuacccuagaauaguauauccagugaaaauauccuucaaacaugaaggagaaauaaagacuuuuucagacaaacauaagcuaagaaauuucauuaacaccagaccugucuuacaagaaaugguaaagagaguucuuccaucugaaagaaaagaauguuaaugagcaauaagaaaucaucugaagauacacaacucacugguaacaguaaauacauagaacauuauaacacuguaauuguggaauguaacuacucauaucuguuuuuguuuuuuuuuuuugagacagagucucacucuugucacucacugcaaccuccaccucccagauucaagcaauucuccugccucagccuccccaguagcuaggauuacaggcacccgccaccacacccggcuaauuuuucuauuuuuaguagagacaggguuucaccauguuggccuggcuggucucaaacuccugaccucaggugaucugccccccucagccucccaaagugcugggauuacaggagugagccaccguaccuggccucguaucuuaaguaggaagacaaaaagaugaacugaugaaaaauaauaacaauuuuuccagacauaaacacaauaauaaaauauaaauaaaaacaacaaaaaguuuaaaaccagggaaacaaaguauagaguuuuuauuaguuuucucuuuguuuauuugcuuaugcaaucaguuaacuugucaucaguuuaaaauaauggguuauaagauauuauuugcaagccuaaugguaacuucaaauaaaaaaaauacaacaaauaaacaaaaaugaaaaaguaagaaauuaaaauauaccaccaaagaaaauugccuucacuaaaaggaaaacaugaaggaaagaaagaagagaccacaaaacaaccagaaaacaaauaacgaaauggcuagaguaaguccuuacuuaucaauaauaacauugaauguaaauggacuaaacucuucaaucaaaagacauagagcaauugaauggauagaaaaacaagacccaacaggcuguugccuaacaagaaacaccucuucaccuguaaagauacacagagacugaaaauauaggaacgguaaaagaaacuccaugcaaauggaaacuaaaaaagagcagaaauagcuauacuuaugccagacauuauggauuucaauacaaaaacuauaaaaagagacaaagaaggucauuauauaaugauaaagggaugaauucagcuagagaauauaacaauuacaaagauauaugcacccaacacuggagcacacagauauauaaaacaaauauuauuagagcuaaagagagauagguuccaguaaaauaauagcugguaacuuaaacaccccacuuucagcacuggacaaaucacccagacuuugagcauccaaagaaacaucaaucaaucugcacuuuagaccaaaugaaccuaauauauauuuacagaacauuucauccaacaauugcagaauaaacauccuucuccuaagcacauggaacauucucaaggacagaccauacguuaagccacaaaacaagucuuaaaacauuuaaaaaauugaaaucagaucaaguaccuacucugacuacaaugaaauugaacugaaaguuaauaacaagaagaauuuugaaaacuguaaaaacacaugaaaauuuaaaaauaugcuccugaaugguuagugggucaauaaagagauuaagaagaaaacugaaaaaugucuugaaacaaaggauaauagaaagauaacauaccaaaaccuaugggauacagcaaaaggaguauuaagagguguguuuguaagugccuacaucaaaaaaguuuuaaaaagucaaauaaccuaaugaugcaucuuaaaaaacuacaaaaagaagagcaaaccaaacccaaauuaguagaagagaauaauaaagaucagagcagaaauaaaugaaauuaaagaaaacaauacaaaacaucaacaaaacaaaaaguugguuuuuugaaaagauaaaauugacaaaacuuuaggaagacgaacuaagaaaaaaagagagaagaccaaaauaaauuuuaaaaaggagaugaaaagggagacauuauaaccaauaucacagaaauucaaaggaucauuagaggcuacucuaagcaacuacacaucaauaaauuggaaaaccuagaacaaauggauaaauaccuagacacauacaacccuccaaaauugaaccaugaagaaaucuaaaaccugaacagacgaaaaacaaguaauaagaucaaagcuauaauaaaaagucuuccagcaaagaaaaacccaggaccugauggcuucacugcugaauuuuucaaaacauuuaaagaauuaauaucaauccuacagaaacuauuccaaaaaauaaaggaggagggaauauagcuaaacucauucugugaggcaaguauuacccugauaccaaagccaaauaaagacacauaaaaaaaggaaacuaaaggccaauaucccugaugaacauugaugcaaaaaucuucaacaacauacuagcaaaccaaauucaacaauacauuaaaaagaucauuaaucauaaccaagugagauuuaucccacaaauguaaggauaaucaacauauacaaauaaaucaaugugauacauuauaucaacaugcuauaggacaaaaaccauaugaucauuucaauugaugcugaaaagcauuugauaaaauucaacaucuguucaugauaaaaacccucaaaaaacgggguacggaaggaacauagcucaacauaauaaaagcauauaugacugacccacaguuaguaucauacugaauggggaaacacugaaggucuuuccucuuagaccuggaacacagcaaggaugcccacuuucaccacuguuauucaacauaguacuggaggucuuagcuacaggaauuagacaaaaggaagaaauaaagggcauucaaauuggaaaagaagucaaauuauccuugcgugcagauguauauuucuuggaaacauguauauuuccaaguauaaucuuauacuuggaaaagccuaaugaucucaccaaaaaacuauuagaacuaauaagcaaauucaggaaaguuucaggauaaaagaaucaguagcauuucuauaugccaacagcaaacaaucugaaaaauaaaucaagaaaguacucccauuuacaauagcuauaaauaaaauuaaacacccagaaauuaacccaaccaaaaaagugaaaaaucuuuacaaugcaaacuauaaaacacugauuaaugaaauuuaagaggacacacaaaaaaaggaaagacacuacguguucacggacuggaacaaucaauacuguuaaaaugucuguacuacccaaagcagucuacagauucaaugcaaucucuaucaaaauaccaaugacauuauucacagaaauagaagaaucaauccuaaaauuuauauagaaccacaaaagacccagaauagcccaagauauucugggcaaaaagaacaaaacuagaggaauuacauuaccugauuucaaaauguacuaccuagcuauaguaaccaaaacagcauggcauuagcauaaaaacagaaauauagaccaaugaaacagaacagagaacucacaaacaaauccauucaucugcagugaacucauuuuugacaaaggugccaagaucacacauuggggaaaggauagucucgauacacagugcugggaaaacuggauauccauauauccauaugcagaagaaugaaacuagaccccuaucucuugccauauauaaaaaucaaaucaaaauggaucaaggacuuaaauccaagaucucaagcuaugaaauuacuaaaagaaaccgucgaggaaacucuccaggacauuggacugggcaaagauuucuugaguaauaucccacaauuacagacaaccaaagcaaaaauagauaagucagaucacaucaaguuaaaaagcuucugcacagaaaaaaaaaaaucaacaaagggaggacacaacccacagcaugggaaaaaauauuuguaaacuauccaucugacaagggauuaauacacacaauauauaaggggcucaaaaaacucuaugggaauaagucuaauaauccuaugggaaaaaaugggcgaaagaucuaaauaggcauuuuucaaaagaagacauaccaauggcaaacagguauaugaaaaggugaucaacaucauugaucaucagagaaaugcaaaucaaaacuacaaugagauaucaucuuaccccaguuaaaauggcuuuuauccaaaagucaggcaauaaaaaauacuggcgaggaugcagagaaaaaggaaacccucauacacugcuggugggaauguaaauucguacaaccacuauggagaauggcuuggagguuccucaaaaauagagcuaccguaucacccagcaaucccacuccuguguauacacccaaaagaaaggaaaucaguauaucuaagagacauuugcacucuguuaauugaagcacuguucacaauggccaauauuuggaagcuauguaaguguccaucaacaggugaauggauaacaaaaaugugaugcauauacaccauggaguacuauucagccauaauaaagaaugagaucuugucauuuguaacagcauagauggaacuggaggucauuaaguuaacugcaauaagacagguacagacagacaaacuuugcauguucacuuauuugaaggagcuaaaguuacaacaauugaacucauuaagauagagaguagaaagaggguuuccaggggcuaggaagaguaguggugauaggaggaaauggagaugguuaaugaguacaaaaaauagaaagugaaucacaucuaguauuuaauagcacaacaaggugauuauaaucaauaauaauuuacauguacuuuuuuuaaaaguaaaaguauaauugggcuauuuguaacacaaaggauaaaugcuuaaagugaugcauaccccauuuacucugauaugauuauuacacauuguaugccuguaucaaaaugucuuauauaccccauacuuauauauaccuacuaugcacccacaaaaauuaaaaaucgaaaauuaaaaagaaaccuuaaaagaagcaaugguaaaaucacaaaagacaaucaaguuuaauaaaaaauugaaaccuuucauauaauaaaaaguucucugaaguuaaaggaaaacaacagguuagggaaaauaugugcuauaaauaaaccagguaaaagauuaauauauuuuuagaagcuuaagcaaaucaauaaaaaaaaaaaaccucaaaagauuagagggcaacagguauaagcagacaauuuuaaaaagaagaaauucuaaaaucaaacuugaaagcuuccaaagcuuauccaaaaacuaaaaaucacaaaucauaccaaaaaugacuuauccuuaucuuuuaaauuaucaauaaauuaauaauacccaauaucaauuaaaacauuuuaggaccagcauuuucauauaauauuuguuguauugcaugguuuacaaugauacaaccuauuggaaacuaaccaucaagccauagaaaucauuauuacuaugauccaauucaaaauaaggaaaaaguauuuaugugccaacauguuuacuaguauuaucuaugaaaaugaaaaacuaaaaaacauaaauauccaaaaguaaaaaugacuaaaauaaugucauuacauccacuugaaugacugguagaugggcauuaaaauagaugacugugaaaacacauaaaaacauuaauaaugcuaaaaauaauauuaaauggaaaaaccacauacaaaauuauauauguaugauuauaagcaaugaccaaauacauucuuuaaaauauagaguggguacaccuaugggaagcugacuucccucagucgggcacuucucaugggggcugaacaugguuccugccauucuguuacccacucucccaggugagcccuggauuggcucccagaacgccuuuguaaaaucaguagccauccugcaggcaggcgggacaacaggggcuucaguagcuucauuuuccugucuugcagacagagacccuuggcuaccacugugcugcuaauaggauaaguacucuguugccggauuaccaugccuuuuauacaaaaccaaauuaacuuaccuaauaccugacaccucuuugggcucugaacugcuuucucucaucaagcaugcuagcccucuagacagaauucuagaaauuuggcagauaguggaagucuuuaauugaacuuacuccuuauuugacugaaaagaguuuuaaauucugagcuccugagauacugacuagcaaccauggaaugaaugugugaccagaaaguggcuuugacaccaagugcugcugucccuuuguaauuggcuucuaacggauucaaccagaaauaacugauaaugugaauuuguguuaauuguucacuuguaggaaaauagaacacguaucacccuuuguuagguagacaugaacuuuuccugcacaaagccuugcuuuuagagaaugcccaauaaggcaagaaaaagcauaguaacuugugcuuugagagcucaauauuuguaucuuaucaguacagaagaaauauuucuguguaacuugaucuucugucuaguacuugucuuauagguaaccaacacugaaaacuuuguagugauggcuaccaaagaaauacaaaaaaacaaccuuuuauuuccaaauuguuaaagagccagccauugaugcugcuaccugaguuccaugcucaagagccauuguaagagauuaagggguuucuagguuuuuggugauuuuuuguuuguuuuuuucuuuguuuuuuaguuuguuuuuuuuuuaguuuuuuuucuucuuucuuuaauuuuuugauuaaaacauacacacagcuguuagcauaaagucguggggggcauuuucugauuaacugcaaagcccagguugccucucgugaaaaaauccugugucuugauagcauggaugcugugugugugcaugugugugucugcauucaugccuuaacucggguuacugcucaacuuuaguucuugacuuagucugcaccaucaucuagauuguauuguacaucucggucugaacuucauccuagcaaaaacaaaguugcaggcacaacaguuuaagaaugcauuccuccagaaaaguaucuggucagguucacccugagccuucuuuggacuuaauuuggaacuuagccuagaaagcaaaaguggacuguccaacagaaagaugucaacaaggaaaagaggagagccaagcgcuagcaugccuuuugccucugcauaucugugcacacuguauguuguucaugauagcuugucuacaacuugacuagguuggaguucugguaauaguggcaaucuugacauucuuggucagaguuuagagagauguaagaccuucaacuaaugucuuauuuacuccuuuauguugauuagucuuugauacaugugcugaaucagaaaccuaaauaaagauaauuuuuuaaaauguaaaaaaaaaaauauagaguggguauaaauacucuaguauuauaauaguucauaugauuagaaguaauuuuuaagauuucuauauuuuauuaaaugugauuaauauauuuucuuaauuaaauauuaaagaauuagaagguuuaugaugcuuuaaaauuucugucuaaucucacuaacuuuuaacacuaaguauaaaguagacauuauuauaauuuuauuuuuaagcaggauuccacaacagugauuuauaucuaauuuuuacuuuauaaaauauucaacagcaguccaauuuaaauuaaugauaacaaguuaauagaaaagaaauaucaaaaucuuuugccagacaaaaaaaggccaauuuguuagucuugccuuaauuggguuucuguuucuugaagauuuucuauuuguuucaacauccuuucuucuugcuuuuuguuauucuaaagaaauaauguuguuuauaucaauuauuuuguuuaaacaaaaauaaaauuuaaacuacuauuuaagaccuuuaucuaucagcauaaaauuuauuuaguuauauauaaagcaaaaaaaugggcuuuucaacuuguauaguuccauacuacuuuuuuaagccuuacuuuaauuauucucccaacaaucucuauauaacaguuaacaaaacaaguaucauuugguuuuccagcguuacuuugagucuguauccuuuguucauauugucacuucaaguaauguuuuccauucauuguuaccuacugaacucauaauucaccuuuuaagaccaaaaucaaugcuauauucucucagaagccuucucuuuauccaaagcagaagugauccugcaaacucugauagcaccuugucccacuaacaacauauaugacauacuauuuugcuuaaguuaugugagaaauuacuauuuuuuauuaagucauaaguucuuaaagagaaagggugacauuuuauucaucauuguauccuccacaaucuuguaugacuuaauaaauaccuauugacuaaauacuuuuuaaaaaucuugaugccuaaaauuaaauuaacuuuuucuaguaauggcuuccauuuuaauuuuaaucagaggguagccucuguugccuauuaccacccuauaagaccaauaugcauauuuuucugcuaaaacaaaguuuuagcucuaaagcaaucagacuuuaaaggucaaagggucuuuagaggucaucuauucuaaccugcuaauuggaagaaaacuaagucaccagcacuuucuuuuucaacucacauuaauaucuucuugcugauucuugaguucuagggucauaucacuuguuuccugugugagcucuuuguuuucuagugaaagcuuguugcagugugaaguuaauucaguauucuuaagccuauuuuuuaaaaaaaaaagucauaccaaaauauuuacaaauguaaugacauaauauggaauuuuauucaacauaaugauaggggaaagggaugaagggcugggggaaaaacaugaaacaaaauugacuauugguuuauaauuccugaagcugggugauagguugaucauuacauuauuccuucuaauuuuuauauuuuugaaauuuuucuuuacuaaauuuucaaaugucauacaauauauuuccuugcauguucccuguuugcucauccuuucauacuuuccacaaauuuugaagagcacauuauuuucuucaauaauuuuuuccucuccauuagacugucucuuagaaguuauuucaaacuuccuauaaccugauuaaaguaguacacgaagcauuagcuguguuuaauuaagauauuuuuaccugcacguugugcacauguacccuaaaacuuaaaguauuuaaaaaaaaaacugaauuuaacuuuuuugcacaacaccuaacuugcucuuaaaagaucucaaauguucuacuuuggaagagagauuauugcuguauugcuuacauccaauaucaauuuuaaaugaaggcggaggaguauguggcucuacagagugauuuuaggagcaucuauuaucuauuucuacuuaaugauacuggaaauucaucaaagaggagauaaaguguuucacuaagccaaugaaaaguugaaaagcaaauauacuaaggauaacaaauuuacauuaaaguacaaauaacuaaccaguccauucauuaaaagggacauuaguuaauagaugaguuuaaccuagggcccuuaaaaaaguacuauugaaaagguaccagaaauagagaauuagauaaaaaggaagggagaggaugcugcauaaacuguuuacuucucauauuuaaucuagcacugagaagccaccaaaaggggaaaaucaugcucaccaccacuauacuggcuacuugaauuuacuuuucucugaguaauaauacaauaauaauuuccccgcuuucucuccaaauuaaacuuacugaguagguaaaaucauccaauucaauauuuuauuuggauaauguaagaaauaauuuuuuauuuugacacuuuaucagcaaaaaccuauaaaauaauuuagcaaaacaaccaaaacaaccaguuagaacugaaaaugauuauuuuuauggggaacuaaauaccucuaagaaaaguaacacauugaucuaaagugguucucaaauuugggauguacucuuucuuuaugucagugauauguacuuucuuuagcaaugaaauuagcacauuauuuagauccuuaagaguaaaauacaauuucaaauccauucaaauaaauauuaaauauaauuuacuaaauuauuauuuauuaucagaaagcuuaggaauugaguacauaaacuauuuuuagauaaauggaaaacauacuucucguuuucaagcucaguuuuuagaucuuuaaccucuuuugaauaauacuguucacuugugguaauggcaguuaacuguauuuccaaaucauguacuucuuucugcaaaauaaacauauauaacuauggcaaguguuuuucgaauuuucucauuuaaaagguauagucacuguguaauuaagucauauauuuggcaaaaauuuggcagguuaugucaaauauuuuaaacgaguaaauuuaaagugaauaaucacuauaauuuuaaaacaaugaacaaugacauauucaguauaaguaaauucuaucucgauauuguaaaauucaaccagaaaaacauuuauaugcuauaaaauauucucacucugccaaguaacuaauuucuauuaaaauguuauauuaucaaggagaaauauauuaauugaugaaaucagguagugucuuaaaaaacuaaaauguucuuauuauuauaaaauaauaagaacuauaauguucuuauuauuguaaaaagacaagauguaauacugucauggacuggaaacauacuuuaaaauacaaauucuaaaacuauaacaugagcacuauaaaaaguacuauaaacuaagaaccuaacuuaaugaagucuaaauuucaaauguaccaauuaagaaauacuuggcuaggcaugauggugugccccuauaauccuagcuacuugaggggaugagccaggaagcacaggaguucaaagcugcagugugcaaugauugugcauuugaauuagcuacuucacuccagccugggcaacauagcaagacucugucucaaaagaaaaaauacucaagacaucaagaaauaucacuauuauaaaccauagcauaaugcaucauauugaucuuuuaaaugcugaucuuucucacauuauaauauggggguugucuagauguguuuuaaaucaaucauaaauauauuaauguaauaauaaaugcuuggaaaggaauuuugugaagaaaucuuuaacaaaagaaauacuuauaccauaauccauaaaucuauguucuauuaacaaaauauuuaaaauaaaaauguuuccuuaaacaaaccucucuggcuuggagaagaccaauuaguucuuguucuguuccuuuuaauucuucagcaaucuucucaaauuguuuauuuucauauaaaaguguuuccuuuucucccuauuuauaaacauuaacaaaucaggaaugccaaaccauacacauagugaaaguaaucaaacugcccaaauggagcuguggaaagaacuaugagcuucccccuggcuaaaauucuuuaaaaagagaaaauuagucaauauuaaguaaauucaaagacuaaacaugaugacagacaauucaguagacacagcccuggaacacaauaauuaauuguuuaguuacagaugauuaauuucucaucauuccuucuacuauccaacacagcauauauuuaugaacucacuuuuuacuuugucuucccaagcaugacaucacaaugauuuuauaaaaggccucacaauaaaagguccuauauuauuaaccauaaaaacuacuaauuguaguuaaggaguuugaauuuuaucuauagacaauguggaaucaucauaaauguuacuguaacaauauauaauccuauuugcgauuuuaaaagauaacacuagcaauagugcagaagaaagcuuaaguagggcgaaccuaaaaacaagaaagccaguaaugagacuacugugccaaaacaaaugcaagaugaaaaguguuuaaauuauaucaaggacuguggagacagauugauaacaauaaccaugguuucaugcuuucagaugacuucuguaugaccagcccucacuagaugcuuaaaauauauuuucauucuuuacacuacucuauggaagucagauuuuuaugucuccauuugaaggaucaaaaaauagaagcagucuuuuagcuuucaguaugucacuauaaucucaugcccagagaccaacucucccacugaaaacuucuauaaacucuggacaaaauacauaaauacauauaaacguguguguguguguguguguguguguguguguguguguguacagcaagggagagagagggaaagaaggaaggagggagggagggcgggggagagagagagagagacaauauauaaccuaaggauuuuaacaaguaaaaaaaaaauuaacacaaguggcuggaagaggagugaguuugucaguuuugguagcuuugucccaauggugaaaugucacugcuaagcagugugguauaggcagcuaaaacuacaauagaaaccccaccaucucucuugcuagaggaaccugguagaaccagggaaaggagcccugggacccacaaccagcugccagaauauaaaggagaaaucauacagaacaaagaaccacugaaaguaaucuccugauucuauguaugaauacuacacaaauuuaaaaacaacccaugaagcauacauucauauacagagucaaaaguaguacaccaaaggcucagagaauuaaacuaagauuugaagcaccauuuauagaaggugagauaaaguuuauuuuugaaucuagcaaacugauagauaaaacaaaaacauuuacauuauucagaagaauguaacagaaucuacauaauauaaccuucacaauguccugaauauaauccaaaauuauucaacauacaaagaacugguaaaaugucaacauucucaagggaaaaggcaacagauauaugcuaaccccaguauaaccaagaugugagaacuuuaucagaugagaacuuuaaugcagcuaauucaguuuugcucaaucagguauaggaaauacucuuaaaaugaauaaaaagauagaaaaucuaaggaaagaaauagaaaauaagaacaaauggaaauuuuagagcugguaaaaaaaaauucauugaaugcucaugggagcacaauggagauuacaaggaaagagacagugaaucugacuaucagaacaacagaaucgauagucugaagaauacagagaaaaaacauugaaauaaaaugaauagcaccucaggaacccguggaacaauauaaaaagaucaaaucaauguauaauuguaaucuuagaaggagaagacagcaaaaauagggcagaaaaauauuuaaauggccaaaacuucccauauuugaagaaaguuaaaaauuuacagauuuaugaagugcagugaaucucaaauauaauaauucaacuucacuuacauacugcugaaaaucaaaguuagggagaaaaucuugaaagcaugugagucucucauuagaaaacauggaggaucaaagacaauaagacaucaucuuuaaggugcugaaagaaacaaaacugucaacccacaauccuauaacaaaaaaaaaaaaaaauccuuccagaaugaagaguaaauaaauaauauauucaaaaagaaaaacuaagaaaauuugucagcagcaaaacugcacuacaagaaauacuaaaggaaguucuuuaggcugaaggagaacaauauuagagguaaacguggaucuucaggaaaaaauaaagaauaucacaacugguaaauauugcaauaaauauaaaagaucauuuuucuucaaguuauuuaaaaaacauaugacuacuaaagcaaaaauuauagcacugucuuggaagauguaaaugcauguagguguaauauauaugacaacucuagcauaaaggacaaagugggaaaaggacauaaauagggaggccgaggcggguggaucacgaggucaggagaucgagaccauccuggcuaacacggugaaaccccaucucuacuaaaaauacaaaaaauuagccaggcgucauggcgggcgccuguagucccagcuacucgggaggcugaggcaggagaacggcaugaacccaggaggcggagcuugcagugagcggagaucaugccacugcacuccagccugggcaacagagcaagacuccaucuaaaaaaaaaaaaaaaaaaguuucaacauuuaacaugaagugguacaauauuaacucaauauagacaagguaauggauacaugcuguaauccuuagaacagccacaaaaauaaaugcagagaaguauagauaaaauaccaguagauacauuaaaacggaaugccaaaaaauauucaaauaacccaaaagaaggcagagaguuuaaaagaggaacaaaacaaaggagcaaacggaaaacaacuuuuaaauggugaaucuaaucuaagccacaucaacacuuaaacaacaauuuuuaaagauaucaauggucuaaauucuccaauuagcagugauugucggagugcauaaagaaagaagacccaauuauaugcaggcuacauauaagcacauauguacaaauauaaagucaaauguagguuguaagauauaucaugcaaacaacaagcauaagaaacauggaguggcuauaauaauauguuaaaauagacuuuaaaacaaaaaaguauuaucagaaauugagggcauuuaauuauaaucaaagggucaauucaucaagaagauaugguaguuagauauaaaugugaaguuuauagcagaaguucaaaacacacgaagcaaucacugauagaauuaaauagauaaauaaacaauuccaaaauccuacuaguuuuaacucuucucucaguaaauaauagaauuagacccaaaaauucaauuaaaaacauauauuuguacaacaccaucagccaacugagccuaauugacaauuacagaacacucuaccuaacaauagcagaauacauauuauuuucagugcacauggaacauucacuaagauauaucauaucugauacauaaaacaaaccuuaagaaauuuuuuacaaaaguacauucucugaccauaacaaaguuaaacuaggaaagaauaacaaaaaauaacaggaaauucuccaaauacauggaaauugaacaauagacuucuaaaugggaucaaaggaaaacccucaagagaaauuuaaaacuauuuuaaacuaaaugagaauacaacacauaaaaauuugugaaaugcagcugaaaaggugacuagaggaaauuuauagcaugcaaaugcuuacaaaaaagaaaggucucaaaacaaucuaaacuuccaccuuaggaaucuagaaagagagcaaaauaaacucaaaguagcagaaggaaggaaauaauaaagauaugagcagaaaacaaugagauugaaaacagaaaaacaauagaaagaaucaaugaaauauaaacuaauuauuugaaaagaucuaugaaauuaagaaaccucuaccagacuaauaaaaaaggggccggucacgguggcucacacuuguaaucccagcacuuugggaggucaaggcgggugcaucacuugaggucaggaguucgagaccagccuggccaauacggugaaaccccaucucuacuaaaaauacaaaaaauuaguagggugugguagugcaugccuauaaucccagcuacucaggaggcugaagcaggagaaugacuugaacccaggagguguagguugcagugagccuagaucaugccauugcacuccagccugggugacagaacaagacuccaucuccaaaaaaaaagagacaaaaaagagaaaugacacaacaaccaauaucaguaacaaaaagaagguaauccuacagacuguacagauauuuaaaaggauaacaggaaaugcuacaaaaaauucuaugcacagaaauuugacaacuugggggaaauggacuaauuucuuuaaaaccaaaaacuaccaaaaucauucaagauuaaacagguaaccugcauaguucuauaacaauaaaaaaaauuaaauccauagugaagaccuugccaaaaagaaaucucuagacccaagugguuucacuagagaauucuaccacuuaaagaagaaauuauaccaauuuuacacaaucucuuccagaaaacagaaaagaaacaaaagcuucuauggagcauaaaacaacucuaucuuggaagcuaaucuaccauguuggcuucugcuuaaccccuguuccagaaaguccucuaagauuuccaguuuaucuauuguuccuuguguacaagaagguacuucccguaaauccugcccuuaggacauauuucuaguauugccucugaagcacauguaccccuccucuaagguauauaauccuugggucuggggguuaacgaugcagggauucaucaucuugucuuaccacuacuugagacacacauggcuucuguuuguaagucccuauuaaauguuuccaagaaacuggauuuauaagccucuuucuucagccucuaagcuucuuugaacuuuggaauagguuugcaaagaccugccucugugaaacagcuucucaguucauuuuacaaagccagcauuacuuugucuccaaaaccagacacagauagcaaaagaaaagaaaucuacagaccaauaucucuuaugaacucaaauauaaaaauccucagcaaaauauuaacaaauaaaauucagugaaauagaaaaaaaguacaauacucaacaccaaaugggguuuauccuggaaaugcaagguucauucaauauuuguaaaucaaugaauacaccacauuaauggucuaaagaagaaaaaccacaugaucauauaaauugacacagaaaaagcguuucacacaauucaacuucaauucauaauauaaacuuucagugaacuagaaauacaagagaacuuucuacaaaaaaccugcaaguaacaucauaacuuaaugguaaaacacugaauguuuuucucuuaagaucaggauaucaaagauuuacaagcucaccacuguuauucagcauacuggcagucugaggccaugcaauaaggcaagaaaaagaaaucaaaugccuauuugguaguuauuuaaaauaccugcaaaaagagaaauacuuagguauaaaccuaauauaacauuuacaguacuguaugcugaauacugcaaaaugcuaaugaaauaaaucauuauaaagaagaucuauaaaaauagaaacagauacuacguucauguacuagaagauucaacguacuaaugaugucaguucaaccugaauuaaucuauauauuucacacaauuccaauaaaaauuucagcaagaguuuuuuaagguauagaaaagcuaauucuaggcggggcgagguggcucacaccuguaaucccagcacuuugggaggccgaggugggcagaucacaaggucaggagaucgagaccauccuggcuaacacggugaaaccccaucucuacuaaaaauacaaaaaaguagccaggcgugguggugggcaccuguagucccagcuacucgggaggcugagacaggagaauggcaugaaucugggagguggagcuugcagugagccaagaucgcaccacugcacuccagccugggcaacagagcaagacuccgucucaaaaaaaaaaaaaagaaagaaagaaaagcuaauuauaaaauuuauauggaaauguaaaggaacuagaauagcuacaacaauuuugaaaaugaauaauaaaguuggaggaaucacauuacucaauucuaagacuuaguauuaaaucuacaguaaucaagacacugcaauauuggcaaaugaauagacaaauacaccaagaaaauguaagagaguccagaaauagacccauacaaacauggccaauugauuuuuauaauaaaugugcaaaagcaauucaauggagaaaggagaguauuuuaaacaaaugguaaugucauccuacaucacuuuuucucacuacuacuacgaccucccagacuaagccaccaucaucucuccucuggcuacugugauugucugucuacucuuaacuguucugccuuaauacacuauucuccuucaggccaaaugugcuuuuugaaaugcaaaucugaucaagucacucccugcuaaaaucaucuggagugucccaucccucuuaggauaaauacaaaauuccuuugauaugauuuacaaggccaugaauuguaaggcuccuaucuaacucuccagcagcaucuuucacuucaucauguacucaccauacucccucccaugaaaagaaucuuagcauguuuccucuaucugauaugcuguauuuuuucuccagauuucaguucaauccuuacuucuucaaaaaagccuauccuaaccuaacuaguucaaguccuuuuaucauaggccucaucauacuaugaacuaauccuuuaaugcccuugucaccauuguaauguuacauuucaaugagugauugaauuuaagugugacuacuugauggcuguuguuccaugaaggcaguauauggguccauuugcuccccacuguauccccagaguuuuagcauaauuaaaacucaacaaauguuuguuuuuguucuucagacaggguccacucuguugcccaggcuggagugcagugguucaaucucagcucacugcaaccuccgccucccgggcucaagcgauucucugucucagccucccaaguagcugggauuauagucacacugccaccacgcccagcuaauuuuuguauuuuuaguagagacaggguuuugccauacugucuaggccgaucucgaacuccuggccucaagugauccgcucaccucagcuucccaaagugcugagauuacaggugugagccagcaugcccagcugaaaaacucaacaaauguuuguuaaaugaguaagugaauugucuuauuuauuccucacaaucacccuaugaaauauguacaauuauuuuuuccauuucauagauggaaaaacugaggcaucaagaguuuagguaaacugcucuugaucauauagcuaacaaguaaagagcugcacaccaaucaagacauucugauccugagaauccagauauugauguuguucauauauaaugagacggccaaguaaaaagagcacccuggagaaccuccgauaagccugcccacugggaggacagggcggggccucaggaagcuccugccguuugcggggugggggaugaacuugaccccuccugcucuuaugugguaaccagggauucaaucugugaugcagaaagccugcuagcaggacucucucuuugcugagagucccuguggcccuuuuuguccuuuucacccaauaaacccugcccuacucacccuuuaaagugucugcaagccuaaucuuuccugauccugcgacaagaacccgguuuuuccuacaacauauuguuugagaaacauaaggcuugagaaagggugagugaaaugcaaaccaaaaaaaaacaucuuuuucucuuucgcuucuaagccuuuuuuccuucggauuucuucugaggauagaggaaacuguaccccuacucccauugcucccggagaucuggaaugucggccucaguccaacccagccuuuccauggccuuuucuuucuuuuuuugguacagaugggcgagcagcaguuccccgccgcccuccccuccccguugggaagcaugacccaagggccccacgaggcuggcuggcacucccugccaagcgcccguggagucucccccucccccagccaaggaguccagcuccaucccacagcaauuaugcuucucucccuaguggaggaacaacuugcauaagaauaauaaguucuucccccaggcauccuuuucucuucacccugucagcaguuaacacagcccagcaucuaagcugucucauccuuuucucuaccuugucagcagguaacuuuuaaaccagguuuuuuucuuuuuggaagacauuuugcugggccaggaaugauggggaucacuauuuauauuuucuguaguuuuaguugugagaaaggauuugugagguucgucuuaagcugcaaccaaucuagcgugcuuugcaugacuuucuguauaguccucagcaaauuuugcugcaggccuccaucuugcuguccuugggagcaagaccuguaaccacauagcaauguuuuauucuagccuuugccauuuuacaaugguggccccagguucaauccuagcuuagcgaaugaguccuuuaugguuucauaucugcauaaccuuuugcugcuuauugacucucuuccccuccacgcacugccuuggauuuuccuuucucugagccuuuaguaaaguuugaaagccagaaguauugguagcuuggcccaacuaaaguuggcuaauaauggaguuaaaaggauuuucuuaaggaguacucagcuuaauuaaaguggauauccaaguuauagcucuauuuauaaggccuuuauguuuuccuuuuauuggaccuuguuuuucugggaaaagguuuuuuucaguugacuaaauuauuuuucucgauuuugccuugccacuuuuaaugcacaucugaguggggagagaccucugcuauccucauggaaccccaggaauuaaaagcagauagauuccucuccccauuugaaaagaucuuaugacaacugggguuucuucugccuauguaguuacauaugugugaugucucuaaaaagagcucuaauuaauuggcuuaaaggaagauaagugcuuggaucaaauauuuuuuaaagggaagauaaaagcugugguaccuuucaguucauauaacuuuaaucuuuguaaaauaaagacugacuuaaagauuauugguaaaaagcagauaucaucaaaauauaaauagguggacuaaauuaugcaggucagaugcaagguuuguuaaguguuuuaagguuauaaacugcuuuuugguuuuugagaacuguucaacuugguaaggcauggggacauauggaacuaaccacacccuuaauuaugcaggaagaagucaaaccuuagcugcuccuagcacauacucaaaacaacuuaccagauuuuacauugaaguuaaaaauugcuaaaaguuacuauuaugacauguaauugagacuacuggaaauagauuuacaugugagguguguaagaacaguaaaauguguuuuuaauaaaagguuauaagaggcuaggcgcaguggcucaugccuguaaucccagcacuucgggaggccgagggagguggaucacuuguggucaggaauuugagaccagccuggccaacauggcaaaaucccaucucuacaaaaaauacaaaaauuagccaggcaugguggugggcgccuauaaucccagcuacucaggaggcucaggcaggaaaaucacuugaaccugggaggcagagguugcagugagcugagaucacgccaccgcacuccagccugggugacagagcgaaauuccaucucaaaaaaaaaaauguuauaagaaggcauuaaaaauguaaauuguugccuaagguuaaagaauuguuucaaauuagauaaaauaaaguuaaaaguucaaacaagugguggaaggauuguaaaaacuaaucuugcaaaaacucugugugugcauauauugacuaaauucaaaaaggcauuauaggguuuuucuguaaauugagcauuaaaauaaaagcacaacgaaguauucauaaggcacuaaucugcucuuaagcaaaauuuguaacagguuauaaaaguuucugaaucacgacuuuggcaaaauaaaugauuuaugucaucuggaauucuauuucauaacauuaaguguuuucaaccucuaacauauuuuacaggcuucccaaaaucaaacuucaguuucaaaauugccuuuccugacgccaggcuuuuccgaugcuucagaagggccucuggaguauccagaaaagagguaaacaggauuaugugacauguuuacuuacauaggauugccaaaaugguguucaauauucuuuagguuauauuuuggugaauaauacuaauauauguucccaaauuguaugggauuucuaaaauucuaaugucugaguauacuaucaaucacaauuaagguuaaguuauuguaaaccacggagguaccaaacuucuuugucaauuguguuucuaauuguaacuacccuggacauuucguuauucacagacaauuguugucuuguuuuaauucuuuucaaaagaugguuuauaauaagcuauagaacuuugacaggugcucucaaauacaggucugauaacuuugaagauuaugacacuggaauaaagggaaauguacagaauucaugaagagcuaaaauguucaugaauaucaaggaaaagaagagcuaacugaaugaauucagaaaacugaagcaaucuuuuugacuuuugcuuggaauauugcugauccuuguuuuguuuuucagaguaaaggaaacauuuuggacuauuuacagccuuuaauaauugaguaagguauacucuugugaacaaaauuuagagcauguuuauuucucucugccugguuccucuagaauuuggaaacuaucuguguguauucuuaacuuacggcaauauaguuguuugcaucagugcaauaagaauucauuuucuuuugcaacaggaugcaauuaaagaaacugguuguuuuaccaaggcuuugacuggaaggguaugcuucccuuuaagcagucaaacuugacuugcagagccaauaaaagccccuugggaaaaaacuggccucacaccguugucugcacagccccauacaggguuccugaccuguggucaguaaagaaugucacuuucuaacaggccaggaguuccaaguauaucuugggaccuuagaaggagaggauuacccaacucagagguauuugaggauacaaauccauggcugggccuagcuuuaaaaggucuuaucugagauuccuuguggaacagaguaccaucaaagccaaucuagaaguccuauguagaaauaguuauucuugcuguacuuuaugcaaaaaaucaggccaaguauaagacuaaagucuauuuugcaaacaacucaguccuaucaugauuuguuuuuuuagcaaaaaugaggacuggagagagagaaauuauguuucaaaauuuaucauacauuugucauuacuuucuaaacucauuaguuguuuuuaaguuuuugccuacauuuuagacuaauccugcuuguuccuaugaaccaagcagcauucuccagauguggcucagaaggaagaaaaggggauggguaauguaaaaaucuggaucaauauucuaguucugagcaauuaucuugcaaauccggacagaugaugggaauaaauaaggugcccaucaccuggagguuucuuuuuugggaaaguaagaccaagggagcuagccaaagccaagcacaaugcacccaaaucuuagcaagcauaaugauagccaccaguuaucugggcaugucauaagacauccuuuucucucccuuguuggaggaaaacucaguuccacaguguuaccuuagcauucagcuuacgauaaggaguccaugcaacaccccugagacacauuuuggucccaaacucaauuccaagcuuugggucaaagcacuaggaaagaaaacuggauccagaggcugacaauaagggaaguuaaaaggcacagugcaggugaguguggcugauuccugccaauuaagccaagcuucccauuucauggauaaagucuaugcucacauccaugacauaaaugaggucuagggaauucaaaggcuacugacagcaggggagacauagcauauguggguaagagcagauacuuccacccucuaggcuccccuguuaacaugagugaaagccacuaaaacaccaaugggugguaccugucaugguugccaggacucagggaugcaagaacagaggaaagaaagaggaaugccucacuuucccucccucacauaucccugguauuugcuagugaugccugcucuccuuuuucuagaugaguagccauucaucuucagucuguaccccuuucaaaugcauccugaacuccugggacuccuuuggaaaaaaaccuuguuuuuuccuuuuuccuccuaucuccucucuucgcugauagguaauugugucucuguacuaugggagauuccccucagaugcauccuccaaacugggaagaguuaauuucucaaaccuuaaacuggucagcuuaggauugggcucaggggaagggaaccuagaagccugacauaccagcaaaaggguaaaaguuuuucuuaccagucaggcuuuuggcccucccuucccugugcaaacugguaaaaggccuugggauuuuugagcuguccuuaccaccuaccccacauuuuauuuugauacauauuuucuaauaacccuguuugugucuucucaccuucaggccaucaaacaaacuccaaaacggucaugcaaccagagcuucagacauuggccccuuuugccaggaauccuuagauaugucucugagggagaucugacugcuguuuucccaaaacagcaccuccugucagcaggaagcaauuaagauuggucuuuguccuuauccuuauccuuauucuaauggcaguuagauguacuucuuuagaauggagaagguaaaaaggucuccaaguaaaaaggucuccccggagaaccuccgaccagccugugcacugggaggacaggcuggggccuugggaaguucaugccauuugcaagaaagaggagccugaccccuccuauuccugugugguaacuggggauucaaucugugaggcagaaagcuugcuagcagcacucucacuuugcugacagucccuguuucccuuuuuucacuuuucaccaaauaaagccugccuuacacacccuucaaaaugucugcgagccuaaucuuuccuggucaugugacaagaaccuaguuuuuuccuacaacaauaacaaaaccuccaaaccaguccuuguccaugcagaagugaaucguuauauaaaagccaaugcuuuaguauucauucaacaaauauuuauaaaguguuacaaagugucacuuucugugcuaaguacuagaguuacaagguaaacaacacaaaggcuccuaacccuuauugaagcauacauucauuccacuauuuauuuauugagcaccuacuaugugccagccacuaugcuagguaaggagucuaaagggugaauaaagccuuaaauaauaauaccaaaaauaaaugaauuucauuugugauaaguguuacaaaggaaaaauucagggugcuauggaaauaagccauacaaagaccuaaaccuagccuagaguaucaagagagguuucauaaagcacugacauuuaagcuaagacuuguauaaguaugcauuaauaaaucugaaagcacugaaaacauuauuauuaguuacaaagaguuugucccggagcaauuaaauggagaaaagaaaaauauuuuaaaauaaugcuccccaagggacagaagaacuaggagcugcaaaaucagguagagaugugauagguaaacacaaaaucaauuaucagucaucauaaacaauauuauauucuacaucaggggccagaaaacugcaguaugcaagacaaauucagccugcagucuguuuuccuagacccuuaagcuaggaaugguuuuuauauuuuuacaagguucuuaaaaauaaaagagagaaggcagaggaggcaaaggcagagaaggagaaaagagagaccauguauggcccacaaacuguaaaauauuuacuaucuaguccucuacagacaguuugcugacccauguucuauauacuguaaucaauuaaaauacaaugaaauuuuacccuacaucuucacuaaacaugauuuuaccugaacauuaaauauagguacugaauauauaucauacaccuuuuucaaaauugcaucuuuauuguucaaaggguacaacauccaaaauuaccaaauuuacaaucagcuacauaacaugcaaauuugaucuuagugugcuaucaacacauauucaaaugauauaaacagcuugaugaagacaguuaacaagguauauaaaaauuggucuaaaaaaugcaucuuuacuuaaaaccaaauauaauuuuuacauuuuagcugaaaaaauuaguauaaaacaucuauagugugagagucuauaaguuaagggauucaauauucuucugaaaaguaauugcuauauauuaauaggaaagacuauacuuaccaagacuuuuuucaauucuucaaguucuacuucuuuguuauuuguaagcuuagucaucucuucuaaaaugagcaaaaaaaaaauguguuaaaaagcuggauuaaaagaauaggaaaagagacagaaggaacaagcauaauacuacgcaaaagggaaaaaucaggagagacaaaugcaacuagagcaauguaaagcauagagggaguccaaaucuaacuaugaaaagcuaauaaaagauaaauauuaauaguaauguuucucuaaaguuaaugccauugccaaauaacccaaaguucauaaagcaaaauaagcaauaaaucuauauaaaauauauuugaaaugaggucagaauguacauuuaccuucaacucaucacugucuaaacaucugacauuuuaaucuucacuccaaacuuaaaagaagugauucucuuuucucaagcuaacucugagcauuguacuuuggauucaacauucccaccuccucugagacucugcccuuacgcuaccaauauacacagauucuauguagaggaaucuuuaauuucccuuaucucgucuaaacauucuauuugauuauaaaacaauaucugaccuuucugcucuuucaagcagcuaucaaauuucuuaguuuguuuuuccaacaaauuccuauuuguuaccuacacauuucauuuugaacuccaaguaaaacuaaugcuuaucaccauaauaauaaaauugucaucuuaaggaucaccaauaaccauuuugugauacaauucuuaagucuucaucauuguggagguuuguacuauuugauacuauuaacuucuccccauuuuuuccucuuugauuuugcacuauucauauguccuguuuccucucuaccuccuguucuuguuuucuuugcugacagccuucuuucuugccauccuaaaaaauaaagcccaauguuuuucuuucuacaguuccaugaguucaacauuaugcuaauaaauugaaaaaucuuuccagcccaagccucccgcauuuuucaacuuucuuauauuuuuaaccugcccacaaaaaauuaaaccaaaaaagaaacugccuacagaguucccuaauauguccagcugucagcuaaaaauuuauugugucugaaauauuguccuuccucacuguuaaggguccuuauugauuaauggaaauguaauagacuuacugaaaauuucucaaacucuguacauuuuuuaaaacacuuguaauaauuguccacagucuuuaaagaaaauuaacaaaauauaaaaugucaauauagaauccaaaagaaaaaccuggcguauacauagcuuauuuaacuagaaaguguuauuucagguaaaaauacuuaauuuuuaaaaacucaaaaauugauuaaagacaguggacugagcaugucucuauauguucucucaccccaaucccacaaaauuagaaaaaaaaguacgagaaaaaauauauauaaaagaacaacauuaacaaaauaagagacuaucauuaacaaaccagaaaauuaacgaauccuuggagaaaaaaaaaaaacaacucacacuaauucaaugaaggcuauguggaacaagaccaagugaccauaccucucaccacaaagcccaccucaggauaaaguaaggauccuaggaauuuggguggcagaugagguaguguuacaaauagcuuauuauucuuaagcaagauaaacauccccuauaguaaaagacaagcugcuaugcccaccuuuccccacagcaacucccacucacucccauaaucagaagaauuagauuguaauacacaagugggaaaagaagaauacuuauacuuagagagucaacaaucagguaccaacaauuugugaagaaaagcaaaacaaugaaaaagaaagcuccaaauuaaacugugaaaaaaacuaaaacccaaagaaaaagaguuaauagagugaacagaaacagauauuugacuaaguauaguguuccaacaggauaccagaucccugaaauagauuaccuagagcucuuagaaauuuaaaauuugacaacugagauuuugaaaauagcaaaacagacauauuuaaagauugaauuagcaagggagaaacaaauuuagauagagagauagagauagagaugagauagauagagauacagauacagauacagauggagauacagauaaagauagagaugagauagagauacagauacagauacagauggagauacagauaaagauagagauacagacagagauaggauagagauaccucccaauucaggaaaaagaacaaagagguagaaaauguaagacgaaaguuuaaaaacaagaaaggcuucaagauggcugacuagaggcaucugcccacucaccuccuccacaaagaauaacuaaauuagugaguagauaaauuacacuucaaauagauccucuaagaaagaacacuggaauucaaaagagaugugucaggaaacaccuaaggcaaggaaggguccuuuggacccugagauuaacauagguagcugccuagagaucucacaaaggcauugcuccauagagggaauuuaugcugggucccacccacccucugaguucuaagcagcuauagccccguaccauuuugagagcccagcccccaggagacuacauccugcucuggggcccaaaaacccccgcaucuccauaucccuggagccccacugacaucccccaccugccaauacucacugcuggcuacugcuaccaagacugaagugcaccccacuggcagcaacccugcccccuaccaacagcaggacugcagcacaucuucccgugcgugcgccaggaaaaggcucccgcuccugcagcugcuacuacuggcugcugcugcuggagccaaagcauaagccaauggcaucaaucccaugucaccccagcagaagggccaucacacauuugcaaacaccccaaggacaagcuaccuugcucacagccacaaccucugccacugccagcuaccaggugaagccagaaccacuagcagcaaccucacugcccccagcagcggggucacaugcccugaguacaggcucacggacagcugaugccuggggcugaagcgcacacuccucagaggccugccuauagcugcugccaccuacaacaaucgcacacucccuggcagcagggccgcagcacacuugcacaugcucuaagggcaggcucucccagcucaccacaacugcugcagcacucaccugagugcuccaucaggggcauaggaaucaccccaccccugcccaccagagccagcaccuauaaacacaacugggaagccugaagauaggcccacgaggacuaucucugcucccucaagugccugaguacacuguccaagagccuagggaucacacugccccauccaccaccauuagcaccuaagcacuccuccugggugccugaugaagggucagccaggccugccacuaccaccacagcuggcacucacccauaugcgcuugccuguaggccugcggacuggcccacacaguccauugcagccaccgcauugcaucauuuuuauuuccuucauagcacuuaucccaauuuauaauuaaauauuuauuugugauuauuuguuuuguaugucucuccaagaagagugcaaaccucaugagaacaaauaccaugucuguuacauuccucauuacauauccaaggcuaaauaaggaauaaacaucuaagccuuaguucaauaguuauuauauuauauaucugauaaucaaagcagaagcaauagaaccuacuaggaggggaaucuguuacauaccaaauugaaagcaaagauagauccagauauggaaaaaugaguacaagaauaagacacauuuacagcaauauuagacugaauugaagaugggcaacgcaugaagcagcaaagaaaacuguaacaaguuaagaaacugagaaaaaauuacuugccaaagauuuccuauugcaguugacuucaacucacuugguaugcaguacucccacucuuuaaaugaacaaugaaaagauaacugauaucuaaguaguuugaacuuaggcaaugagaugccucuuaaauuugccacauagaauaaucauauuuguauuuuuaaagaaacacucuagcagcaauguagaaaaugagcaaaagguggcuauccuagaaagaaaaggacugauucucaagcuauuguaacuauaauagcacuggucaaagacgucugaccuaaaagauacaaggaguagagcaggcuauaucugagcaguacauagguuaaaaguguuuugaggauugagacugcugaggaaaugauggaagaccacuuuaaccaagauguaagucuaagaaaauaccaucaaggaagaauguaaaguguagccaggaaacaaagaagaaugagaguuguugggguaagaaaaaagauuauuaaagaaaggcaaagcaaacagaagcuuaguuaaauauagcaaggggggaugaauaaagauuaggacaaauggggguaaucugaagcacgguuugaugauuaaucuuacaaauacaauuuuuguaccauuauguucuuuacaugcauccugaaacucuaaaaccaagaaagagaaaaugaggaauugaacuguucuagaucuguggaaaucaagaaaaggaaaagauucaaaugauaguuaagaggaacuucuaaguuaguuauauuuuaugaguuagguguuaaggagcaccagauaaccaauuagcaguaaagcauaagggaaggagaauaaauaguacagaauauccuucaagauuucugguuuugagaccauauugucacccaaagaaguugaguaccuaugucacuguuaaugcuaccuuccuacacaugauguuuuguacacuccuucauccucuacaacuauccaaagccuuaaagucuacuuuuaaauuuaaaucuaccuuuuccauaaagccuuuuccaacuaugcaguacacauugcuaucuuaggcuuccucuugguaucaguauuaacauaccuccaucaauaagaaaucugugagcauucacccaaaauauauuaguauguauaaaauacaaaugcauauuuauauuuacauaaauguauaaucaguuauaaauuaauguuuauaaauauaaauuuauaaaauauaaauauguauuacaguguucauuauaaaacauauuuaaaacauaaaaauaaauaaaaauagaaauucuaacauuuucuucccuuuuccuaaaggaaauuuugcucaccccuucauuuuggacaccauuacucuaaggguuuuauguauuuaagcuuccuccaacaauaaucagagauuucucaaaaggaugguauguuacuucuauacauuccuacaacaucuaaggcaaugcuaaaaaacacacaugguucuauuucacaauucuagaauacuuuuuucaaauuugucaaaauauauugcucuacugugagaaaaucauauaauacaauugcauuuuuaauaugacaaauagccacuuaauuucaauauuagacugaauuauuacaaauaaauauccauuaaagacauuuuaagaaacaaaauucuuccuuagccuaagacauuaaauuaaacaauucuaaagaaaauaaguauagguauacaaaaauuaacucaagauggauuaaagacuuaaauguaagaccuaaaaccauaaaaacccuggaagaaaaccuagguaauaccauucaggacauaggcaugggcaaagacuucauaacuaaaacaccaaaagcaacggcaacagaagccaaaauugauaaaugggaucuaauuaaaugaaagagcuucugcacagcaaaagaaacuaccaucagagugaacaggcaaccuacagaaugggagaaaauuuuugcaaucuacucaucugacaaagggcuaauauccagaaucuacaaagagcuuaaacaaguuuacaagaaaaaaacaaaaaccccaucaaaaagugggcagaggauaugaacagacacuucuuaaaagaagacauuuaugcagccaacagacauaugaaaaaaugcucaucaucacuggucaucagagaaaugaaaaucaaaacuacaaugagauaccaucucacagcaguuagaauggcgaucauuaaaaagucaggaaacaacagaugcuggagaggauguggagaaauaggaaugcuuuuacacuguugggaguguaaauuaguucaaccauuguggaagacagugaggcgauuccucaaggaucuagaacuagaaauaccauuugacccagcaaucccauuacuggguauauacccaaaggauuauaaaucaugcuacuauaaagacacaugcacacauauguuuacugcagcacuauucacaauagcaaagacuuggaaccaacccaaauguccaucaaugauagacuggauaaagaaaauguagcacauauacaucauggaauacuacgcagccauaaaaaagaaugaauucauguccuuugcaaggacauggaugaagcuggaaaccaucauucucagcaaaaauaucaaaaggacagaaaaccaaacaccauauguucucacucauaagugggaguugaacaaugagaacacauggacacagggaggggaaccucacacaccaggaccuguugcgggguggggggcugggggagggauagcauuaggaaaaauaccuaauguuaaugacaaguugaggggugcagcaaaccaauguggcacauguauaccuauauaacaaaccuacacguugugcacauguacccuagaacuuaaaguauaauaauaauuuuuaaaaaguaaguauagguauauauaaugauuuaaaacacuauuuuaugcucgaaggaagaauaaaaaauggaaugguuuauauuauaaccauucuaauuuaaaguuauccuaagaagauacaauuauuugcauuugauaguacaauuuuacaugauaaaggguuaaucuauaguggaaaauuaagccucacagaaaaaaaggauaaauaugguccaaaaguucaaccaaacaaccuaacuacuugugaaauguaaagcacacauuuccgauacuagauaauauuuuaguugauaauuauuuuaauuauacaacuauuuaaaucuaauaauaaagcuuacauaaaguaaugaaaauauuuuauaaaauauuugccaauucaugaauauuuuuaauuuauaaaaaauauuuuuucacuaaaauuggaaacuauuuuauucuuugcaauuuuccacauuuguagauaugaagaguuaugaauaugaagcauagguuauuagaauuaucgaauuacauggccauaaauuauaaaauaacuacuguagagaaugucucucucguggccaugaaaguuguugaauuuuaauaacaccuuaugauaaaauaggaucacauuuuccugugaauaguacauaauguaacaugacaaagcaaugaaauuucaaaauucaauuaaacaauaacagacauuucucacgaagaauuauuaaggucucugaauccuaaaauaaagaaaacagaauaucaacuucucuuaguuguauucuguuaggagacucagaccucucuuaggcuccccacacuucuaaauaucuauuaacugcauaauaaaacugaauaaaacacucuuucuuaagguuuaaauuuucuaccuucaaauauugaaauaaaaauauuaucaagcaaucucuacuggcaaaugacagaggggaaauuauauuuuauuucaaaacaguguuuaugauucuauaauaaguuaauauuauuaaaguacacacauuauucucuaagucuuacccagcucacuugauuucuuuugaagcuccaugguaaguauuuucaauugaucuucauuuuuuuccaaucuuguaaaauauaucauuuucaauacaaaauauuauuuuagucagaauucaucucauaacuaaaauuggugcaauuuagcaacugauauaucuuagaauagauucacccacuggauuguuaaacauuuauuaaguaccuacucugcaccauauaguguaacauuuuaaaauaagauauuacuauuauaaauacauaauucuauauuacauuuauguaauauacauagauauaccuuaaagcuuaugguauaaguuuucucuuagcuguugaugauaaucagauuaacgcauccuagaacucugaaagaaauugaguauguaacuacuauuauacugaauucugccuuaggaacaauauaauuaugagaacauguauaauuugguuaacuucucuggcuuucuguuuccucaaaguauaaaacugagguaauagggauagaggaaucuuagguaaccuaccuuuuuaaaaaugaaaaaucacuggauaggucaaucaaaaauauauaaauuaggggagcuagaaaggcuagcuuuucccucaccaugcacaagcaacagagaaaaacuauugcuaggccccggcuauggcuucagagagaaaccuguucuccuuuauccuaccaaacuuaauuaacccuaaugcuaaugagacaaaaaauaauuaucuaggccuccuaacacagcuuuauauaaauauuuccuuaauauagaguaguaaaaaauagagucuuuaacacucaagcauuagaaaaacugcuauuuagaugaaaugaaaauacuaguuuauuuuuuauguaaucacauuugugaaaccauuuauuuaauaaguuaaugauaauuaauuauauuaauuaaauuuauacugauuaauugguuaauuuaauaaacauagaguaguacuuaccuaugccaggcuagcugcuaaauuuauaaaucagaaaggucuacagaccucaguaagauaaaccugacagccuggaagcuacuucuaggaagcuaauaauaaucuacagagucauuaaauauaucauaucacugcaucaaccuuucaugaguuuauguauauaacuaaauucuauggcaaagcauacaugagaacuauccuagagaacaucuucuuuuacaucuuuuccuaagauaucugucuauccaaagaaacuuuuaaaauguauucccacuuuauacaugagaccugacuacaguuguuauaugaauuacacacaucaguuggcaaugcaaagaaaauggcauugaauauuaaaaguaaauuguuuuuauucacuuauuuuguguauuaaaaauaauaaauauuuuaccuuugcuguucuguucucaauaauucuuccaagcugcagacaguaguuucaaauucaguaaccacaaacgaaugagcagcucuagcuuuauuagauucuuccauuugaguuucuuuuucuucaguuagcugacaaauuguuuuuguugcuaucuguaaaucuuccucuaaagccuuuugaguacucuaaaugaaauaaaguauaaaacaagagcaaugauccaaaggccuuaaccaaaaaagcugaacuuaucugcuucuauacauucacugccccuuucccacccucauauuuuccuauuauuccuccuuccuacccuggaaugcccacccacuacucuuauuucaauucacuguucuccaaaucccaccuauaguuccagcuccuccauggagccuuccuagccaaaccagccauacuguucuuucaauucuuagaacuauuaauuuauuaccuaaaccacccuguugucaccuguccagggucuuguauuuuaauuauacuuuugauguguuuuuaugcaaugucucuaaacuauagcauuuugcagacuaggauugugucuucucuaacuauuugaaacuccagguccuuguacauuguauuaguauuuaauaaauauuuguugacugauugauagggugagacuuauuacacacuaaugaguuuuuaaaucauaccacacuucuuuguaaugacacuuuaauaucuucuaguucuuuagucaaaugaugcuguuucucaauugauuguuuuaaguuuucacucuguaauucuaaaagagaaaguuauaaauagauaguacuuagcagaagauauauaccaagaaaacuaaguauuauuugugacaauuagucuuuuuccuccguuagauaauaguccaaaaugagaagaaaauaugcaaauauagacacacaaauauuggucaccaucaagcuuuauugacuuuucaagauuguuaucucccaagaacucaaaaauaaauauuuaaggauuuacauuuuuuauaauagcaaaacauuagaaacuaccuaaauauccaaaaguagacaaauuauggaggcacauauaugggaugguauaccauguagccacugaaaauguaauacaaauuuuauugauuauuaauuuggauauucauaaaacauagaauaaaaagaguggguuuaaaacaauauuuaaacacugcaugcaaaaggaaaagauacacacuaaaauaugaaaaguaauuuaucucccgaugguaaaauuauucacgauuuuauuuucauuauugauuaucuugauuuuuuuauuuuucaaaauacucuauuaaaugauaaauaaaagcuuuugacuccacuuaagagcccauuuuuaauaaauacuaagucucagguacuagucuauauguuuuauauuugugcacucauuuuuaaacaucauaaaagcaauaggagaaaaaagaaguucauuauauucucugaauucaaauuauacgauuuccuuuuacuaagcuaccuggccucgggcaugauacuuaaccagucugacuacuuuucccaccuggcauguuagaauaaugauaauuauucauauuaugaagagucaccugcuguuagaauuaaacaagauaaugcaacuuaaaaugcuuaagcacagugucuaaucuauaaucaauaaaugauaacugcuauuaagaugaugauaauggugauauaugguagaaacugaacacuaauauucaugauaauuuacaauauauuggucaggcaggcaaauaaacaaugauugugcugauggguacucacuggaaguucugggaguuuaccuagaggggacaccuaagccaaauaagaucagucaagguuagagguacagggagacagaaaaaguuuaaagacuucaagaaaguagcagcugaguugaaacauuugaaagacaguaagaauuaaauuagcaaagguaauggaaguuaggagagaaaaggucacgggcaaguguaagagcacauacaaaggaaaacacagaagagauagaaugacacguucuggcaucuagagaaaauguauuuuaggagcauaaggcuugaaguauaacgaauaagucacaggagauaugauuggaaacguaacaaggacaagaucauaacaggacuuauauaacuugcucagagucuucugguucauaauucaugaagaccaugcaaaacaauaaaggauguuaagcaacagaaguacgugccaaguuuauauuuuuaaaauuccauucugaaaaaacuacauagaaugaaagggucauugguccgacuguggggaaaaaauagaaaaaguaaaucugggccaggcccggugguucaugccuguaaucccagcacuuugggaggccgaggcggguggaucaugaggucaggaguucgagaccauccuggccaacauggugaaaccccgucucuacuaaaaauacaaaaauuaggugggcaugguggugcaugccuguagucccagcuacucgggaggcugaggcaggagaaucaccugaaccaggaaggcggagguugcagugagccaagauugcaccacugcacuccagccuggugagggaaauguugacuaaugauugugguguccauuaugauacuauuucuuauggucuggugauaaaugucuccucugaaaaaucauaagcacaaacuagcccuuaggcauguaucggaacggaauguauacugccagaauuuuccaaagagcuccaagccaaaauuuaauuugaagugcuccuaaguuuccccaggagccuagaaaauggaauaugcaaauuuucuucaggccuaauauacugcuaauucaggccuuaaagaauuuccacaaauaaaguuacaugaccucacaaucaacaaacacaaugggaaacaaagcaccaugaacagagucagcaaaaugaacaaaaggccaacuuagaucuacaaagauuucauauuuuagaauuauuggcuaugaaauuuaaaaauaaguauuaucacauacuuuguaaacuaaaggaagauaucaguaaaucaauaaaacuacuagaaguaauacauaaaauugaaacugaaaacuccaaagcgauaaugaugagcuuugucauuuaaacacuucuguaaaagggaauaaaaauucaagaucaaauauuaagaauauuaaagcauuaagcuccugacaaaaauaggaauuugccaggccaaaaaugaagagaaaauagaaaccuauagaaguaagguaaccacaaaacuugcuugugcccagagggcauuugcagacccuggcaaaguuggacuuuugguuugaaauaugaugggauagagaauuuaagauauaugaaaacccaaagauuacagaagguagagggugucuaagaaguaaacuuuuguacaauaagccgggacaguuuugauguaaggagcaaacaaaaguaaaccaacucacaggcagauuugcagcccagguucaaaucaccugcguaguucaggacaccccaagcguucaagcugccuuaagguugucccaaauggauagaaauaucaugugcauggggggaaaaaaagcaaauccuuccagguggauguuaagcaggccuuaacuuauuccuacaaguaaucuuuuuuuucaaguaaaaaaaaugagcauaaagucaaaaacaauaaggcacacaagcaaacaagguacuuugacuaaaaacuaucauaaacaagacagaaagagaaucacaaacauuuaaaauaaaaaaaucagaaaaggacuauaaaacagcuaugguuuguauauuuaaagaaaagacaaccucgaaaauaagaagaaacugaaaacuagauaaaguagaauggcagguuagaaaaagaagaauaacaucuuaaaauaaacaucuuaguaacuaaaaauaaaauggaggaauuucaugaugugugagaaauaaaagagaagaaaauuagugaauuacaauacagguaaaaagaaauuaggauaagguauagaaaggcaaaacuguugaaauagaaaaaagagauuaagagucaaagaagaguuagaaaauuaaugaagguuuuuauuuugguuucggguuugguuuuguuugguuuguuuguuuguuuguuuguuuguuuguuuugagacagggucucacucugccacccagguuggagugcaauggagcaaucauagcucacuguaaccucgaacuccugggcucaagugauccuuccaccucagccucccaagaugcaacacggguuuuuuccacguuuuuuucuuacucagaaaaugaggaaacagaaaguagagcaaauacaauaucugaagagauuauuguugagaauuuccaagaaacaauaguaacagacaguaauuuacagauugaagaagcuauuaaacaaaacuaagcguaugaguuaacauauuauacuguaaaugcuaaaaaucgaagaugaagaaaaucugaaaacccauaagagagggaaaagauauuacugacuucuuaaaaucaacaaaguaagccaggcguggugguucacaucuguaaucccaggacuuugggaagccaaggcaggaggaucgcuagagcccaggaguuugagaccauccugagcaacacagugaaacccugucucuacaaaaaauguuaaaauuagccaggugugguggcaucugccuguaucccagcuacucaggaggcuggguugggaggaucacuugagggcaugauugugccacugcacuccagccugggcaacagagcgagacuccaucaagaaaggaaggaaggaaggaaggaaggaaggaaggaaggaaggauaauaccuuccaugugcuaaaagaaaugucuagaaauaauguacagugugccaaccuagaaagacauaucaugcaaacauauccuuuauggaugagaaugaauaaacaaauuuucagacaaauggaaucuaugacagcuaaucacaaacauauucucacuaaaggagauucuaaauauuccucuucaaaacagaaagaaaauggucugaaugaaaaguuuaagauaccaaaaaaaagagcaaagaaauugaaaaaaauacauggguaaaacgaaauaaauauugucuguacaaaacaguaauaauaauguuccaucuauagaacuaaaauacacauauuguagcacuauucacaauagcaauauggaaucaaccaguguucaucaacagaugacuggauaaagaaauguguguguguguguguguguguguguguguguguguguauauacacaaauuggaauacuguucagccauaagaaauaaugaaaucauguaaaaucuaauuguuaucuacuuaaauuuuugauaauuaauacucuuuaagaaccaacuauuauuagcaagugacaaaauaaauuaggcaauaacaagcaaacauuaaaaaggaaaacaaaaauuaguugaucauaauuaauuuaaaugaauauuucuagggaggguggaguaguuaguagcauaccaacucucacgcuggaaacaaccagaaaagacaaaaugacauaaaaggacuaaacgggcuaagauucuuaaaagaaaacugcugaaagugaacugauaaaguacaacugacaucugccgaucugggcauaagcaaaagacuaagaugcugucuuaacccaggcagaggccuguugcuaagguacagaaaagccagcuuacuuuugagaggucucaaagagcugaagaaacaaaauugaaaaccugaaaaaccuuauauacuuggccaguuuccuuucauuuagcucagucucuaacuggaaucagauaaucagcccaacauacccccaauuucucuccagcagagaaaagacaacaucaucgggaagcuccaagauuuuucuuauuacaaugcacaggauuuaauuuuaaaaauuacagggcacaccaaaggauaacaacaaaugcccaaacagcaaaauaaaaaagaaaaaguaaaaagaaagaaaaucaaauagugguugccagaagcugcaggaagaagggaaugggauguuauuuuuuaauggguacagaguuuccauuuugcaagaugaaaagaguucuuggauggugaguucuuggagaagaaagauggugguuaugguugcauaacaaugugaacauacuuaaugcuauagaacuggacacuuaaauaugauuaaggugguaaauuuuauguuacaaguauuuuaccauaguuuuaaaaaagaaacgauagaaauaaaccaacagaugagacauauauugaaauaaacagagaauagcuauaaaauaucaaugacgaauauauauuuaagaggugaaaaaugagauuuuuaaaagaggagaaaacuuaaccacagaauuggacucuuaaguaaucaaauggaaacuucaaaaugaaaaauacaugauucauuuaaaguuaagaauucaguagauagauuuaaagcaaauuagacacaucacagccaggauuagauaacagaucaguaaaaaauauccacacugaacacagagaaaaacaaguggaagauacauacuuauggaaaacaaugaaaagucacuuaaaugaacacacuucaguggguaugagucuacaggaaucauauagaauuacaguuauuuauuaauuuuuucaguuuauaugauaagauuaaauauuauuucauucauccaacuauugaacucauauuaugugcaaaaccauauacugggcacuacaguuacaaagauauuuaagacccaaucccuccucaauacacuccuagucacaggggacaaacagguaauguuuaugcccuuacuaagaauuuagccaacagacuugggguggagagaagagauucauuuugaguacaggaaguagccaaaagcauggggugggauugaaagagcacaaaauauagaugaaguuaaauuauuucaauauaucuggaguauaucauauaguaaugacaguaagaugaaauuagcagguauagauuggcagaaaccagauaauuauuugccaugugaagacaagagaauguucugaagaauagaaaaacaacaaaugccauaauaucccuauaauguucuggaaggugcaugguguuucacaaacacuaugccuucuaaguguccugccguuuaaaaaaguuugaaaaauauucccuaauaagacagucuaaacaugacauaacacucaggauccuucauaaagggauccaaaucuuuuacaauuucaucugucugaguucaauaagauguugccacaccagucaguuuacuaaaaauauacccuaacauuccuacuuccaugacuugcacaagccguuuauuccaccuguauugucuacuccaguucacugucuaguaaacuuuuaaacaguucaacaguuuuucccuaaugccuuucuaaaggucucucucugggaaaaauuaguaacucucuccaucaugcucccauaugauuuguucauucaaaaaauaauuuuugcuaggcgcaguggcucacgcccguaaucccagaacuuugggaggcugaggcggguggaccaccugaggucaggaguucgaaaucagccuggccaacaaggcgaaaacccgucucuaggaaaauacaaaaauuagccaggcguggugguacacaccuauagucccagcuacuagggaggcucaggcaggagaaucgcuugaacucgggaggcagagguugcagugagccaagauugugccacugcacuccagccugggugauacagugagacuccaucucaaaaaacaaaaauaauauuauuaauuuugagugccuuauaugugccaggcauuguucucggcacuuggaaugcaacaguuccaagucagugaacaaaaaagacaaggucucugucucuguggagcauauaguugaaacauuugaaaaagguaagagcauggaaaaaggaaaagaagaguacauguauuuuacaaaagcuccccagguuaaucuauuaugcccuccuccaaccgaaccaacucagauugagaaguacaguacuagaaagcauuacaacaaacuuguaaugaaagucaauguuuagaacauaacaagaggaauacauaaggcacauuauauuaucuuauauaaacucuuacuugucuuuuccucuaauugauuaacuuuaucucuggauuccucuagcagaaauguuaaaucuuucauuuuauuuucuuucucagugauuuggaucaauaguagugauaccuaaaauauuuaaauaauacauuaucaauaugaaaauuuaaauaugacaccuuaacauuuauaauaccuacaauuauuuuauguacuugucuacaugcuuuucagcugguccacuuaacccucccacccuggucucuacucccuggcagccaauguagucagagaacuggcccuauuaucuuuguaagagacagugucauaucaaauugaaaaaggcaaucucuaaacaucgguauuccaggcacagggauggguggggguauauauaauggaaaagucaacauacauaaugguaagauucagucugucuuugcuauccugcccaauucagcuccagaaugccaucagccaaguuuauauccacaagcaagaauuuagaaacccccagcaaaaaaaguguuacaaauaaugacauuuaggaguccucagcaaaaacacuagcuggccaugccaucauuuuacaaggaagcccaacaaucuguaagcucugcccaugcaccuagaacuccaaaaagcguuucaguacuucacucuauuuuugugguuuuuauuauccucucuguacugugaauuaauuuuuuaaauuauuaaguagauauccuuguuaaccauauuagaagauaucuuguggcaaaucagacaagaaaaacugcaaauauagugagaaauagaagaggauucuauuauauauauugcuuuccauuugggaagcagaagacuugaaacugauagagauggcauaauaauaaucugaaacauucuugugaaugccaaaggauauagaguuaacauuuucaagucuuccacuauaugacaugaauauaaaaaacaucugugucuuguuuucuuaggcuaaaaaagaaaaaagaaagaugcaacagaauauuuuaguuccucuucauugauauuaugaauagcacauuucaaaacaaacugcaaaauguaaguugaguagucaaugaucaucuauacauuucaugaaguuuuugucugaacaaaaguucucacaaaauaauauauuuugaggcaauauccuauuacccacugauauaaauauuauagaagaauaauugauuaaaacccaaaaaaagcuagagugaguacauauuugagucaaugaaaauuaagugagucuaaaggcuaaauauuaauauauguauaauauuaaaauucucucauaggaauuuaucauacuuucaguaaauauaaacuucuuuugaaauuuuaaguuuuuaaugaauuagcaaauauaaagaauacaaagaguugguuuuuuaaaaaaccugcuuuuccuugucauuuauuuccuucuuguauucuuguucaagguguuggauuuuuucauaaucuuccuuuacuuuaaaaauaaaacaaauauacuguaaugucauaacauaauuuuauaacauuucuauuacaaacaaaauuuaaaguuuauuucaccucuuuauuuaucucuaaauuauauuaaacucuaaaaguuuguaaugagcuaauauugcuguuuucuuccuuucuguuuaguaaaauaguaaauauaaauaauaucaguuauaauaaccuaaaauucuauaauucuuauauauaaaacuuuauucucuaaaacacacuaaucugaaacaacagguuuuaaauauguauaauaugauacauauacaauuauuuuaacaugcauacuauaccaagauauguaaaaagagaccaaaucacauuucuaaaaaaaaaauaaaauuaguuugauuucaugaaagauguaguuuuaaaacccaaaauuauuuuuaacaaauauuaauucccugccacauuccacaagauuuagaggggcuuacagaaauaaauaaaauagaaaauaguucagagcaucaggcuaaagagaugaagacauuaacggaaucugauaaaaauauaaauagcaaaacaguaauauaaaaauuaaguaagaucccuauaccuacacuuaaaaugcauuuccagucuggaauucucagcuugcacacgaaguuccucaaaagcuguuaucauuuucugaaauauaaaguuuuaagaaucauacuuaaauuuuuuuaaauagcuuucuucaaacuaugaaaauauuaccaaauuuguaucaugugaucauuaaauuuaaaaccacacaauuuggaauaacuaaaacacuguaauuugaauuacuuacuaaaaauguauuaagagggccuuauguuaguuucccagaugcuuaaaugcacuggcaacauguuauacaauacaaaauagcagcaaauggauuguugguacaccagccauuuacuuaauagcauguaucaaaaucuguaauuuuguauuuauuugugcuuauuuauuuacgucuucuccacuaaugugaggccucuccccaugaauccaaaguuacacuuccaucagcuggcagcauguguucauucggcauucaacaaaucuugcuuuguaaaaucagguuaauuaauuaauuaauuacugagugccuauuaugugccaggaacuguuuuagguaauaggaauagaagacaaagucucggccgggcgcgggggcucacgccucuaaucccagaacuuugggaggccgaggcgggcggaucacgagaucaggagauggacaccauccuggcuaacacggugaaaccccgucuccacuaaaaauacaaaaaaucagccgggcguaguggcuguccccuguagucccagcuacuccggaggcugaggcaggagaauggcugaacccgagaggcggagcuugcagugagccgagguugcgccacugcacuccagccugggcgacagagccagacugucucaaaaaaaaaaaaaaaaaaagaagacaaagucucuacccuacuggaccuuacaauaaaguguaaaaaagaauacaaauacacacacacacacacacacacacacacauaucaaauacaugccaugcagcuuuaugugcucuugagaaaaguuaaaugagauggauauauauggaauaaucaaauagaaauuuuagauaaaguauuaaggggagaauaacaaaaaagcagaaugaaguuuagaaaugugcauaagaucuuagacauaaaaguucugcaaaggguacaaauucaaagaaccaccaucagaaagagcuuggcaaauuugagaaacauaaaagagugacuacagcagaaaagcaaaguggacaaugacaggagaugagaaaacaaagguaaacagaagccagacacagaugaauaauacuuuauauguuuucaaauuaaugguuaugugucacaaugugcugauuucugacaaaaggcaguaaauauuugauaaauuaagugaugucacuaacauguaaaucaaaaagcuccuacauaacauuaaugcucauaguacagaaccuuaggaauuuuauuagugauacaauaauauaucaacaaauaaauaauaaucuuuuuaguaagaauaguuguccauaucuuuguagcaaucgcucuaauuugcucagaaauuccuauguuuaaaauacucagauuucauuaacacucaccucaauguuauuauuuagauccauauaaacuugccugguuucuucccguucauauucaucuauuguuaauauaaaaauuucaagauuaaauuuuaaaauaagaugucaacaagacaauacucaaaaugccuccagaaaacauuaaaauauuuaaaauucuguguuaaugaugaacauuggguuaucuaaaucauuacugggucuuuuuaaguugcaucaaaagcuguuuggguucagucuguugugaagaagcuuagaagucacugcuccauccuaacgacagguaaaaagcugaacaaacuaaaaaauuaauaacucuucucagauccuuaagagaaguaaagucgcagggcaaacuacuaccccaaaauuggagagacaggcaaacacagagagaauuacaacuuaccagggcagaaacccauaagcagaaaacucugugggaaccagagucagggaaagaaaaccugaacuauaauugacacauugcuggaaauucaguguaaacaaaucugagagauacacuauguggaggcugggugugguggcucacgccuguaauccuagcacuuugggaggcagagguuggcagguugcuugaugccaggaguucaagaccacccuggccaaugugguaaaaccccaucucuacuaaaaauacaaaaauucuccaagcauaguaccacaugccuauaaucccagcuacucagaaggcugaaacaugagaaucgcuugaacccagaaggcagaggucgcagugagcugggcgacagagugagacucuaucucaaaaaauaaaaauaaaaaaaccucuguggagacccagucaucagagaggccccagauucuugugaguuuaaccuucuggagcucuaccagguuucucacaaugaacauaggaaaaacauccccuugugcuucuaacaggaaaagccguuuugaacuauaccaauaugucccguucuuaacaaggccuccuuugggagagcaaaaucugcugggaauuugucagagccuaacuaaccugggggaagggaaauacccaauuccagacagcucuagccuuccaugugaaguaaggaaaauauccaacuccaucccccucuagccauccagauggaaaaugggaaauucccaacugcagcccacucuaccaccuugucccaucuaaggaggagagggaugcaagggcugaggaguauuuaugaaguucauuaucuggaggcaaaaauuugcuaaaaaacugagaccuaaccauaggucuauagaauacuccucccccuauacuuuaccagcacauuacaacaauuccuuuacccaguacaucauguguagcuauccaaaacaauaaaaauacaagcauacuaaaagcaaaaaauacacuuugacaagacaagcauaagaaccagacucugauacaguuaaggaugucagaauuaucccagaccaguaauuuagaacaacuaugauugauauacuaagggcucuaguacauaaaguagacaucacgcaagaauagauaagcaauuuaaagagauaggugaaaauucuaagaaugacucaaaacaaaaaugcuacauaucaaaaccacuguaacagaaaugaagggcuugugggugugggggcucauucccauaaucccagccacucagaaggcucaggcaagaugauuacuugaggccaggaguuggagaccagccuagacaacauagaaagacgcugucucuaaaaaaaauaaaacgaagaaaugaggggcuuauuaguagacuagacacagcugaggaaaguaaucuuugaaguugaagauauuucaacagaaaccucaaaaacugaaaggcaaagagaaaaaagacuagaaagaacagaacagaauauccaagaacugugagacaacuacaaaaaguauaaugggaauaccagaaggagaagaaagagaaaaaggaacauaaaauauuuguaacaauaaugacuaagaauuuucccuaaauuaauuucagacaccaagucacagauccagaaagcucagagaacagaaagcaggauaaaugccaaagacacuacaccuaugcauauuacauucaaacuacaaaaaaucaaagauaaagcuagaggaaaaaaacauuuuaccuacagaggagcaaaaagaaagauucuaucugacuccuccucagaaaccacgcaggcaagaauagaauggaguaaaauauuuaaaaugcugagagaaaaaaccagcaacacagaauucuguaauuugagaaacuauccuucaaaagugaagaaauaaauacuuucuuugacaaaaguugacagaauguguugccagcagaccugccuuccaagaaauguuaaaagaaauuauuuaaagagaaagaaaaugauuuauguaagaaauucagaucucuauaaagaaaaaaaagagcaacagcuggucucaguggcucacaccuguaauuccagugcuuugggaggccaaagugggaggaucacuugaggccagaaguucaaaaccagccuggauaacauagcaagaccccaucucugccaaaaaaaaaaaaaaagaaaaagaaagaaaaaaaagagcaucaacgcagaaauaagugaaggcuaaauaacuuuuauuuuucucauucuuaauugaucuaacauauaaguuugucaaaaauaguaauaccaauaaugggccaggcgcaguggcucacaccuguaaucccagcacuuugggaggccaaggcaguuggaucacuugaggucaggaguucaagaccagucuggccaacauggcgaaaauccaucucuacuaaacauacaaaaauuagcauauuacuaaacauaaaaaaauuggcacacgccuguaauaccagcuacucgggaggcugaggcaggagaaucacuugaacccaggaggcggagguugcagugagccaggaucaugccacugcacuccagccugggcaacagaaugagacucugccucaaaaaacaaaaaacagacaaacaaacaaaaaaauagcaacaauguauuagauuauaaaugcuuauuuaugcuuuauauaaaagaaauuaaugacagcaaugauacaaaagacgggaggaggccagccgggccugguggcucaagcccauaaucucagcacuuugggagguggaggagggugaaucacuugaggucaagaguucaagaccagccuggccaacaugacaaaaccccgucacuacugaaaauacaaaaauuagccgggcuugguggugggcaccuguaaucucagcuacucaggaggcugaagcacgagaaucacuugaucccggaagguggagguuguggugaaccgagauggcaccacugcacuccaaucugggcaauaaaacaagacucuguauccaaaaaaaaaaagaaaaaaaaaagaugggaggaaagaauuauaagguacucacuguaaccuugaagcaguagaggguuauuugaaagucgacuuggauuacuguaaauauauauugcaaacucuagugaaaucacuuuaaaaaguaaaaauagaaguauaacuaauauucuaagaaaggagagaaacuggaaucacauaaaaugcucaauuaaaaccacaaauagcauaaaaagaguaaaagacaaaaauaggaacaaagaacaggacaacaaauagaaaaacaguaauaaaugugguagauaauaauccaacuauaucaauaaucacuuugaaugacaauagucuaaaugaccaacuaagagauugucagaguggaucaaaaaacaauacccaacuacaugcugucuauaagaaacucacuuuaaauguaaaaucacaucuagaauaaaaguaaauggauaaagauacaccauauuaacacuaaucacaagaaagcauguuaacacuaaucaaaagaaaauuaaaaacuucuacucuacaaaagagaaugucaagagaaugagaauacaagccacagacugggagaaaaugucugcaaaagaaacaucugaugaaggacuguuaucuauaauauacaaagacucaaauauuauuaagucuuuucucuuauuguugauuaaaauucaacauuaagaaaacaagcaauuugauuaaaaaaugggccaaagaccuuaacagacaccuuacaaaaggagacauauggauggcaaauaaucauauaaaaagaguagcuauauuaauuucagacacagccaacuucaaagcaaggaaaguugucagauauaaagagggccauuucaaaaugcuuuuagagcugggcacaguggcucaugcccguaaucccaguacuuugagaggaugaggauggaggaucacuugagcccaagaguucgagaccacccuaggcaacguagcaaaccccuucucuacaaaaaauagaaaaauuagccaggaguggugauacacaccuauaguccccacuacucaagaggcugagguaagaagaucgcuugagcccaggauuucaaggcugcagugaacuaugaucacaucauugcacugcagucuggguaacagaccaagacccugucucaaaaaauaaauaaauaaauaaaaauaaaaugcuuuugggucauuucuccaaggagauauaacaauuuuuaacauguauaggccuaauaauauggugucaaaauacgugaagcaaaaacugguagaaccgcaaagagaaauaaauuaauccacuauuauaguugaagauuucaacaucucuaucagaaauggacagacccagcaggcagaaaaucaguaagacauguauguugagugucccuuauccaaaauguuugggaccaggacaauuaauauaucagauuucagauuucuuuuuagauuuuggaauauuugcauuguguuuaccaguugagcauccccaaucugaaaauccaaaaucugaaaugcuccaaugagcauuuccuuugagcaucauuuuggcacucaauuggauuuuggaguauuuuagauuugggauuuuuggauuagggcugcuuaaccuguaguuggauucaauaaaaccaucaaucaccuugacauuuacagacugcuuaauccaacaauaacagaaugcauagucuucugaagcucacauggaauauucaucaagauagaccauauucugggccauaagacacaccuuaacaaauuuaaaagauuauaaauuguacaguaucugcucucagaucacaauggaauuaaaccagaaauaaauaauagaaagauaccuggaaaaucacaaaaugcuuggagaauaaccaagacacuucuaaauaccaccugagucaaagaagaaaucucaagagaaauucaaaaacauuuugaacuaaaugaaaauuaaaacacauauuaucaaaaucugugcgauacaggaaaaacugagagggaaauuuauagcauugaaugcauaaauuggaaaagacaaucugaaaucaaucaucuaaguuuccacuguaggcaacuagaaagagaagagcaaauuaaauccaaaguaagaaggagaaaagaaguaauaaaaauuagaguaaaaaccaugaaaguggaaacagaaaaucaauauuuuaaaaaaucaaugaaaccaaaagcugguuauuugaaaagaucaauaaaaucaauaaauucuagccaggcuaagaaaaagagagagaggauucaaauuacuaauccauaaaugaaaaaggagacaucacuacaaaccucauggauguuaaaaugaagaaauauuaugaacaauucuaugcccacagguuugcuaaccuaaauggaauggaccaacugucaaaagacacaacugccaaaacucacagaauuaaaagcaggcaaucugaauaagccuauaucuauuaaagaaauuaagucaauaauuaauaacccuccagaacagaaagcaccaggccugccagcuucacuggugaauucuacaaacauuuaaggaagaaacuauaccaauucucuacuaucucuuucagaagauagaagcagagggaauauuuucuagcaguacccuaauaccaaaaccagacaaagacauuauaagaaaauuacagacaaauaucucucaugaacauagaugcaaaaauacucaacaaaacauuagcaaaucaaauccaacaauauauaaaaggagccugacacaguggcccacaccuauaaucccaauuccagcuacucaggagacugaagugaaaggauugcuugaggccaaaaguuugagacuagccugggcaacauagcaagaucccaucucuaaaaagaaauuuuaaaaauuaucugggugcaguggcacacaccuauagucucagccacugaggaggcugaggcaggaggaucacuuaagcccaggaguucaaggcuauagugaguuaugaucaugccugugaauagccacugcacuccagccugggugacagagcaagauccugucucaaaaaaaaaaaaaaguauaaaaaaaauuauacaacacaaccaaaugggaugcagucaagguaugcaaggcuggcucagcauuuuaaaucaauuauuguaauccaucacauaacaggcuaaaaaauuacaagaucauaucaauagauauagaaaaauuauuugacaaaauccaacacccacucaugauaaaaacuuuuaguaaacuaggaauagaagggaacuugcucaaucuaguaaagaauaucuacagaaaccuauagcuaauaucauacuuaauggugagaaacuagaagcuuucccacuaagaucaggaacaaggcaaggauguccccucucaccauucuuuuucaacauuguacuuaaaguuuuaauuaauacaauaaaacaaaaaaaggaaacaaauggaaucagauugagaaaaaagaaauaaaaacuacuuuauucacagauaacauaacugucuauacagagaauuugaaagaauuaacaaaaaaaaauccuggaacuaauaagcaauuacagcaagguuacacgauacaagauuaauauacuauacaaacgucaaucauuuuccuauacaccagcaaugaauaagcggaauuugaaauugaaaacacaauaccauuuacauuaguauacaaaaaaaaugaaauacuuagguacaaaucuaacaaaacaugcaagaucuauaugaggaaaacuauaaaauuuugaugaaaacaaucaaauaauaauuaaaucaauagagaaagauuccaugaucauagauaggaagauucaauauugucaagaugucaauccuucccaacuugaucuacagauucaaugcaaucccaauaaaaaucucagcaaguuauauuguggauaucuacaaacugauucuaaaguuuauauggugaggcaaaagacucagaagagcgaacacgauauuaaaggagaagaacaaaguuggagaacugauacuauucaaauucaagacuuacuauaaagcuacaguaaucaacauagugagggauuugugggggaaaaggacaaagaaaucaagggaacaaaauagagaguccagaaacagacccaauauauauagucaacugaucuuugacaaaggaguaacaaauagacccaaacaaauauagucaacugauauuugacaaaggaguaacagcuauaaaauagagaaaagauggucuuuucaacaaaugaugcugaaacaaguggacaucugcaugcaaaaaaaaaaaaagaaucuggacacagaucuuacacccuuaacaaaaauuaacucaaaauuuaucauagaccuaaauguaaaauacaaaccauaaaacuccaagauaaauaggagaaaaccuggaugaucuuggguaucacgaugacuuuuuuuuuuuagauacaauccaugaaagaaagaaauaaugagcuggacuucauuaaaauuaaaaacuucugcucuccaaaagauaaugucaagagaaugagaauacaagccgcagacugggagaaaaugucugcaaaagaaacaucugauaaaggacuguuuucuauaauauacaaagacucaaaauuguuaagucuuuuuucuuauuguugauuaaaacucaacaauaagaaaacaugcaaccugauuaaaaaaugggacaaagaccuuaacagacaccuuaccaaaggagacauacagauggcaaauaaucacaugaaaagauucccaucauaugucaucagagaaaugcaauuuagaacaacaaagagauaucaauacauaccccuauucgaauggccaaaauccagaacuuugacaacaccaaaugcuggugagaguauagaacaacagaaacucucauucacugcuggcggaaauaaaaaauuguacacccacuuuggaagacaguuuggcaauuucuuacaaaacuaaacauacuuuuaccaugugauccaggaauugugcuccuugguauuuacucaaaggaguuuaaaauguccacacaaaagccugcacauggauauuuauagcagcuuuauucauaacugccaaaacuuggaagcaaccaagauguccuuuaguaagugaauggauaaauaagcugugguaugugcaaacaaugaauggaauauuauucagugcuuaaaaaaugagcuaucaagugaugaaaagacauggaggaaacuugaaugcauauuacuaagugaaagaagccaauaugaaaagccuacguacuguaggauucgaacuacauaacauucuggaaaaggcaaaauuauggagacaguuaaaagaucagugguuaccagaguaggguguagagaaucaauaggcagaacacagaauuuuagggcaaugaaacuauucuguauuauacuauaauggcggacauauuuguccaaauccauagaguguacaacaccaagagugaacacuaauguaaacuaugaacuuuggacaauuaugaugugccuauguagguucaucaauuguaacaaacaugccacucuggugaguuauguugauaaucggagaggcuauagaugcauggggcaaaagcuuugcaaacuggacucugcauaaaacacuacccaagucccagaacuauccuugaguacagcauacaugaaauagacccagggcagcacagcaaaggcauugaaaauugaacugauauuggaacacccacaaugaaaaggcaagacagaaccuauucuaaaccuaagugagcugacugccuguuagaaaauaaacaaauaaacauucucuaggaaaucugaagaggacucagauucucacaacauaauccaggauauaauacagaauugcugaacauucaaugaacuaggaaaauuuaaccauucuaagucucaaauuauuaauuauuaucuaagauagcugaugagauaaccaauaaaacuaggaucuauggcaaaaaaaaaaucacagaaauggaccccaggguauugcagacguuggcauuauuggauacaacuauguuuauuauguucauacagauaaaaaguagagcuuuaaaaagucagcaaagaacuuaaaauucuggaaagugacacuacaaauuuuuaaagaacuagcuaauacucaaccaguaaauacaauaacaaauuaagacaccaacugauaaauuuuaaaacagacaagauagcauuaggagauauaccuaaugcuaaaugacgaguuaaugggugcagcacaccagcauggcacauguauacauauguaacuaaccugcacauugugcacauguacccuaaaacuuaaaguauaauaauaauaaaauaaaaauaaaauaaaacagacaagaauuaacuaaauagaaaaucaguaaacuggaagagagguuagaagaaauuaugugggccagggcaguggcugacaccuauaaucccaacauuuugggaggccaaggugggaagaucacuugagcccaggaguuugagacuauccugggcaacauggcgaaacccugucucuaaaaaaauacaaaaauuagacagcccugguggugugcagcuguagucccagcuacuugggaaacugagguaggaagauugcuugagcuugggaugcggggguuauggugagccaagauggaaccacugcacuccagccugggcaacagugugagaccaccccaccccccaucaaaaaaagaaaagaaagaaagaaaaaaguauccugaguggaguacagugagaaaaaagaugaaaaauacagagucagaaauacagaacaguggccucauuauugugaccugaaaagauugaacaggcucucaucucugggacuuugcacuuaacugcuuccucugccugaaauauucuuuccuaaaauagauggcccacucccuuauucaggucucuacccaaugucacuuaaccagaaaaaacuucccaaucacccugucccaaaauauucucuccuuaagcaguuaucaccuaacauauauuuuauuuauucauuaaugaucuguauccucuccccucacuagacuguauacucuuuuuuuuuuuuuaaguucugggauacaugugcagaauguguagcuuuguuacauagcuauacaugugccauggugguuugcugcaccuaucaacccaucaucuagguuuuaagccccaccugcauuagguauuuguccuaaugcucucccucccccugccccccaccccccaacaggcccgggugugugauguuccccucccuguguccauguguucgcauuguucaacucccacuuaugagugagaacauuugguguuugguuuucuguuccuguauuaguuugcugagaaugaugguuuccagcuucauccaugucccugcaaaggacaugaacucauucuuuuacagaaaaaaaaagaaacccauucaaaaagucggcaaaggcuauaaccagacacuucucaaaagaagacauuuaugccaccaacaaacaugugaaaaaaagcucaucaucacuggucauuagagaaaugcaaauccagaccacaaugagauaccaucucacgccaguuagaauggcaauuauuaaaaugccaggaaacaacagaugcuggugaggcuguggagaaauaggaacuuuuuuuuuuugagacgggcucuugcucuguugccaggcuggagugcaguggcaugaucucagcucacugcaaccuccgccucccggguucaagcgauuccccugccucaaccuccugaguagcugggacuacaggcgcgugccaucaugcccagcuaauuuuuuuguauuuuaguagagaugggguuucaccauguuggccaggcuggucuugaucucuugaccucgugaucugccugcuucggccucccaaagugcugggacuacaggcgugagcccugugccuggccuaggaacacuuuuacacuauuggugggaguguaaauuaguucaaccauuguggaagacaguguggugauuccucaaggaaauagaaccagaaauaccauuugacccagcaaucccauuacuagguguauacccaaaggauuauaaaucauucuacuauaaagacacaugcacacguauguuuauugcagcacuauuuacaacagcaaagacuuggaaccaacccaaaugcccaucaaugacagacuggauaaagaaaauguggcacauauacaccauggaauauacacucuuguaagaguagagacuuuguucacugcuguuuuucaucagcaucuagaagauuucaugacauagcaggcacuaaaaaaauauugaaugaaugaauaaaagaaagaaaaaagcacaauaacaaaaagacuggucaacaacuuaaggcaagaaucugcauagaguuuacacuaacaauaaagcaagugucaagacuuuaaaaaaaaaacuuucuacaugucacaucaagacauaccucaacuuuaguuuauuaaagagaccaccuugaaaaauguuggguucucuaaaccuuccucaccaucugauuucuaacuuagcugaaaacuaaauguaagaaagaacuaucgcccagcgcaguggcucacgccuguaaucccagcacuuugggaggccgaggcagguggucaagagaucgagaccauccuggccaacaugguaaaaucccaucucuacuaaaaauacaaaaaauuagccagcgugguggugggcaccuguagucacagcuacucaggaggcugaggcaggagaaucacuugaacccuaggggugggagguugcagugagccgagauugugccacugcacuccagccuggccacagaguuagacuucgucuaaaaaaaaaaaaaaaacaaagaacaaaaaagaacuaucagacuugucucucuaacccaaguuauuuucugcaagacagccaauguacuauccuucuacccuaucacuguacuuuucaccacuuuuuauaucuaggcagaaaaauuaaucuugaauguugaguacauaggauauaguagaggagcugguagugguaugguacauucuggaagauacauagaguuuugaaaagcaagguaauacaggcagggacuaagaauaaaaauccuggccgggugcaguggcucaugccuguaaucccagcauuuugagaggcugaggugggaggaucaccugaggucaggaggucgagaccagccuggcuaacauggugaaacccccuuucuacuaaaaauacaaaaaauuagcugggugugguggcacaugccuguaaucccagcuacucgcgaggcugaggaaggagaauugccugaacccaggaggcagcgguugcagagagccgagaucacaccauuacacuccagguugggcaacaagagugaaaccacaucucaaaaaaaaaaaaaaaaagaauaaaaaaaccuaacagucaauguuagaaauaacgacaauaauaauaauaaaauacccaacauuuauugagcacuuugcauuguucuaagcauauuuauuaacauuuaauuuucaggacaauacuaagaggcauuuaauuaauaaacagagugacagacagacuacauaauuuacucaaauuauucaagcucccuagguggacagaaacugaaagucuaaauuugagcaccggcuaucuaauccuuaagcccaagcuguuaaguaguaagcuguaugauacaaauuaaaauuuuuagcuaagaaaaauagagaauaucccgaaaaagcagguagacaguauuucccaauggauucuuggcagaaacaaaguaaagccagggucaaauuauggcaaaaauaaagaauuauauuuuauaaucacacacuuauuuuucaucaaaaugggaaaaaauccuacuuuauaauuuaaaaaaaugaaaacaugcuuuaaaauuuuuaaacuguucuuucacauacacaacacaaccauauuagaauauuuuaaaagaauuuuucuuuaggaaaaauuugagaauucuauuuagauugaaaauaaacauugcaccacuauucauaaauacaauggcuuuagcaaagccucuacugguauuuucuauuacgagcauggcuauguaucuuauucucgauugaauuuccuaguuguuccagacagagguuagucucaaaaucauaccuuacuugaaaccaggauuaacuauaaauaucaagaauauacccuuugacauauauuaccuuucaaaaaauuuugagcuuucaaaagucaaagaacugugauucuccuuauuacuuauauaaaaauagucugaggcacauauaauuuguucaaaucaaauugguuccaaaaauuaaaaggacaauuucuuucccucuccaccucuaccaguaaaauaaauugauaaaaucacauaaaacaagaaagauauuuacauuucuuugucuuuucugcagaucuagcacagguuucuuugaguagauuacauaaaugccuuguggcauuauuccugaaacaaaggaaagaguuugccuguguguaaucugaucucaaagcaaaaucacaauauauaaguuaugaaauauauuguuacaauuuuuaagaaauuuuuaaaauauuauaaucuuuggcauacaucacauuauucauaaaugacuauaugaagaaacaguggguugacuguacuacuagcaaagaugauuuaguaauugccucccuuuaaaaguaaaaguucuaguaacuggccacuaaaauaaauaaacaaauaaaagugacagcuccuuaacaaguuucuacccaaguugcuaucaauaaacuuucaguaaacaggucuagauuugccuaaggaaaaauaaugagaauagguugggccauucauuaacaaauuaauauaugucuaaccuucaaaacacaaaauaagguaacuuucugauuaggcauucauuaugugaaugaugagaccuguggcuaucuugaaguuacuaacacauauggcaguuagacuuaauuuucuaacuuaccauuuuucuguagaaauaaacuguuacauuuucaaaaacaggaauuugaguaagaauuaacuuggaacuaaguuaaguccuguuuuauaaguacuguacucaagacagcagugaaacagacaacauacauagguaguuguagauacagaauuaucaggcaucuuuuuugacaccaaggaauguuuauuccugaugccugacauuuuaaaaagugaaguuauuagucagugaccacaguuugccaaacacaagaauguacaucuuccuuuuuccauagcacucagauauaauucuacuuauaaauucauaugauauaacguauagaaagugcucaauauguuuuugaaaauuauuuuaguaguaaauuuggaauaaaaaaugugaaaagaacaaauucauuaaauuacuacuuacucuuuuauuaaaucuuuauuuucuuguauuccuucuucuaauuucaaacuuacuuuuucauuuccaaacuaauuuauaaaacagaaaaguucaucccauuuugcuuauuagcaaaaauaaacacgaauauaaucauuaagcaguauuucuuuacuaauacacaauggucuaaaagaauuauuuucuuuccacauaaaaaggaaacauuuuuguaauagcuuaugauuucccuuaagaauauggccuucaucaaucuaaaauaaagaaggcuaaaucaucuccaagaaacauucaacaauauuuuaaugcaauauuaucuucucuaaauauuuuugaaguaauguuuuuuucuuuguccuaauacaaugucacauuuucucaacauuuuuuucacuuuaugcuacagauaaaguuacacaguuucggccgggagcaguggcucacgccuguaaucccagcacuuugggaggccgaggcaggugggucacgaggucuaggaguucaagaccagccugguaaauaugguggcaucccaucucuacuaaaaauauaaaaauuagcugggcgugguggcucaagccugcagucccagcuacuugggaggcugaggcagaagaaucgcuugaaccagggaggcgaagguugcagugagccgagauggugccacugcacuccagccugggugacagagcaagacuaugucucacaaaaauaaauaaaaaaaauaaaguuacacaguuucaaauuuaaaguguuaccuacaacuauuguaaucuaagagaauauauuuacauaaaacaucaauaggaauaaaaauugaaacucuuuauaauaaauuagaaucauuaaaucaauuuuuauauaaagugauuuauuauuucccuaaucauuugcauuaagcguuauacaacuuguccucuaugcucauucuuaaaguuaaaauguauccaguauugauguaacuuuuaaaaagcauuauccuuaaaauauucaucacaaaaacaagaucaauccaauuuaucccaacuaauacucuacuuucaacaguauuaugauuagauuuacuauacuauguuuacaaugcaaaauugugucauacuugcaguuccugaauggcuuuucgcugugcuucaauuaucuuucuguuuucuugcaacuuacuuucuuucugucucaguucagcuucuguacuuacuuuccauuuuuuuaucuuuucagccuccuuauacaguuuugaauacacucugcucaaucccucugaauucuauuaaaauauguuuucaaaaauuaauuguccaaaauucuaauauaaccaaacuacagcugccuacugaaaauauccauauacuaauaguugagaccaaauaucuccucaauuuaagcacuaauagcauacugaaagccacauuaacucuuuuaaacuacuaaggcaauauuaacuacuucauuaaaguuauuggucacuugacuaaauuauaccuugcugaauaaaaugaaauggcuccauaaaaauauuuuaguuagugacagaaucuggcugguuaaaagcuaaaauaaaucauccuauaagaaaucuauaaaucuuaacaauggucuugaaacacuuugauuauacaaacaguuugaagauucacuaaaggacaugaaguuuaaaauauaaugacaagaaaaauaaaagugaagacaagauauaauuuucaucaagucugauuuuuauauagauuuccugccuuuuuaaaauccacauuauauuguaaauaucagagauuuuuagucacaucaauuuuugcugguugacaacuuuuucuuauaaaaauauauaaauaaguucuauauauuuuaaauucugugauaccauaaucacagcaacaaacauacaguaccuuaccaggcuauggaauuucucuucauuuuaaagacacuauaugccauaaauaagaaauauuuuuauaacuaaaaucaaaaguauauagcauguccuacaaauuccuuauacaauaaaccagucaaccagucaauuucgucuauuaauuaaaggcugauuuuguaaaauacucucuugauaauauacuuuucagguauaguacucguuuccccucuucuugauuucaugguuuaaaauuaaauugccucuacauaaauggaacuuucauaacccaaaaaauacagaagcagaaaaaaagguuuuaaaggauauaucuuaaaacguuaaucaaauaauaauccuuuugaagcuucaaaagaaauauacauauagguaauaaguuauauuccaauuacaagaaauuuaauaugaaugggaaaucuucugaccuccaaaucagagucuuuuaguccuuccugauagugacagucagaauuaccaaccuaaaaagauagauguuucuauaagaaaauacuucugauaagagcuucuaaauaauaacaauuaaauacagaagacuaguaaugcaauaacuaaagacuuuuuucgucuucaaauaagcaguucauuaccuaaacagauuauaucuacauguacuaugcuuaacugaccugcucaagcacgggcaagaaauuaacuuuuuguaaagcaggaucugcaagauaaaagacaacagguauuaaauacgccaacaucuuuuucucuuucuuuuuuuuuuucuuuuuucucuuuuuuuuuuuuuuuuuuuuugagagagagaggacaucuggcacuauugccuagacuagagggcagugacccaucauggcucacugcagccucaaagccuccaucucuagggcucaaaugauccucccaccuuagccucccaaguagcugggacugcaggcgcaugccaccauguccagcuaguuuuggggguggugggguuuguuugcugguuuuuuuuuuuuuuuuuuuuuuuuguacagacagggucuccuuauguugcccaggcuggucucaaacaccuggccucaagugaucccccuccaucagccucccucccacagugcuggaauuacagguguuagccaccguguccagccuuauuuuuuauauuaaguauuauaucuagcuuuugugucaauuauacuuauauaauacuuauguuacauuuucaauaacuaucgauguauguaacacaauguuucuauauaagcugauacacugcuuuuccaugcuccuaccugaaucaauguuuuccccauuuuuggagagauuagucuuugcaaauggaaacucaaaaucaucuucaguacauuuguugaaacucuagagacacaaagaaguucuuaaauauucuguuucauaccacucugauauacuaauaguguaauauauacauauguaauauacaucugcuuaaaaagguuacuauaauugcaaauccuuuaauguacauacaguguuuaaaauaucaaaugccuuuucuauauaaacaaagaaaaaauucuaauuagauauuuccacuuguaagaugaagcuaaacuauaaauuacucaauauauggcuuuguagguauucgagaauaauaguaaaucuaacuaguaguauagaacaauauuaguagauuucuucaguuuaugauuucccuugauagaauuaaagauugucuuuauugaauagcauuuaauaauauauuauugccuauagcagccacaagaauuguuuuacagcauauacaaguaaaauauucauugcaucauugcaucuccaauauaaggauccacaugauaaauuuuuuuaauuaauuuuuaaagcucuguuucaccugagaaacuugguauaauuccuccuauccaaugauaacaccauuacauaaaugaauuucccucuuugcccuauccacuaggaagcucagagccaaaucugaagcucagucacaacacgaauuauuauucauauauaggcauuuguccaaauaguccucauuuuucuugauaauuuuccuaauuuuauccuaacauauucuacuaucucguaguaucuguccuauaaguugccacgaaucaaauacggaaagaaggagaauuaaaauaagcacguuccacuauguaugcagaguucuacggcagcagucauuauuuaaaugaaugaugccuacacaauaaugcucacuguucauuuaaagcaaugggauucaaaauucuuggguaaaugagaccauuuauugagaagaaauaauuauaaaacaccaccaggaagaaaguacacuuuucuucauuucccuaaaguuaagaagaguccaauuaagagucacauggaaauuuaccuugaagaaaguggaaucgccucccagggucugagguuucaccgcagacaccugacugcugcuugaucucggugguacgaacaaugcaaagggcuuuugcuuuuccauuuucucuguuacgguuguaaauaucuacugccccgggggggcgggaggggaaggaaaguuuuuuuucaccgagugucaugaauacacuauguauucuuuaaagugauguuuacaaacuaaauggcuaaaaaaaaaggaauccacggggcucucgcuacaguggagcccuacaacgucgcuuaccgcggagugggcaacggaauaaacccucguuuccuucucccuuucgcccuaccgcccgcugccacgcuggccugaaaagaaagcccguucccuucuccugucccauuaaauuccaucacaucgccaggaggaacugucuuaaguuccuggaccacuacccaaaagaaaacagcggagggcugcggcggggaggugcaguagcacaacaucgccccgcucugggcucaguccccaggaaaauaacucggggcaccugcccucaccuuugaagaacuagcgggaaaccguggguucugugcccacgcgaacugcuacauacggucuaugagggcaacagaaagaaccaauggcucccgccucagaaccucagaaaaggcgggaaaucgcucagccugagcggcccggagcgcgugggccccgggcggcuggcaguucaacggcuaaauaa

SEQ ID NO: 192887 - RNA, 49920 nt, Homo sapiens
uuuuugaaacggagucucacucuauugcccaggcuggagugcaguggugugaucucggcucacugcaaccuccgcugcccggguucaagugauucuccuuccucagccuccugaguagcagggauuacaggcacaugccauggugcccggcuaauuuuuguauuuuuugcagagaugggguuucaccaucuuggccaggcuagucucaaacuccugaccuugugauccacccacaucggccucccaaagcgcugggauuacaggcgugagccaccgcgcccagccaggaaugaacuauugaugcgugcagcagccuggaugcaucucaaggaaaugaugcugagugagaaagcagcauaugcagaagggaacauacuguacgauucugcuuccaugacauucuggaaauaacagaauuaugacaguggagaacagaugaguaguugccaaagguuaguaaggggaaggggaugugguuauaaaggggugacaugaaagauccuuguagcaguggcaucaugguaccuucuguauggugaccguggcagugcucacaugagucugugcaugggguaaaauugcauauaauuaaauauaggcacacagaaaugaauacuuguagaaauggugaaaucugaauaagauugguugacuuugucaaugucauucacccaguugugguauuguacuauaguuuuacaagacauuaccauugggggaaacugggggaagaguauauaguaucucucuguguucuuucuuacaguugcaccugaaucuaccauuaucucaaaauucaaaguuuaaaauuaagaaaagauuccucuauuuuauuuuauauuuuauuuuuugagacagagucuugcugucacgcaggcuggagugcaguggcacgauuguggcucacuguaaccuucgccucccagguucaagcaguucuccugcuucagccucccaaguagcugggacuacagguguaugccaccaugcccagcuaauuuuuguauuuuuaguagagacgggguuucaccauguugaccaggcuggucuugaacuccugaccucaggugaucugccugccucagccucccaaagugcugggauugcaggugugagccaccgugcccagcuuucauuuuaaauuuuuauuuuauuuauuuauuucacucuguuggccaggccggagugcaauggcgugaucuuggcucacugcaacuucugccuccuggguucaagagauucuugugccucagccuccugaguagcuaggauuauagguacccgccaccacacccgacuaauuuuuguauuuuuaguagagaugagguuuuaccauuuggccaggcuggucucaaacucccgaccucaggugauccgcccaccuuguccucccaaagugcugggauuacaggcaugagccaucgcgccuggucacaauuuuaauuuuuaauucagcaaauacgaauaaauaaaaccacaucaaaaaauaaaaauaaaaaagaucugcagacucuuuaguaauuuuuuuuuuuuuuugagacagggucucacucuguugcccaggcuggagaguagcagcacaaucauagcucauagcucaccgcagccuugacggcccaggcucaagcgauccucccaccucagccuucuuaguagcugggacuacagguccaugccaccacaaccagcuaauuucuaaauuuuuuuguagagauggggucucccuauguugcccaggcuggucuuaaacucugggccucaaacagucucccaccucggccucccaaagugcuaggauuacaggugugagccacugcacuuggccuccuuaguaauuuuuaagaauuugaagaugaaaacauuugggacuccaugcugaaugcuguauacacauaccccagcugugugguguguaccuggcuauaugauggcacgacuguaugguacacaccucagcuguaugguacauacccccgacuguaugaugcacaccccagcucugugguacacacccugcuguguggcccauacccgggcuauauggcccaguggccaagugaauggacucuagggucagauuuuaaguuugaauauggcucugccuguuauuuuugguauauccauguggagguuauuuaaccuuuuugugccuguuuucuucaguuguaaagugggcuuccuagcagaacccaucugggagggaaagugaagauuaaaugugaucguuaauauaaagcauaguacacaaucaguauucagugaauaucaguuacaauuaaggaaagcaaccugggcuaagggcuaggacaucuggguacuugcaggcugggacaucuggguacuuguccuggcuuuguccuuaacucucagugugaccuuggugagccccuucccugccugggccaccauuucauuuuccgugugugaccaagcuaccauccagugguucucucuauucugauguccugagucagcgcagaaccagggaagaugucaucaaggugacuugcaccuggauuggggacuuuucugcuuccguccacguuuccuggaaaugcaagcucccugagcuccuggaucugaccuaggagaaaggugccuccuugcccgugaggcugccaaggcggagucacuucuuuaggccgugcccugcagguggcaucgguugagaacccggagcaguugggugauagggaggagucugguguuugcagcggggcuuccuccuugguuuuccuucccucugcuccccaggcagcccauuugcuuggugucugugauggguguuuuagagucaggcucucugagcucagcuccuggugcucacacucuguguggcuugggcuccucauguaaccuuggagccgcaguggcccccgucuguaaaaacaggauuguuaagaugcuccuggggcuaucuggaggauucagggagcuaaacccguggggugccagcacagggccaggucuacacucacccagcgauggcuguucugugacucagaacccuuuggaguuuuucugccucagccuauuugggcagguagguuccucuggaugaggaaugccuuuuguccccagcuaguccccugccugaccuagggcacaggcagugagggaaagugcauuuuuuuuuuuuuuuugagacggagucucgcugugucgcccaagcuggagugcaguugcgcaaucucugcucacugcaaccuccaccucacggguucaagcaguucucugccucagccucccgaguagcugggacuacaggugcccgcuaccaugcccagcuaauuuuuguauuuuuaguagagacagaguuucaccauguuggccaggguggucuugaacuccugaccucaugauccacccaccucggccucccaaagugcugggauuauaggcgggagccaccgugcccggcaggaaagugcauucuuuaagagccuuuacgagaguuaauuuaccuugcccucugucaaacuguuggagguagauugguuccuuguucuguauuuaccuagcaaguggcucccaguguuuaccuacccuaacuuccuuauagaaacaggcauuuauugaaugcauauuuucuccacacuguaugcuguucuagggcguucucugugugcugaggaaagguuaagguguggcagaauuuuauuaaggccaagaaaaccgucagggcuucugguugaaaguugcaccaaggcuguggaacucaggugaaacagcagaaugucuuuagucuaaaaggaaaguucuauugagaaggcaaauggaagccaugaccaaaaaggugacuccugagggacaugcucuccucacacacaguggccaucccagcaaagccgcccuucccuccagcaccugccucuguccuaggcacggugcccucugacaggcugcugcccugaggcuggcccagccuauuuguggcuacacccuuccccugacucccuguucuccccagcucaucaccaugggcuuuuuuuuuuuuuuuuuuuuuuuuuuuuuuugagacggagucuugcucugucacccaggcuggagugcaauggcaugcucuuggcucacugcaaccuccaccucccagguucaaguaauuguccugccuuagccucccgaguagcugggauuacagacacacaccaacacgccgggcuaauuuuuguauuuuuaguagaggcgggguuucaccauguuggccaggcuggugucaaacuccugaccucgugaucugcccgccacggccucccaaagugcugggauuacaggcgugagccaccgcgccuggccugggcuucuuuuuuuuuuuuuccaauccugaaggauccaaaaccugaggggagaggaagggacuuuagaaaaaucucagcuccacuccucucuuuccuuaccccugacucagaucagcaguucccagagugucccacaggacacaguacagaaaugggguucugugggcacguguuguccacccucauucauuaauugauuuagaaucaauaaaggguuuuuugguuuauuuuuuguuuugucacccaggcuggagugcagugacacgaccucagcucagugcagccucaaccuccuggguucaagcaauccucccacuucagccuccugaguagcugggacugcaggcacacaccacacacccggcuaauuuuuauauguuuuguagaaacgggauuucgccauguugccuaggcuggugucaaacuccugggcuaaaaugauccuccugccuuggccucccaaagugcugggauuacaggcaugggcuaccaugccuggccagaauuaauaaaguucugagucgaauaaguuugggaaacacuggguuuggaacucagcuaaguugauuuacugggacccucuaagaaggcauuaaggcaggguaguguuucucccaaacgaggcuauccaugggacccauuucugcauguugaacucagcugggagcccgaggagaguuguacaugccugagcucccuucagacucccacagacuuugugcuauggggcaggagggagagaggagugcugaggcugccgggcugcauggaaccccagauagagggaacccgauagcacggucggcaggcuaggggaagucaaggagucccugaagagaaaggggucaccaguugcugacccagccuguaguagccccuaggcacagcgauacugucuuagggcugaaaguuaggaucuuccagauuacucagauucccuuugcccgauggcucugaguggcaguuuucuaaauguccacuggguggcgcuggcuccccaggaggcggcaaaaugaggcgccccuucccuuuccagcaggaauuggccuuuuucuuuacuugaaaauuacagaauuccaugcagauuuuacagccucuguagguaagcuuucacaagguguuuuucugcacuuguccccccuccuugccccgaucgcucugccccucucuuggggggguuucugcuucuguuuaugcccuggugggccacaccacacucccacaagaugaacauuauacaaaagaaaacucaguggaagguuccuucuuuaaacagaaagcacucucuucaucugccaaaugaagugagaaggguaggaaaauuagauuuuauugaaaaaauauauuuaaaacugauguuuuuucaguucugucuuagggcuaguuagcaguguuaugagacacaaacaggaaggagugagguggaaagguauggaagguacugggcauggcagcugaagcuugcaaccccagcacugugggaggccagggugggacaacugcuugaggucaggaguuugagaacagcccgggcaacauagcaagaccccaucuccacagcaaauuaaaaaaaaaaaaaaauuagccacaugugguggcacgugcuuguggucccagcuacuugggagacugaggcaggaggauugcuugaccccaggaguuugagaccagucugggcaacauagcaagaccccgucucuaccacaaaagaaaagaaaaagauggaaggggaaaagagaagaguuaaaaauaaagcagaggaagagcagugagaaaggugaaggaagggaggaaaggaaggaaacggugggagggagggaggaaggaaagggagagagggagggaaggaaagggaggaaggaaagggaggaaagggagggagggaggaaggaagggagggagggaaggagacaggaagggagguagguugguugguccgucgguccgucgguccuagaccaaucagaguuugcauuucauuucagcaacuucccugggagagggaaagauuugugcccaugugaucaagugugagcaacucacuaagcccuaacuuauuucugagucaccauucagagacauugauuuuuucgacuuuugauuuccaacuucaaaacaaaacaaagggacucaagaaaacuuuugaaggugauguguauguuuauuacucuugugcugaugguagcaguaguguauacuuaagucccaacucaccaaauuacauuaugugcaguuuuuaguauaucaauuacaccuuacugaagcuggaaagaaaugauaauaaaaaguuuuugaguucuuauaauuugacagcaaacugagauuuuacucuuauaacuugugauccacugauuccuucagcaagcauuugcugacauuuaccaauuuccugagucuuguugaugaauacuagagaaggauguugaagagcacuaaauagguaaccucaagcagugacguuauaucugaaaaaagugacugagguucacuuuuaaguaggcagcgugcuuugaggccugaaagggcucggguugaaugggcccugccagccauggauccuuauguagaggcugggcaaaaaaaugcuccauuuucccccuuucgccaagaauugaaauagccccuuuuccugcucguuuggccgaguagaagggaaagccuuugaggcuauucauguuuucacugccugguuuucugggucaggauuaggucaugaccguuucauguuuguucauuuggccuugggccccuggggcagguagggucuggccaggggaaagguucuuuuccagauucuuuuuuuuuuuugagauggagucucgcucuguggcccaggcuggagugcaguggcaugaucucagcucacugcaaccuccgccucccagguucaagugauucuccugccucagccuucugaguagcugggaucacaggugcccgccaccacacccggcuaauuuuuauauuuuuaguagagacgggguuucaccauguuggucaggcuagucucaaacuccugaccucaggugaucugcccgccucggccucccaaagugcaggcaugagccaccacgcccagcccuuuuccagauuccuguagccagcaaagaccagcaccaaacguuuguugggcuaauggauggguggaugcaaaugaauguuugcauuugaaugaaaugacugagaacaaaucuuugccugcuuucaaguugcugagcgucccucuacugccuaagaugagggguuuuucuacuuguauguuauuccuugccugucauaacaacaguguuuuuggacaauggugaaaaggagcucccucuuugauuuuuguagauggcaguugaauuccugcaugaacugaauguuccauuuuucaaaguuggaucuggagacacuaauaauuuuccuuaucuggaaaagacagccaaaaaagguaagugucuaauuuuugacuuaaaaucgaagggaguccaaaccuucauauuuuuacuccccucaugguggcccacuuucagcagauuucaugaagacaaauuuuagccucuuuucauuuuuuuaaauagagauagggucucgcuguguuggccagguuggucuugaacuccuggccuaaagcaauccucccaucucgaccucccaaagugcuaggauuacaggcaugagccacugugcccugccagaaaccucuuuucaaucagccuguacuuccauuuuuuguaagcuaauuugaaagaaaaugaauuaagaauaugacaguuuuuauaagacauuuagaaauucuuuuuaagaauuuuuuuuuuuuuuuaauagagacaaggucugucuauguugcccagguuggucuugaacuccuggauucaagugauccuccuacuucagccucccaaaguguugggauuacaggugugagccacugcaccuguccuagaaaauuuuuuaacuaaaauuuauaagaaauuaaggauaugacaguauauauaaaaccuagcuggguaugguggugcauuacuguggccccagcuacucgggaggcugagguaggaggauugcuugaguuugagaccgcagugggacaugaucguguaaagugguuuuacaacaugaacaauuucauuugauccucauaacacuccuaggacugaaacaggucaugauuaugaugcuugauacuuauuucacaggggaggccucugagacucagagacggacaguacucugcccaggcacagcuagaaguggcagcuccacaccucacauucauucacacucuugaaucagcacucauucuacuguacugccaugguauacaaccuauuaaucagauaagauacucauuuuccucuuggcagugugaaauuccucugccucuuuaauucaguuccuuuugcucaagaacacugucggggggcagaggggagcccaccuuuccuguggccgagggcaggaacccaacaagcuccucucuguucccccacaggggcuggcacaguguuuuaagagaugucuguggaguucaguugaaugaugagaccagcaguugggauguguuggggagagucagaaccucuaaagagaaagugcugaugguguuggugcuggauuacucaggucgcccaauggugaucuccagugggaugcagucaauggacaccaugaagcaaguuuaucagaucgugaagccccucaaccccaacuucugcuucuugcaguguaccagcgcauacccgcuccagccugaggacgucaaccugcgggucaucucggugagcaggagggaggggguucccuucuugggccauuuacuauggggaaggcguagucuuuuuuauaaccaaaauucuaacaaacauggcauacuuuauaauuugaacauccuuugacagucuugcuguuaccaaaucaaauucgagcuaagcaguugaggaagcacauacauucuaaagagggugacuguaaaugaaauuuucuuggccaggcgcggugggucaugccuguaaucccagcacuuugggaggucgaggugggcagaucaccugaggucaggaguucgagacuagccuggccaacauggugaaaccccuucuuauuaaaaauauaaaaauuagucaggcauggugaugcgugccuguggucccagcuacucaggaggcugaggcaggagaaucgcuugaauucaggaggcagagguugcagugagccgagauugcaccacugcacucaagccugggugacagagugagacucucagggggaaaaaaaaaaaaaaaaaagucugucugucaacagacauuugggaugauuuuaccuuuuggcuauugugaaugaugcugcuaugaacacuagcguacagauaaauauucaucuuuuuucauacugaguuauaggaggccuucuugaaacuuccuggcuuuuucugcuuuauuugcugacucucuuauuuucuaaugcugagcaucccugaggcucauacuaguuauagugacagccuugauggaaauuacucucucccacgauuuugccuacucagucauuucacagauggugaaauccagucccaagucgggaagccugagaucccacagcagcuugguggcaaagcuggaacuagaaccugggcaugucccccuaggccuuugucucuuacugucucacgccaucucucucaguucuuccuguagcacuggaaauuuaacuuuauucgaaaauauguauguaauuaucauuaaaacuauuauaguaacauuaauggaauucuaucuaucuauccacacauacuagaauccugauauugcaguuguuuuccuuuuauauuuuccuuucaguauaguauuugacauuguuuuccccauaauauaagcuuucuuacauguuguuauacagccauuaacuuaaaaaguuagccuuuuugaaaacugacauuacucucuuuuuaccuaaacuuucugucccucccaauccuguuuuugcuucacuuacagcuuaucuaaaucacguuauuuuuaaaauuuaaaaaugauuucugugaaauauguaaugucgaaaguaaacauccccugcacucccaucccacagagauuccgauaauuaacaguuuaguagacgugaccccagcuauuuuccuuuucaguguaucuccguccccacucaaggugcugucauguccucucucuugacacuacacauugcaggaguuauucugccagccuaucccaucuugggccugcacauaguacagugguuugaauuuucaaacuuguagcaacccgcacuccaucacacacccuuaagccugguuuucaaggccuuugccaccuaacccuccuaaucuuuuguuaaaucccaccugaggccagacaccguggcucaugccaguagucccagcacuuugggaggcugaggcagguggaccgcuugaggccaggagcuugagaccagccuggccaauguggcgaaacccugucucuacuaaaaauacaaaaauuagcugggcgugguggcgggcacccauagucccagcugcucaggaggcugaggcaggagaaucgcuugaacccaggaggcagagguugcagugagcugagaucacgccauugcacuccagccuuggugacagagcaagacucuguuucaaaaagaaauaauaaauaacaauaaaauaauaauacacgcuaccugagucuuucuacuguacucagcuuucuggucacccucaccaacaagacucacccaucuuagagugucuuuuguugcauucagugaauuauagauaacggauuaauuauuuaucauuuucaccaaaggauuguuuugagauugggcuguguauauuauugaugauauuugugcauauagcacacuugcuuucagcagcucaggcuaauuaaaugugacagaugguuuuugaaugagguuagacauucauuuauaguucuguuguuacucuugguguauugugcaaugugaaacauucuuaaaaugcauucuuuagaauaacaguaaccauuuuuagagcauuuacaaugugcugagugcuucucaugcauuuacagcaacacucagcagguauuauuaucaucccuaggaaagagaggcucagagagccucaguaucuugccccuggcugcacagcuagugaguggcuaaaccggggcucaaccagauacgcuucaccuggagaauaugcauaaagcagcaugauauuuaauguuauuuuucuuuuuccauuuuaaaggaauaucagaagcucuuuccugacauucccauaggguauucugggcaugaaacaggcauagcgauaucuguggccgcaguggcucugggggccaagguguuggaacgucacauaacuuuggacaagaccuggaaggggagugaccacucggccucgcuggagccuggagaacuggccgagcuggugcggucagugcgucuuguggagcgugcccugggcuccccaaccaagcagcugcugcccugugagauggccugcaaugagaagguguguccugccggacucuacucgguucugcugccguguguggaaaaaggauaggcuggccugagagggauggucaggaccagcccucccugagccaggcugaugaaaugaucagugaaugugcucccacccgugucagcuucuucaggcuucucuucaguaaugcaugucacucuggccuguagcagcagcaggagacacauguuaucuaacuuuagcaguuucucuggccaccuagggucacauuagagucuuccacuaauucucugaagcccauggccccaguacuccuagacuccagaauauguaacaggagugaggcccuggaauaagucaagucugggcucccuuggagcagguaagcccugagaaacauuuaggcacgguguucccugagguaccagaagagccuguggcauuuccuaagccaggguggcacuggugggaagggcagugagucguugcagaggugggugggugaugaugcagcuauuccuugugcaacagugaccuucagacagaggaacuggugggccuagaagcacugccuggcaugcugacuaucagggcuuccuggaagccguggccuggaccuucuugccuucugagucauagagccaggcaggcauccuggggcugccaggcacacacacaccuaaccuguaggcugucggggucaaggcaaagaccaaacaccaggcaugccugggacuguugucaccuuuuauucuaguggggccuaccugcuuccccaaaucaaagaugcaucuauaccaggaaauuaaaauaaaguaaaaagaaauaguuucuuuauagaggaaacaggagagaauuagaccagaaaccagaguaagauuuauaacagcugagcacuuaauuuggcucucugagcagacaguaaaacauaacaggaugcaugauuaucacuugacauuuuuuccuggcaccacauuccaagcagaauugauuccuuguacucuuacguggaggauauagaguaauaaaacacguaauuuauuugaaagcauuuauagagaagacaaacacuggucaugagcuucagguacccuucauucccucaucugccuguauuaucugccccuuccucgggggcuccuuuucuugccaucugcauaacagccacauucaccaucuuaugaguccuucauauuucuauuuuaccaaacaaaguggcgguaaggugugugcccuggagaacggugugucaggaguuaagaaucucaucccuauguuauguuucaucuuggcugucugcaacccuggccaagucacccacccuguaugggccucaguuuccccauguuuacaaugagauacugagcugaaugguaaccaaaagaaucagaguuugcauguauugagagcauucuauguuccacguacauucuguaauaucaccaauccuuacagucaucugacaggauaaguuuccauuugacagagaaacuaaaacguggccuauaccccacagacugggauuugaaccuggcuccgccuacauagccucagcccuuuccuuugcacuuuguuguaaaggcuccuccucugagucucugaauucaaucuauacugguugaauuccugccauguaugagauauucugagcaguguagggggcaacagagugccugcucccaagguacugccuggggaagacugaucagggaccuugaguguaaaguaaaguagugugcacuaguuacuucugugaagcuggcacugaauguucauuuuguccacagcugggcaagucugugguggccaaagugaaaauuccggaaggcaccauucuaacaauggacaugcucaccgugaaggugggugagcccaaaggcuauccuccugaagacaucuuuaaucuagugggcaagaagguccuggucacuguugaagaggaugacaccaucauggaagaauugguagauaaucauggcaaaaaaaucaagucuuaaaaauaaagugccauucucugaauucucaguucccuugcugaugcugucagguguguuugagugaggcgagggcaggaauggcggucuccagggaccuggcugucauccaccuccaccugcuccuuagacagcagauguuucugggcuaggcccugugucagcccacuggagacagaaaaagauccagugaugcaaucucuccuucaaguuggccagcuuagugcacuggccaacagugcauuauaaacagagcaccagaagaaggggugguuccaaacaaaguccauauccuccaguugcuggguggcugcagagaggggugagagcuggcugcacauguccuuuccuuuaagccuucauucucacuuccuuacagcccuuuacuucuccauugucuuuaucccuuuccugcccuuggccucuguguuuaguuggcauuguauagcagucacuccacaucagagaaaggacuggucaaaggaucuuguaggcagaaaaugcugaaagcacuccuuucagagcaaagagagggaaauggcauguguuccuucucugaacaaauauugagggccaucuuugugccaggcacugcuuuaggcacagaguauauggccaugaacaagccccaaucccuuccucagagaacuuccauucagaugggggcagaugcauaaaaauccauagcauagugauucagucacacaauauguuagaaggugguaugugagccaggcgugcuugugugagccuguaaucccaacuacuuaggaggcugaggugggaggauugcuugagaccaggaguucaagcuauaauacgaucuuggaugggaacaggugggagucaggguuuguuuacacguaagugagaacuuuaaugaguuaucuucagaagcagugaaugccccaucccuggagauaguuaaucagggagcagcugacuacuaccagaaggcugcguaaggaauaagauaugaguaaaggcccuucugggucugggugcuagggacuugaagcaacaugaacuggagggagcugugauguggacacgcugaaaucgguggggaggaagcggaagauucaagggaccucaagagacagaagagucaggacuggaugacucccauucauucacaaauguuuacugugugccuacuaugugucagguuccugugcuguacgagggagaagguucccaggcugcggaugauguauucaggaugcugagggcuuaccuguggggguaucacugggugcuagggacuugaagcaacaugaacucccagugaagaccaugguuaaaagggacauuauucacauuuuauuaaaccaaauauuagaaaauugcugucauuuaaaaauaucugcaagcaauuugccauaucaauaaagaaaugucuacagauucaagucugaaagagaagaagguaagugaucaguaacccuuacagacauggaaaccaaggaagccucauuccugugcugagaauauucuaguagcuccugcugcugccacauggcagcugggaauaccaguagucucagcacucggucaguaccgugcaagcucccuugggaaugcugauaaauccuggcaugauacagcaguauauauguuuuuuuuguuuuuuuugagacaagagucuugcucuguccccaggcuggagugcaguggugcaaucucagcucacugcaaucuccgccuccuggguucaagcaacucucuugccucagccucccuaguagcugggauuacaggcaugcaccaccacgcccagcuaauuuuuguauaggacuauaguuuuaaggcaaguuuauaaccuuuggcucauuugagccucacagcacuugguagguagugcuauuauccccauuuuauagauggcacugagaaguaaaaagugacuagcccuggucacacaauugauauggacugaaacugccgcuuucuggcuaucacgggccuugacacagcuaguuugugaccuuuacagucuagcucugucucugcuacaugaaucccaaauuuuugaaucaaguuccccucugggccauaaggccucaucucagacccccaaggaaggcaguccaaagguagacucaagucucgcagaguaaccaggcacuaggaaagcaucaugggcaguagcuccacgagaggggccagagcaccaggcacuggccagagaccagcugcauucacccugagcaguagggccugguggccaugagcacagaccuggaacucacagccugggcccagacuccagcuccaccacuagcugugcgaccuugggcaagugacucugggucuccauuuugccauguguagaauugggaaaacuuucuacccucuagggcugaugaaaggaucagaugaguuuagucguaaagcauuaaaacagugcauuauaaacuauuaagagcuguuauuacuuggccccugcagcugugggucugggaagaggucuuggucaucagggaugggcagaaauguuggggucaaguguauucaucuucccucugucaggaacacccucugccugucacaauucaguuugggccauuccuaauagaauuaauuuccccuuuuucucaggauuccugcagcauagugcuuaaaacucuguccagccagaguuuuaaagucuuugguuagaaguuaagguguuugcaagguucugucugccugguauucugcuacauugucucauaucaaaagugccauuuuuaacucaaaaacuauugaaaauugucaguuuuauaugguucaaacuaaugcacugaaagucuauuuaaaccacgaggauucggcgaccuuggccucccaccaagcaccuaugaagaugcuuuaacagaauauaacuucaaaaccgucuagggaauugacaaaacaggacgcagaaccuucagaacggagacacaaaucccuggaaagaagccucccacucccugcuagcgaagguggccuccugugagggccuacuguuuucuaccucugucacuucauuccagacagcugggcacucuggguuuccuuggcaacaucuggaucuaagggugcucuuacccuuuuugucccaagacaguugggaaacaccacccccuuugguugcuuagcaacugucaccugcugauuccuucccaaaauccccugagaaaugaguaagcagguugaaagcugggccuaagggcugggccaggggacaggucagaugcuugccugggggugggugaacggggcacacgucuggccccccuauaucaccccgggguaacuuuacgcagcucugcuuucuuucaggaccucagacuccccagaugagaucuggcugggugaccugugaggcccgccuaacucagcucuucuguuacucagugauaggcaccugcugguuauuaauucacugcuugggagggaaggggcuuucugggaacuuuucaggguggagagaguauaggacaaagcugcccuuccaaagccuccaauuuaguuggaaagacaggucccagauuuguggcucugauagugagauucuuguuccuugguuagacuuccuggcgcagguaagccugcggaagacugagacaggugaaaagacuuuucugcaugaaugugcuggcagcagagagguguggagguggaacuaugcgacacauuucugacuggagagucucuaagaagagugguaggagcuaggugaggauaaguaauuuugggcagacuagacaagccuugaaugcuaaggugaggcgcuuguauuuuuuuuuguuauuucauggaaacuccuggaagccuuuucauagcugagggguuaagugaaguuuuaggaagaucacucuaguuuuaggguggaagaugaggacugggagaggguucagaccaggaacugcuaagaagcucuugcagcuucuggagggagcugugauguggacacgcugaaaucgguggggaggaagcggaagauucaagggaccucaagagacagaagagucaggacuggaugacucccauucauucacaaacguuuacugugugccuacuaugugucagguuccugugcuguacgagggagaagguucccaggcugcggaugauguauucaggaugcugagggcuuaccuguggggguaucacuuugaaggaacuggauuaaaguaguguaagugaugguggggugagggugcggaggucugaugagagggcagcagcagacuuguuuagggccuguuugaaacuagccuaggagaggaaaccuucaaagcacuguaggcgugauuggucggggaaagcuggggcagggagagggcccuaagaagcaggcaguaaggggaccagccacgcugaucuagguagauuaggcgagacugggcagcugcggcguaccuggaggcugucacgccgguccuggccccuagggcagccgggggaugcugauggcccccucccagagccgcagggccggguagagcggcuccuggaacguggcgcggaagguaugcagguggcucaugccgcccgucacgucguagaaggcgaggacgccggccucguaguccaggaagacgccgagccggucgaggucgucgcggggccgcaggcggcugcgcuggccgucguggaaggcccaguacucaaggucguagcgcuugaggcaccaggacuggcgguugcagcccaggcgggcggcggccgaggccccgcggcgccgaagggaggcguaggccgcgcccacccaccagccggcgcccgccuccugcacgucaaccucccaguaguggcggccgguggcgaagcagucacgagccagcacuugccagagcgcgucgaaccgcagcacgggcacgggccccaggcugcccagcaggccgcagcgcaccgucaggcgaucggcggacaggcgcaggcgcgcgugcaucgugucaggauccagcgugggcgugcgcgcgucugcagggggcgagacaagggacgcaccuggugggcggggccagcgcggcgccccgcccccgggaacccaccaacgcacgugcaaaucacaaaaugcgaagcgcggaaauggcccaaggaaggggugacagaccccuuuaaaccgcgacugccccuggggcggggucuuggggaaaggggaagaagagaucacucugcugcacaucccuuauacugucuguauuuugugccgugaaauuuguugccaauuaauacaaauuuaauuaaaacuaauccuaucacuguuaacauuaggguguguguacuuccuaucuuuccccuccccuugcugcuuuauagcuuuucuuuuucuuuuuuuucuuuuuuugaaacggagucucgcucuguugcccaggcuggagugcaguggcgcgaucuccgcucacugcaagcuccgccucccagguucaggccauucuccugccucagccucccgaguagcugggacuacaggcgcccaccaccacgcccggcuaauuuuuauagcuuuucuuaauauuggugucacaccauacaugacguuagguaaucugcuuuuuaaaauugauugaucuacuugugaggcauuuugacacaucauaauauccuuucacaagagcauuuuaguggagauucuaaaauuuugauguuuggacgcauaacuuaguccuccguuuaaaaagcuuuugaaaccacuaauacaauuacauuuuuacguaucugauugcuucuguagaauauacuccuaaaacaggaauugcugggucaauggguauuuuuuuaaggucuuugauacauauugcaaaacuauccuccccaaaguuuguagugauuuaaacucucauuaacauuucucuuugcauuacaccauguauguacacaugaaguuuuuuuuguuguuguuguuguuguuuuuuaagucuggaucacaggguauguggauauucagcuuucauaaacaaggccaaacaguuuuccauggacauuuggauuguuuccguguugccuauugugacuaauguugcuauaacuguaaacguguaacagagacugaguuuucuaagaaaaagagcauuuuucuaagagaaagagaaugaauuauuuuuaagauuuucccccuuuuucuccugucucccacuuccuacuuagcucuuuauuuuuauuuuuuuuaagauggaguuucacucuuguugcccgggcuggagugcaguggugugaucucgacucacugcaaccucggccuccuggguucaagcgauucuccuaccuaaggcucccuaguaacuaggauuacaggcaccugccaccacgccuggcuaauuuuuguauuuucaguagagacaggguuucaucauguuggccaggcuggucuugaucuccugaccuccggugauccgccugccucagccucccaaagugcugugguuacaggugugagccacugugcccugccucuacuuagcucuuuagaaauguaauuauaaccauuaccuucccuucaccagauagucccuacagggcaaacuuaucuaccuacuuagagggucuagaaccagaacuuucucccaccaggagauugccuuaagagacaacagucaauuuacaacauaaaguaugccuucaacagaacucuuccacccggacagcaucucaagacaacggccacauuacaaccuaguucugcccucaauggcaccagcucaaccacuugguagaaaacgcaucaaaaugagucauauagacccccaucugcuugcuccuucccugcaugccauucauacaaaguccccauuuaaaagccucugcuuucugccccaaaagugaggcgguaccguuaagggcaggaggagccuguaccucuuccccuaagcuaaucuuuagaauaaaaccacuuucuuuauaccagaccucgcucuuguuaauugaacucugcaaagcguugagcaacugaaccuguguuucggucacauaacauucuugugcaggucuuuugauucacauauguaugcauuucuguuggauauaugucuaaggugggagaaaaugcugcucauuauaaccacuucuauucaacaauguucuaaauguaguagacaguaacucaaggcacgaaaaagaagugaaaggaaagaauaaagaucggggaaaugaaagauuauuauucauaggugacaugcuuauuuacacaaaaacccaaauaaucuguagauagcuuagaaguacuaagugaauuuauaacagccacucaguaugucaauauacaaaaauggauaaaucucauauugagugaaagaagcaaaacacagaaggguauagugugaaugaucuacugaaaguucaaaaacagguaaaacuaaccuauaguccuagaagucuggagaguggauccccuuuggggauaguaaacaagaaggcacaugaggaagacuucuggggaguggaaauuuccauuucuugaucugaaggugguuacaaaauauguuuccuuuuuaaaaaaucauugagcugauugaucugcacauuuuugauuugugcacuuuuuuuuuuuuuuuuuuuuuuaagacggagucuugcucuguugccaggcuggagugcaguagugcgaccucggcucacugcaaccuucgccucccggguucaagcgauucuccugccucagucuccugagcagcuaggacuacuggugcaugccaccaugcccagcuaauuuuuguauuuuuaguggagacaggguuucaccauguugugcaggcuggucucgaacugcugaccucaagugauccaccugccuuggguucccaaagugcugggauuacaggugugagccaccgugcucggccuuuaaaucaguauguuagccuuuguauggaaaauguaaauuuauucagugccucuguuuugauauucacugucccccucccaacaccaggggcagugaucaccauucuuugguuucccucugucuccugaugguuacuuugcacuugaauaaacucugcuaacuggauacugagccuucuuuagauugagucuuuuuuagguugacacccaguaauuccacuugagaaauuacuccuaaaaaauaaucugaaaaugagguaugguguguucauucucucauucauuaauucaauucaacaaauguguacaagaauggauguuuauuacagcauuguuuuagaaaugaaaauguaaacauccaacauuaugagauuggcuaaauaugacacauccauucaaugcaaugccaugcaaccucuaaaaacaaugauaaaaauaaaaaauuagcugggcaugguggcacacacugauagucccagcuaugagggaggcugaggugggaaaaucauuugugcccaagaggucgaggcugcagugagccaugacugcaccacugcacuccagagcaagacucggucacacacacacacacacauagugauaauauuagcugggcacaguggcucacuguauaaaucccaaauauauauauguucauaauauaucaguaaaugaaaacagaugacaaaacaguauguauaguaugacaccacguuuguaacauaaaaagauauauuaaauauaucauuauaugcauauuagaugugcuaaaaaagcuaaaaggacaaauaauaauagcaguuauucacagaagagggauuaugaguaacuuuuuucuuucauuuucuaauuuuucuacaaugaacauguauuguuuuauugccuuuaauaauaaacauuuuuuaaaaaacaaguucuuaaaauaaauaaauaaauaaauucuaaugagaaaaaaagagggaccuccauuuccaugauccuccuccacccaacaucccaccaucuccaccgucuccacccuauccccacucccgggggucuuacauuucagcaauagcgaucgcucuggugaggggcugguuuucaacaagguaccuggcuuggugcuggaagggucugagagcuggcaguuuaugccuguaaggaauuguugagaaaugagcgcccggagcuuaugcaagcagacaaauaagacgugcuaaaaauaccacacaacuggagauucgcauaaucucgcccaagagccaggcagauuuaagggauuuaugugaauucacagggacaggaaaaccccaggaugacaaggcuggugugggagaguccuaaauaggaggaggagcugaggcgcgaacaacuacuggauccaacacucaaggaugggcggcgacucagggaagaugugcagauuccaggguaaagauggaaaacaagaaaguagagcugaguccucaggaaggucugagugcucagaaagaaagaaggaggggagucuaucccaacaagcgggcacagcaggggcacccagggcccuuggcacuugcugugcccucugccuggacagcccccccacacccuuccccccuugcccagguugccuccuucccagcuauuggggccgcagcucacucagcaccuccgcagaagugccuuccgcccccaucacucccagcacucaucacaggggccuguagagaucugugggaagcccaccugcaggcuguuuaaaucaaguuuugccuaaagcuccuccuuacaucuuuuaaguucggccuacauauuuuucuguacgucaugaacaauaacaaguggagguguaaacagaccguagccugcacuugugccaaucaccaaguuuuggccaaucagauguagccaacuguucaaauuguguucaaauuaggcgaacgccgagcuguaaccaauccagcugcuucuguaccucacuucuguuuucuguacgucgcuuuccuuuuucugucccuaaaucuucuuccaccacguggcugugcuggagucucugagugcacuguggcucagagggcugccggauucaugaaucguucauugcucauuuaaacuccuuuaaauuuaauuuggcugaaguuguucuuucaucaaggcaaaagccucuccccucuccccagaacucuagaaucauagguccuacugccgaggcgauaccaccacaugggaaguccaacuucucaaaucuaacagguucacuucauucccuccaguccuaaauacucuuucucacuucagaaaaugacaguuuccuucugcgaguugcccacguccaaauccuuggauucugaucucuuuccucucuccccugugacccuacguccacuccuguuguccccauugcugcuccuucgauauggccagcucacucccaucgcgccucaggaccuccacccuugcuuuucccucugucuagaauaccucccccagacguaacagcagcagcaaucauaaucgccaagacauacguggugcuuaauaugccugagcgcuauauguguaagagcucauuuaauccucacagcagcccaggagaggcgacugcauuauggucuccacuuuacagaugcagaaacagaggcauggaaaagggaggagccgugucuaagauggcaggguucagcaggguuccaagugguagaccucggauaggaacccaggaggccuagcuccagaggccgugccuaugaccacugugcucucuggcccuucagacccacagaaccugcagaaugaaugcuuccuuugggccaccuugaguguccccuucucagaggccaucccaacugcuuauauaaaacagcuccuccuccuugucacuuuccugucuuccauccugcccugguuuauuauuauuauuauuauuguuauuuuugagacagagucuugcucugucacccagguugaaguacaguggcaugaucucaacucacugcaaccuccaccucccggguucaagcaauucuccugccucagcuucccgaguagcugggauuacaggugcaugccaccaugccuggcuaauuuuuguauuuguaguagagaugggguuucaccauguuggccaggcuggucucaaacuccugaccucaucauccacccaccucggccucccaaagugcugggauuacaggcgugagccaccacgcccggccuuuauuauucuuuauagcaguauagcaguuccugucaccugacauguuuguguacggucugucuuccccuacgaagacugugagcaccaaaagaggagaaggagcuuuguuuugugcccugcuaugccuggcauauaagaggggcuugauaaauguucugaaugaaucaugauagcagaggugaaugaaugaaugaaugcauaaaugaaucaaagaacagauauuuuugaguacauguuuugugccaggcccuggggggaccucagaguuggaccuaaagcugguuucugcccuucacgugcuuacaaggggcaaggagggggguccauguauccacuucaugagcacccucuagcaggacaugggcaggcccuggagcgggaagggagaggggagauggcuaaaggagagagugagucagggcugggcuggcaggaaagggcuucccaggugggcgcagcugugccagucugccucgaaggggugccaggccuuggccccagccagaggaagagaaggaggaagaguuggucauuccagcugggagcccagagcaaggcugagauguggcaggcucccaggagcaaucugaggggcagaagcagggcagugugacuggagaagggcaggucucagucucaggaaggguuggaggugaaguggugaggguggguugggcaccaggcccaggagccccugaccgcccagccaagggccucagugugggagagacaggauguagggagaugaucuuugcauucgucucugggcuaaaggacacuaggggaguuaaggacacaaaguuggucacucggcgacuuacuuuccuuaaggcgaauguccaauggcgucuguaauguacucuccacggcuuccacgaggcccuuaaagaagcucuugacgggcucaaaggagaggggcacgggauggcacagcuccccgaggcucaucugcugcugcaucuccugcucgguggccguguaugccugugugggcacacgggggugaggguggcucugggagaugcaggcagcaucccagccuccugugcugcacccaggaacaaacccacaccagcaugcccaggcuccacguuggccuggcaccuauggucagcccaggccaugccugcaggagcagagcccuggagagaccauacggcaucccugaggugggagccaugcggaggugcgguuuuucagugcuggcacuggggauuccucccucuccauccuuccuccuuuccuuccuuccuuacguguucauugaaaccuacucugugccagcuaugcaugcagaaggcagggucaggcugacacggggcccuucccagagaggcuucagccucacacacacugcgccacgggucugccuuggguacaaaaagggugagaggucagucucccuggggaaggagcaccuggagcuuauucaaagguggagcaggaaaccauguucuaagaaggacgccaaaggccagcaagguucagcugcagugcugacugaggggguguggccaccgcaggggacauguguccuguuuugcaccuggacagccccucuucaauacuuuccugugguauguggcuucacuaaggagaagcuagaaaacccccucucccagcucccuuugcaccugugcugcaggagugugaccagacgccuccaagccaaagcguggauuuggaaaugacggugaagguagugaugguggcauguggcacugagggacagcaguggugggggcucuggucaguggugugaguggugaugucuugcccagcaggggugccguggggccuauacuggcaccaaccccugcuggagucuggacuucauuccugcugcccaucuuccaucccgacucucuggcccuccuggagauccuaugggcuaucucauacucuuccauaaacuccuuucuugcuuaaaacaguuccaguggauucucauguuugcagguaagaaccauggcugcauuuucugaagcucuguccuggccaggaguuggaaggaagaugacugccucaggugaucaggcuuggcuggcaguggcagugcugcccacccgagaagggguggacagaugagggccucaggagggagggaggguggccuagcacuuggcuguugggcaggggcagaucccaccuggcagcaugcuguacauugggagggggcugugagauggccugcaagccccauucagccuaggaggccaggagucuauagaguccaaccucauuuugguggggaaccaggccuaaggucacacccagagcgcuggaauggagcuggccaggggagaccaagcacuagcaggaaguccagggugggcagggagcagcuccggggaggcgagagggggcucagagggcagaugaguaggguaggaugaggggucgauagaggacacauggcaccaccugguaaccccaaacuccagcagcuagcaccagaccugacacacagguucucaaaacauauguaugauggaauaaaucaaugcaugaaaccgagcacagccacuuuuuugccuuugcagacucagagaacagaaaucccagcccuucaucucucaggccagaaacccaggcaucaucuggggauuccuccuacccauucuccaauuccaaucuccauuccuguggcaucucuugaccugccuguuucuccccauccccacugccccugucuugguccaggccaccaucaucucucuccuggacauuguggccuccucccaaguucucuuccagccucccauccuggccuccucuguccaucuuccacucuaucucuaaagugacuuuucuaaagcacuaaucugaccaugugaaugcuuucaucccucaguucaaaacacuccccugggcugggugcaguggcucacaccucccagcucuuugggaggccaaggugggcagaucacuugaggucaagaguuugagaccagccuggccaacauggugaaacacugucucuacuaaaaauacaaaaauuagcugggcaugguggcacgugcuugucgucucagcucuuccaggggcugaggcaggagaaucccuugaaccugggaggcaaagguugcaguaagcugagauugagccacugcauucuagccugggcaauagagugagacccugucucaaaaacaaacaaacaaacauuccugucuccuaucucauuacaggacaaagucugaacuccauggcacauaaggccuucaugaacuaacuauggccuauggauccagcugugucucucaauccccccacccuuauacccucaccucuccucaagucaggcugcaccccagcugguuccccagccugucaagcucucacauguacacaguuccugucuguccucucugcguccucucuauauacagugugcuccuacucauuguccagcacccaacccuaccaucaccucuuccuagaagucuucccagacugcauccuucucccagccagagagugucagacauuucuuggacauaauuuugcuagcuucauauuuacaaaauuguuuaagcuguauuguaaauaacuguuucugagcaagucccccacccaacugugagcuccuaauguccagcaagugaccuggcucaguacauauugaugaauaaacgaaugaacacauagaaggugggaacggugaaugauuaaaaucauuagcuguggcccaagagaauuugaaaaaaaaagaugacaaagcccugaaaccguuuucugaugugagaauagcaugcuucuccauggaaggauuccuuuguauuccauagccuuaaaaacgaccauuauuuaaaaagagacaauuacauguaacacuuugugcaucuugccucucuuaaagcacaacacccauuaugccuaggaaaacacuucauccagaauuuggcucaaacagcugacaaugagacacaggcugaaccgacugaggccacauaaagacacaagaguggaaauccccagcuggagacuggcuuggcggguuuuguguugacuggcuuauuugucugucuuauuuuccagccagagcccauacuaaucugugguuagaguuggugccacuuuuaguuguacccugccuugucccacagccuuuaaagugucuugugaagguccucuaauaaggcaagauuuuucuuuauagcgagaaaaaugaagcuaagagaaaauuagacacaaaguguuugccaugaagccuuagucugguuagucaaagcagauuuggcucugaacuucccaaggcaaagaaggaaacaggaggagcucuauuaguggaaaagcaauucuagugcagaagugacugcacagggauauugacaccagacaacaguuucuuccacgguucccuaaagacaggaacaccaucggccgggugcgguggcucacgccuguaaucccagcacuuugaggggccgaggggggcggaucacgaggucaggagauggagaccauccuggcuaacauggugaaaccccaucucuacuaaaaaauacaaaaaauuagcugggcgugguggggggcgccuguagucccagcuacucgggaggcugaggcaggagaauggugggagguggagcuugcuguaagccgagaucacaccacugcacuccagccugggcgacagagcaagacuccgucucaaaaaaaaagaaaaaaguagacaggaacaccauccucaacaacaugcuuucucuaaauguagcaaugacuaucccuggggcuaguucuuuucuuuuuuuugagacagagucucacucuguuacccggccuggagugcaguggcaugaucucguuacucacugcaaucuuugccuccccgauucaagugauucucccaccucagccucacaggugcacgccaucacgccuggcugauauuuguauuuuuaguagagaggugguuuugccauguuggucaggcuggucucaaacuucuggccucaagugaucugccacaggggcuauuucuuagacucuuccucaacaaagcccaguggccaaggaguaccauugagccagcugugacucagccuuugaaaugugcucaguagcugcaaggacaccugccuuuucagguggggugucucaauuuaagacuauaaaggcaggcugauugcgguggcucacaccuauaaucccagcacuuugggaggcugaggugggcggaucaccugaggucaggaguucaagaccagccugaccaacguggagaaacccugucucuacuaaaaauacaaaauuagccacgcaugguggcacaugccuguaaucccagcuacucaggaggcugagccaggagaacugcuugaacccaggaggcagagguuguggugagcugagaucgcaccacuguacuccggccugggcaacaagagagaaacuccaucucaaaaaaaaaaaaaaaaaaaaaagacuguacagucagagggccaggcagggucccuuguggguuuagagucagacagaccuagacagacagccagaccugauaccagcucugcuaccuaccugcugugugagaccaggugagucacuucacugagccucaauuucuuguuuauaaaauggggugagcccacuuugcagaguucuggugaauauuagugcuaaacuacacagugcucaggacacaggggccuuugaaauugguggcuguuaauauuauuuaauuagcccaagagguguauuaucuuccuaacaauguauauucucuugaccaccugugugggggcaagacagucuacauggugacaagacaauaguccauguacuugcuuagugugucaauacugugcucaaugccacaauacuugagaugaaguguggguggcagguggcagcaguaagagcagugaccccagcauuaccugaagccucuggacaggaucgggcuccuggcugauacuccagacccuguuggagagaucauucaugaugucaaguugcucucugcaagagucagcuuguucccuguacaccuggaggguaagcugcguguuuuuaucaaugaauuucuuggccagcgcuuccucuucgucaaguaguaaucugaguucagugaauuuccccuucagccagguuuuacuugacucugcauuagccuaaaaacagaaaaaccaguugcagaugacaugucugccaaccaggaaauccagaauaaucaacaugaaaaaaaucauaacgucugaaaugugaguucaguaaaguggccagucagacacaagaucaacuuauaaaaaccaaagcuuuccuaagcaccagcccaucaccgaucguaaaaugcacggagaaauaaagauccuuuugaaaaugggagaaaaaauagcaaaauauguggaaauauaccuaauacaaaaccauauucgugacugggaggguugauuacuauaaagucacuauuugucucuaaauuagucuauaaauuugaugaaauucuaaucaaaaucuuaacaugcugauuaaaaauuauuaaaucauuaggagagagaauaagcauaagaaaagccaaaauugcuuuaaaaaaaucaauaaagagaaaacugauaagagguuaucugccuuaucugccuuaucugauaacaaaacaauaaaucuacaggaucuaaaaccauguggcucaagcauagauaagaggucaaaaguacaaaauaaagagcuuuuaaaagaacucaaauuauauauggaaauguauguauguguaugugugguguaacaguggcauuuuagaacaaauuuuuguauuuuuuguacuaaaaauauaaaaguaaaaauaauuaaaauaauaugagauuuuccacaaugaaagguuaaggaaaacaaacaaaagagaagguccaguuaaacuaaaacacuguacauaaagcccaaagaauaaaucaauuagaugaaauacaaaacaauuuuuauuuauuuauuuauuuauuuuuauuuuuugagaaggaguuucacucuuguccaggcugagugcaguggugcgaucuuggcucacagcaaccacugccucccagguucaagcgauucuccugccucagccuccugaguagcugggauuacaagcacgcaccaccacacauagguaauuuuguauuuuuaguagagacggaguuucaccauguuggucaggcuggucuugaacuucugaccucaggugauccaccugccucagccucccaaaaugcugagauuacaggcaugagacaccaugcccagcccagaaaauaguuuuugaucauuagauuggaagacuuuuaagagacugaaauacagucuguaaggguaugugaaguagggcauuuauauaaacugugggugguagggucuauugguacuucgcuuuuagaggacaauacgacaauagcuaucaauuuuuuuuuuuuuuucagacgaaguuuugcucuugucgccuaggcuggagugcaauggcaagaucucggcucacugcaaccuccgcuucccggguacaagcgauucuccugccucagccguguagcugggacugcagguggccaucaccaugccuggcuaauuuuuguauuuuuagcagagacagggagucacuguuggccaggcugggucuugaacuccugaccucaggugaucugccugccuuggucccccaaagugcuggauuacaggcaugagccacugcaccuggccucaaaguuuuaaauacauuuauucuuucaugcagcaauuccucuuacuuuacuuauauccuagaaaaugcuuucacaugugcaugaagauuuguguaccaagauucucaguauauagcuucuacacauagagaauagaauugggcaaguguagugguaggugucuguaaucccagcuacuugggaggcugaggcuugagaaucacuugagcccgggagguggagcuugcagugagcugagaucaggccgcugcaccccagccugggcgacaaugcaagacuuugacucaaaaaaaaaaaaaaaaaagaaaagaaaaaaacauugaaaaaugggcgucacuagcagaaacagaaacaacagcaguggggagcgaacguucugagaaauagggucaaccacaaacagcucacuagcacucaagcauccuguuacaagcacucaacucacaguccaccugcacccaggcauccugucugcaagcauucagcucaagcagcacaaccuuagaaaacuccaccuccagcuccugccucuuugcagacagucuucuuucugcugucucacccauugcucccuuucaauguaucucccccuuuucucuaaauaaaucugccuuucuaaacucaaugcuguuuugguaaauuauuuuauuccccugugcaccagccucagacaguuguuaaccaugacauauuuggcacaauuuucaauaugggauauguauaucgguucauuauauaaauuguccuacauucguacaaugaaauaauuuauagcgauuacaaagaaugcagugugcugaugcaugcuaaacauggaugaaccucgaagacaucauccccagugaauuaagccagacaaaaaaggacaaauaauuuaucauuccgcuuaugugaaacaucuagaccaggcaaauuuauagagacagaaaguagagucgacguuaccaagggcugggagaggggaaauggggaguaauugcuugaugguuucagaguuucuguuugggauaaugaaaaaguuuuggaaguagacacaggugauggcuauacaacauugugaauauaauucauaccacugaauugaauacuuuaaaaugguuaaaauggcaaauuuuauguuauguauauuuuaucaccauaaaaaaaaagaagaagaaaauauaacaacaaaaacaaugcaguaggcugggcgcgguggcucacgccugcaaucccagcacuuugggaggcugaggcgggcagaucaugaggucaggaguucaagaccagccuggccaagauggugaaacccugucucuacuaaaaauacaaaaaaauuagccgggcguguggcgggcgccuguaaucccagcuacucaggaggcuggggcaaagaauugcuugaacccaggaggcggagguugcagugagccgagaucaugccacugcacuccagccugggcaacagaacgagacuccaucuccaaaaacaaacaacaacaacaaaaaacaaugcaguagaccuauauguccuggcagggaaaguucuccagaaaaaaaaaaaacaggugaaaaagaacaagcugcagaauaauauaagcaagauaauccaaauuuauguaaaacauaauaaaacaaaaccuguauauggacauauguauacaucuauauauuugcaagugcaauuaaaauguuuguuaguaguggucauauuuggcaagaggcaugggauuggggguaagggaaaagagaggcucucacuuuguaccuuauguaguuccauacuauaccauuguuuaaauuuuaaaaaaugacaauuuguucauguauuauuuauacaauuaaaaaaacacuaaagcugggcacgguggcucacgccuguaauuccagcacuuugggaggcugaggcgaauggaucacgaggucaggagauggagaccauccuggccaacauggugaaacccugucucuacuaaagauauaaaaaauuagccaggugugguggugggcaccuguaguccuggcuacucgggaggcuaaggcaggagaaucgccugaacccgggaggcagagguugcagugagccgagauugugcuacugcacuccagccuggcaacagagcgagacuccgucucaaaaaaaaaaaaaaaaaaaauuaaacauaggccagcucccuuccucagcccaaacaucugcacaguccacauagcagaaugaacccagcacccagccagucacgaggggugggcaggcucccgugauaccguguucucagggggacagcaugugguuuggcagcaaacaggagaugaguucucuaaaucuguguuuccuauccaaugcuccaggcagaggauagguucagaggcuagcucauaccacaggccuauggauagguucagaggcuagcucauacacaggccuauggauuauagcuuuaagcuagccugggaauuaguccacauuuuuaugguugcaaugggucaaugagccuggacacaaauauauauuuacugaaugaucaaaugaagaaaauaaaauguauuucaaacucuugauuuaugaacacauguugaagcaacguaaguacacagaggaccuuugcagagaaaccaagagagcaaauaucuccucccaaccaaguuaugcuccaagcaguuuuuauagauccacuuuguaaaguagaaaauacaaaagaagcuucacgacgcuauaccuuguucuaacucucagcacaguggcaaccaguauggaaaacagccaccagaaaacuucuuguauaagcagaugaggcugauuaugcaauauggucagaaagggguagagagagagagggaaggggagagagagagagagaaagagagcaagagaauaucauggucaugaaauaaggaaguacgccaucugguuugggucccacugguucaaagugaagaucccagcugaacugggcugggcuuugaagagagcugguggcugggugagggccuaacagagucuagcugagcagggucuaaggacuguggaagagaaagaagcugaacagccaugaagccccggucagggaaggcugggggauuuugcacucagagugugggcugcugugugaauccaccucuggguccuguggagagugaggagaugaaaggagggcgcuguuuugcugaaaacucaguaugacuuccaacaacccucccacggaugccucucaugggaugcaccaccagggaaagaaggcaugcuguccaaccuugcccagaccacguuagcauggggacucuuuagacucugcuaugguggcaauggcaggcaggaagaggcagggaguggccaugcccagcaggggcaauggacaccaguggccuugucagcagcauggccuggcaggguccccaucuuuuuguucccagucuggcaaaggcugguucauguccccccauuggugccuugaucccaagccuuggcucagucccuacagcuccugcgggucacagagaaaggcauggagccagcaacugaggcuccuuauuccacccgcagggguucugggucuggugccaggcugggcccuugugucucaggcccauuuccugcccauccccggcucugcucuguaggacagaggggcugagccccgccgacugcauuuucaggaucacuugacgucaggaguucgagaccagccuggccaacauagugaaacccgaucccuacuaaaaauacaaaaauuagccaggcacgguagugggcaccugcagucccagcaauucgggaggcugaggcaggagaauugcuugagcccaggaggcggagguugcagugagcugagaucacgccacugugcucuagccuuggcaacagaucgagacucugucucaaaaaacaaacaaacaaacaaaaaaacaaacaaacaaaguaaauucacugaugccaaaaccaaagaggaaacacagugugagugaccuggcaggagcugaagcuaagugaccuggaaggaguggagccagaggugcaugcaugcagacgaaagccacaauggggccuggccauccagggggagcacagaguaccuggccacauuccagcugagaguggaaaggagugaccugcaucaagucagauccacaaagagcugcuccauccaucaacuagcaccagaaaaacuccacccccgggcccagggaaaagaagaggaaucuagucauucauccagggucacaggugaaaagaaaaucaccagcaaaacaaauaaaacaacaguuuugcauuaagcaggguuggaguccaaauucacggaaacucaaaacugaaaaauaauaugaaaaugagucuggagcuacugaaacucuuagcaucuccugaagaugcucaugucacagugcucugaaggggcacacucacaauccacaguguauuggacaucuaugguaaauagcuacuggagacaagaugauaauacacgugacaaaccacacaagaaaaugaaccaccaugccucaccuccagauuggggauauauuagaauuguauguacaauauaacucaagcuacauuaaaagcauaugcauauacaggaaaaaaaucucaaaaugugaauaaugguuggccugaaguggcaggaugcaggauuauggaugaauuuuuaaaaauauguuucuugaucaggaauugaauauaaaugcucacaggagccagguuguuaacacugaaggaagugggcaggguggagcugggagaucccaugccaugggaguagccauugcucagcuccaucugcccccacaugagagugcaggcauaggguggcaauaucuuucuaauuuccuaacuauaaauuuuuauacaaauaugucucagguuuaaaaugcugacuauuaauuccauuuuucuuauuaccuuaugaaggccacuuagguguuagucuaacaaaacauacagaauuuguaugcugaaaauuacaaaaugcugaugaaagaaaacagagaucuaaauaaauggaaagauauaccauauucauggauuggaagaauacauaguaaaaaugucaauucuccccaaauugauaaacagguuuaacacaauuccuaucaaaaucccaacaaacucuuuuucuuuucuuucuucuuuuuuuuuuuuuuuuuugagacauggucucgcucugucacccaggcuggaguguaguggguauggucauugcucacugcaauuucaaccuucugagcucaagcgauccucccaccucagccuccugaguagcugggacuacaggcaugugccaccauaccuggaugauuuuuuaguuuuuuguagagaugguaaacaagcacaugaauagauacucaacaucacuagcuacugggggaaugcaaauuaaaaccaugauaagguaucacuacacacagauuaugcaaguuaagauaaaaacuugugacaauaccaaauguugucaaagaugcagaaaaacacacucucaugcauugcuggugggaauguaaaauggcacaaccacucuggaaaagcguuuggcaguuucuuaaaaaacaaaacaggcaggugccauaugacccagcaauagcauuccugggcaucuaacacagauaaaugaaaacuuauguccgcacagaaaccuggacacaacuguucaaagaagccuuauuugcaauagcccuagacuguaccaaacagccuacaauagguaaaugguuuaaaaaaccucuaugguacaugcauacuaucggauuaguggaauauuacuacucagcaauacaugggaaugaacuagugguucuugcaacaacuuggguggaucccaagggcauucugcugagugaaaaauaccucaaaagaucauuuuccauuuuuaugacauuuucaaaugcaacaauuaucaaacaaauuaauaauugccagggguuagggauuggucggggggauacaguggguagggaggugaccauaaagguguagguagauuuuuuuuuuuaagauggagucucgcucugucauccaggcuggaguacagaggcaugaucuuggcucacugcaaccuccaccuccuggguucaagcgauccucccaccucagccuucugaguagcuuggauuauaggcgccaccauucccggcauuuuuuuguauuuuuuuuuuaguagagaugggguuucaacaugauggccaggcuggucucgaacuccugaccucaaaugaucugccugccucagccuaccaaagugcugggauuacaggcaugagccaccucgcuuggccuagaagaagguagaacuuggcagugauggaauagccugcauuuugauugcaguggugguuaugcaaaucuauacaugugauaaguugacauaaaacuauacacacauaccauccuuuuuuuuuuuuuuuuuggauagugugcuauaguuauguaacaaguaacccuuggggcaaacuaggucaagguacacaaaacucuacuauuuuugcaacuuccucuaaaucuauaaaaaguuaaaaaguuaguuggggaaagggucaagagaaagagaaccauggcuuagauuaagcugaaaccuaccccaggccaucccucaggccaagcuuauccaaccugcagccugugggccgcauguggcccagcacagcuuugaauguggcacaacacaaauuuguaaacuuucuuaaaacaucaugaguuuuuuggauauuuuuuuuuucuuuagcucaucagcuauuguuaguguuaguguauuuuauguguggcccaagacaauucuuccaguguggccuggggaagacuagacccuccacauggguccuaauucuugggggcccucaaaccauaucugcucaggcauuugcagacagggagccugaucuucaggccuccccacaacccuuccaacgugacagcuuucacuuucuaaauccuuugguacugucuaucuccuagcccagaguucugcuugugaagacaugagagacacuauuaagcugggaccacaggugugaacuacaaacgucuucaggguacuggcaaacugucaugaagacaacugacagagaauggacuuuaggcaaaugugggagccaauucuguggccuggccuggucacaggagaaacugggugccagcuucucccauggucacagccacuccuccucuugugugaaucagucagggguuccuuuuuuuuuuuuuuuuuugauaggguuuugcucuguugcccaggcuggagcacagugacgugauccuaggucacugcagucucaagcuucagggcucaagcgaucuucccaccccagccucugaaacagcugggacugcaggcgugcaccaccauaccuggcuauuuuauuuuauuuauuuuuaguagagaugggagucucacuaucuugccuaggcuggucucgaacuccugggcucaagugauccuccagccuuggccucccaaagugcagagcagggguucuuccagcucucaguggggcaggccccaggagggccucccaccccagcccucacugcgaggagggagcaacagaggaugaaggggaggagggagcaacagaggaugaaagggggagggagcaacaggaugaaagggggagggagcaacggaggaugcaaggggaaaugaccagccccugaggcccuaaaaacacaacaacuuugucaugucaaaaugguuacuuagaauaacaucagccucaaguucccauucaaaauccacagagaauccacucaaacaucauuaugaaaggagagugaagaaaguaccuauuuguggaacagaucuuacccuacuugcuuucuuucagcauggcaguggaauuaaagagauaucugcauauuccuuaagcuguguuuugcuuuguuuaaggcaauuugggauaaugggcuaauuccuccaagagacuggcagaugacacuaaggaaccagagauuugccacaaagcaaaggaaaccggagcucagggccccucacuugcagagccccuucauggucuugcaccuaauuuugucuguaauuuuguguucuuuuucuaaagaacccugaauuauagaagcuccaggccccaccaucugccccuucgcaguugguuuuuauuuucauuggcuccauauugggggucccuuuugucuggggggaaaugugggucuuuccauggguaugaggaagaaauguccacuugccuugagcuucucgguggcaucuucuaucuggguuauguugucaaugugcugcugcuucuugauugccagcugcuuuaaacauucuuggcugaguuucuguacaggagggaguuaggaaaaaagucguaauacugucacuuuccaaauaacaggccccccacaggggucaccuccucuuacccuuguauucuuuuccaauggaggcaucugaaggugagguaacuugcccaaagucauauggcaaguugguggaugagcugggacuaggacaucucugauccucggagguccacaucagguaugccucuaaucuugauuugcaccccuuccucacacuuuacuuuaucuaggacaagucuugccugugacuugcuuuuccagccuuucaagugggacuuuaaggcaaacagcuuggggucugggaaagaacaucuacuuauggaguauuaacugagcaccuauuaugugcugggcccuguuccaggugcugcccucaugaaacauacauuccagggagucugugacccucuggcccuggacuacgugagaggucagugggguucaugcuuccugcucuucccaccuuccauaucucugcuuuuugaaauugcuuuuuuccccaaagucugcucugcacucuccuuccccaagggugugaucucgucuccaucuuagccuuucuuacagcuggccuuacacucagcugcugggcccagaucuggcugccccauugacuaggagcuucuugagggcaggcucgcuucguucucacuccccacagggagcagggugugaccagaaguguuugcugaauugaacagaauuaucaggggcuggucaggcaugguggcucaugucuguaaucccaacacuuugggaggcugagguaggaggaucacuugagcccaaggaguucgagaccagccugggcaacauagugagacucugccucuaccacaaaaaauaaaauaaaauaaaauaaaauaaaauaaaauaaaauaaaauaaaauuagcugggcaugguggcaugcaccuguaguccuaacuacuugggaggcugaggucaggggcgggucaccuaagcccaggagguugcagugagccaugaucaugccacuaugccacugcacuccagccugggcaacagagugagacccuguccccccccccaaaaaaaaacaauuaucaggugcugcuagcuucuuucccaaccagccagagaacucuuccaggucagggaaggaucugaucuguucuuugacucauggcccaaaauauaugcugaauagauguuuggugaaugauggauggaugaaugaauaaugggugaauggauaggaaaguggguauguggaugcaaaaugaauauucauagugucaaccuuacguaaugaaauucaagagcugagcaugguggcuugcaccuguaaucccagcuacucaggaggcugaggugggaggaucacuuaaggccaggaguuugagaccagccugagcaacauagcuagaccccauuuuuaccaaaaaacaacaaacaaaacaaaacaaaaaaccuggcugggcaugguggagaaugccucaaguuccagcugcuugggaggaugacauucacaggcuauagaaaugauuagcaaagaaauaaauugaugguggcuagcuuuguuuaaugaacuauucaggcaaaauuguuaagaaugaaaaaauuaaauaaauguaaaugagaucaaaguuuauaaaugaacauuucauaguuuuaaaaguuguuuucaggcuggacacgguggcuaacgccuguaaucccagcacuuugggaggccaaggcaggcagauaaccugaggucagggguucgagacagccugaccaacguggagaaaccccgucucuacuacaaauacaaaauuagccaggcaugguggcgcaugccuguaaucccagcuacucgggaggcugaggcaggagaaucacuugaacccaggaggcagagguugcagugagccaagaucacaccauugcacuccaaccagggcaacaagagugaaacuccgucucaaaaacaaacaaacaaaaauuguuuucaguaacuuaauaucauguuauguuaaaugaaguaauaggucauuauaaaacgucugaaucauuuauaugguauagaaaagcuaaauauauuucgaucuguuaacaaaaaaaaauugaggagccaucuuucuagaaauuaugaaauuauuuucaucuacaaaugcugguagaaaacagcuaaaaauuacuuacuuccuagguuuuucacuggaaauuuggguuacuaagagugaaaauuguaguuaacauaugugauuaaaacuacuugauauaaaagaaacaguucuauuuacagaguguauaaagucagauguguuuuugguaaagacuguugaaagagaguaauuuuucuuuugcaugagagagaacuuuguguagucaaaaugauaaugggaaaagggaaguaaauuuuuguccuaagguagaaugccaaaauaaaaaggaaguauaggacaaaacugaagauuuaagcaaauucuagaaggucuguggaagauuaaucucacaaaagacauuuuguaugugaucaaauugguuaaaaugagaaggaaauggcagggugugguggcuccugccuguaaucccagaacuuugggaggccgaggcaggcagaucacgaagucaggaguuugagaccagccugaccaacauggagaaaccccgucucuacuaaaaauacaaaaauuagccaggugugguggugcacgccuguaaucacagcuacucaggaggcugaggcaggagaucacuugaaucugggagguggagguugcagugagcagagauugcgccauugcacuccagccugagugacagagcaagacucaaucucaaaaaaaaaaaaaaaaaaaaaaucagaaggaaauggccaggcgcggugguucauggcuguaaucccaccacuuuaggaggccgagacagguggaucaccugaggucaggaauuugagaccagccuggcuaacauggugaaaccccgucucuacuaaaaauauaaaaauuaacugggcaugguguugugcaccuguaguccuagcuacucgggaggcuaaggcaggaaaauugcuuguaccugggagguggagguugcagugaggcaguucaugccacugcacuccagccugggcaacaagagcgaaacuccaucucaaaaaaaaaaaaaaaaaaaaaaaagaaggaauuuuuuauaaguuuuucuaaaacuuaaguauuaauaucaaaagcacacucauguaaggccagagucugggcuccuguguuggaacaaccagguuuuaucagagcauugaucugcucuuuaauagaaaauggugagagauuaucgauuaucuuaucuuguguagucaaagcugacugaaauuggaugauagauaauauacuaacaccuaaguaauuuuuuucuuuuuuugagacagggucucacuuugucacccaagaugaaguucaguggugcaaucuuggcucacugcagccuugaccucccaggcucaagcaauccuccugccucagccccccaaguagcugggacuauaggcacacaccaccacacgcagcuaauuuuuguaucuuuuguagagacaggguuucaccauguugcucaggcugguuuugaacuccugagcucaagugaucugccugccuuggccucccaaagggcuaggauuacaggcaugagccacugugccuggccuaaaaguaaaacuuguuuuucuccuuugaauaaaaauguaauguagaauuaauaagagacgguaaaagauguauuuacuuuugcauaaauggcaaagaaaagguaacuggggagaguuugucccaugcugucuuuauuaggucucuugauugagaacugaaucuccucuaucagagugguuuuugcuuuuugaaaucuuugaauaaucauuuuggcuaaaguaauuaccauuauuuuguagugaccugugauucuauuuugaucauguguuuuaaaccuuucuuauuucuauaucaaguguuuuaaaccuuuaauauuugagauacuucccaaaauuaaauuaagucuuuuugacccaagcuaacuugggcauaaccaggaccccuggaaguccaaaagagacacauuaggcuuauuugggaugucaaagucauaugggaaauauugucaaauaagaaaugauguuuaacuuucuuugaguuauauuuauaaaagcguauuauuaauguguuccaaaauuguaugagauuccuaaaagucugauaugucuugguauauguuaucaguauaucauuaucauaauuauuaugauaaacuggugugugccacacaaauaaccacauauccuagucaauuucaucuuugaccguggcuauucuaagccuuuuaucauccacagacaauuuguuuuuuuuuugagacagagucucauucugucgcccaggcuggagugcaguggcguaaucucggcucacugcaagcuccaccucccggguucaugccauucuccugccucagccucccaaguagcugggacuacaggugcccgccaccacgccuggcuaauuuuuuuguauuuuuaguagagacaggguuucaccauggucucgaucuccugaccucgugaucggcccgccucagccucccaaagugcugggauuacaggcgugagccaccgcacccagccgacaauuuuuauuuuacuuugauucuuuuaaaaaaagucguuuauaaucagcuacaaaauuugcuucaucuuuaaggaaauuuuuggaaaaaaacccugacaaguacucuugaauacagguuucugguaacuucagagaucuuaccauuggauuaagcaaaagcuuccagaacucuaauaaaaaccugaggcauucaugaagacugcuaacccaacaucaagcagagcaagaauuauuuacaugggacuaaacugauagaggauaaaagugauuuuuaugauuuuuaaaauuugaaacauugcugauucuuuuuauauuguuuuucagucaagaaaauuuuuucuuuugucacagcaacuggauaaaagauacuuuugugagcaaaauugaaacauuugucuuucucucuaccugauuucaccaaaauuugcaaacuauuuguguuuacuuuuuuuauuuucauuuuuaaauuaauuuuuuuuuuuuagacagagucuugcucugucacccaggcuggagugcaguggcaugaucucggcucacugcaaccucugccuccuagguucaagcgauuuuccugccucagccuccugaguagcugggacuacagguacaugccaccacgcuuggcuaauuuuucuuucugagguggagucuuucucuguugcccaggcuggagugcaguggcacaaucuuggcucacugcaaccucugccucgugggguucaagcaguucuccugccucagccucccgaguagcugggauuacaggugcccaccaccaugcccagcuaauuuuugcauucuuaguagagauagguuucaccauguuggucauacuggucucgaacuucugaccucgugauccacccacuuuggccucccaaagugcuaggauuacaggcgugagccacugagcccagcacaauuuuuguauuuuuaguaaagaugggguuucaccauguuggccaggcugaucuccaacuccugaccucaacugauccgcccaccacagccucccaaagugcuggguuuacaggcgugagccaccgcaccuggcuauuugugaguauucuuauuuuaugacaauauaguuauuugcauaaguucaauaagaguauguuuucuuucauaacagaccacauuggagacacugguaauuuuaccaaggcuuugacugaaaugauauaucuucauauaugaucagacugcuuucaggaacugaagucaaguuuacagagcccauaagaagacccuugggggccaggcuugguggcucaggucuguaaucccagcacuuugggaggcugagguagguggaucacuugaguccaggaguuugaaaccagccugggcaacauagugagaccccgccucuauuaaaaaauguuaacaagaauaaaauaaaauacaauaaaagggggcccagcacuuugggacacugaggugggcaguucacuugaggucggaguuuucaagaccacccuggccaacauggugaagccacaucucuaccaacaaauacaaaaauuagccaggagugguggugcacaccuguaguuccagcuacucaggaagcugaagugggagaaucacuugaaccugggagguggaggcugcagugagccaaaauugcaccaccacacuccagccugggcaacagagugagacccugucucaaaaaaaaaaaaaaaaaaaaauccuuggaaagacuggacuagcuugguccuugucuacacaguucccuuacaagguucccgaccuugugguaagaaaagaaugucacuuuccgacaggucuaggaaccucaagauauuuugggaccuugagaagagaauaauucacccaauguguauggguaucacaggcauagucugauggugaauccuugguuuggcuuuuuagcuguaaggcuuuuaaaagucaaauccaggccaggcgugguguuucacgccuauaaucccagcacuuuggaaggcugaggcaagaggaucacuugagcccaggaauucuagaccagccuggacaacauggugaaaccccgucucuacaaaaaaaauacaaaaaaaaaauuagccaggugugguggugcauaccuauagucccagcuacuugggaggccaagguaggaggauugcuugacccugggagguggagguugcagugagccacgaucaugccauugcacucuagucugggugacagagugagacccugugucucaaaaaaaaaaaaaaaaaagucaaauccaaaauuccuuaugaaaguuccaauaaugcaaauuaucaggccaaguguaauauuaaaacuuacuuugcaaguaaauuuguccuaucaagacucauuuuugguaaaaacagggaacuagagagagaaaaauuauguuucagaagaaaaucuuagcacaccuguuaugcacaccuguuauuccuguuauuagauuccagcccuggccauuguuuuuuaguuuuuauuuuccugcaauuuggacuaaauccugaauuauuuccuggcuacaacaaggaagguuguagaaaaaguuuuagaagccaauuccuggcuuuuaaagaaggcuugggauuuucuucgugauguuuuuaguugacuccccaguggaauagguuugguguuguucugccauagagauucucuguuuuauuuauuuauuuauuuauuuauuuauuuauuuauuuaagacaaagucucacucugucauccaggcuggagugcgguggcgugaucucggcucauugcaaccuccaucucccagguucaagcgauucucaugccucagccuccugaguagcugggauuacagauguguaccaccacaccuggcugauuuucauauuuuuuaauagagacgggguuuccccauguuggccaggccucaaacccuuggccucaugugauccuccugccucagccucccaaagugcugggauuacaggcaugagccacugugcccgacugcuuaugucauuuuaauguaaauucuugguaaacaauuuaggaacugcuucuucuuuuuuccuuaaaaacuuauauguaacugcugcuaaucagaguggauagucacagaaauuugaaucuauggucccaguuggccauccucaagcuuuaggcuuggauaaacucuguacuuaaucauauuuucugaaucuuauuacuucaaguugacaguagguaguggguagggggauggacaaauggaugggugagacucuugagccagaucuguggaaagcagccuuguuaauucugaauaacaguuuuucaaggagccauuauuauaauuacagccauuucauacguuaaaaaaaggaagggucugguggcagggacaggucuugagcccacgacuccacuggauugucccccaugauccccuuuucaccuuggaguuccaagguugucacagugugguggucuggagucaugcaguaccggagaaaggcucacgauggggcugaauucaucacagaagacuucuuggagacaagugguaggaucaacagcugucagacaugagggccuaccucacccaggcuucaugaaacccagagagagagaaggauuugagagaagccacagaaaaagucagcugggaagcuggagcaggagcccagagccccuggggcacuguuaggauuaugcauggguaaggguuccacggugacaauggcccuguugggggcaucuggcuaauggaguccuggguucaaggccugccccugccuccagagccuuccucuuguggccuauaaaauggcuguaauaauaauggcucacccagggcugcuaugagcaggaaugggagugucuguguggccggggaggggagaggagguagguagugacagcugaggcugcucccagggcagucaggccguccucagcucaaaguucacaggcccuuucuguggacugcagauuaaguaaaccugagaugucuguguggcuuucugagcuacacagggcuguuuauuaagagggagaguuuguaccucuguuaacuaaaaggcagacugucuuccagcccaauggcaguguggcggaucggccaugguggacacggucaaggacaucuggguaccagccugggcucccaaccucucacuccuaaacccaccuuuucugaagcucaacugauggcuuuggcucgccuuugcccuuccuugggucucaggcucccgcucugaacuuucggucgaccgcuuagacgcccucuggggcaccuuugguuuccagguuguaacccgccacuggccacggccaggcacgcccccuccucggccguuaugccugggcuggcucccccaacucccgcgcggcgaaccccguccccaucguccccaccugcacgugcaccgcugccuccagcgccaggcccacaggguggccacggugcgcgcccagcaccgggcaaagcgcgcacacgcagcggcggcagcggcgacagaagagcucagccacgcggucgccaugcuccgggcagcgccagccgcaucccucgacaagcuccgaccucccagggguccggcucccggucgccgcgcccgccauucaucuccaccuccuccg

SEQ ID NO: 192888 - RNA, 49920 nt, Homo sapiens
cggaggagguggagaugaauggcgggcgcggcgaccgggagccggaccccugggaggucggagcuugucgagggaugcggcuggcgcugcccggagcauggcgaccgcguggcugagcucuucugucgccgcugccgccgcugcgugugcgcgcuuugcccggugcugggcgcgcaccguggccacccugugggccuggcgcuggaggcagcggugcacgugcagguggggacgauggggacgggguucgccgcgcgggaguugggggagccagcccaggcauaacggccgaggagggggcgugccuggccguggccaguggcggguuacaaccuggaaaccaaaggugccccagagggcgucuaagcggucgaccgaaaguucagagcgggagccugagacccaaggaagggcaaaggcgagccaaagccaucaguugagcuucagaaaagguggguuuaggagugagagguugggagcccaggcugguacccagauguccuugaccguguccaccauggccgauccgccacacugccauugggcuggaagacagucugccuuuuaguuaacagagguacaaacucucccucuuaauaaacagcccuguguagcucagaaagccacacagacaucucagguuuacuuaaucugcaguccacagaaagggccugugaacuuugagcugaggacggccugacugcccugggagcagccucagcugucacuaccuaccuccucuccccuccccggccacacagacacucccauuccugcucauagcagcccugggugagccauuauuauuacagccauuuuauaggccacaagaggaaggcucuggaggcaggggcaggccuugaacccaggacuccauuagccagaugcccccaacagggccauugucaccguggaacccuuacccaugcauaauccuaacagugccccaggggcucugggcuccugcuccagcuucccagcugacuuuuucuguggcuucucucaaauccuucucucucucuggguuucaugaagccugggugagguaggcccucaugucugacagcuguugauccuaccacuugucuccaagaagucuucugugaugaauucagccccaucgugagccuuucuccgguacugcaugacuccagaccaccacacugugacaaccuuggaacuccaaggugaaaaggggaucaugggggacaauccaguggagucgugggcucaagaccugucccugccaccagacccuuccuuuuuuuaacguaugaaauggcuguaauuauaauaauggcuccuugaaaaacuguuauucagaauuaacaaggcugcuuuccacagaucuggcucaagagucucacccauccauuuguccaucccccuacccacuaccuacugucaacuugaaguaauaagauucagaaaauaugauuaaguacagaguuuauccaagccuaaagcuugaggauggccaacugggaccauagauucaaauuucugugacuauccacucugauuagcagcaguuacauauaaguuuuuaaggaaaaaagaagaagcaguuccuaaauuguuuaccaagaauuuacauuaaaaugacauaagcagucgggcacaguggcucaugccuguaaucccagcacuuugggaggcugaggcaggaggaucacaugaggccaaggguuugaggccuggccaacauggggaaaccccgucucuauuaaaaaauaugaaaaucagccagguguggugguacacaucuguaaucccagcuacucaggaggcugaggcaugagaaucgcuugaaccugggagauggagguugcaaugagccgagaucacgccaccgcacuccagccuggaugacagagugagacuuugucuuaaauaaauaaauaaauaaauaaauaaauaaauaaauaaaacagagaaucucuauggcagaacaacaccaaaccuauuccacuggggagucaacuaaaaacaucacgaagaaaaucccaagccuucuuuaaaagccaggaauuggcuucuaaaacuuuuucuacaaccuuccuuguuguagccaggaaauaauucaggauuuaguccaaauugcaggaaaauaaaaacuaaaaaacaauggccagggcuggaaucuaauaacaggaauaacaggugugcauaacaggugugcuaagauuuucuucugaaacauaauuuuucucucucuaguucccuguuuuuaccaaaaaugagucuugauaggacaaauuuacuugcaaaguaaguuuuaauauuacacuuggccugauaauuugcauuauuggaacuuucauaaggaauuuuggauuugacuuuuuuuuuuuuuuuuuugagacacagggucucacucugucacccagacuagagugcaauggcaugaucguggcucacugcaaccuccaccucccagggucaagcaauccuccuaccuuggccucccaaguagcugggacuauagguaugcaccaccacaccuggcuaauuuuuuuuuuguauuuuuuuuguagagacgggguuucaccauguuguccaggcuggucuagaauuccugggcucaagugauccucuugccucagccuuccaaagugcugggauuauaggcgugaaacaccacgccuggccuggauuugacuuuuaaaagccuuacagcuaaaaagccaaaccaaggauucaccaucagacuaugccugugauacccauacacauugggugaauuauucucuucucaaggucccaaaauaucuugagguuccuagaccugucggaaagugacauucuuuucuuaccacaaggucgggaaccuuguaagggaacuguguagacaaggaccaagcuaguccagucuuuccaaggauuuuuuuuuuuuuuuuuuuuugagacagggucucacucuguugcccaggcuggagugugguggugcaauuuuggcucacugcagccuccaccucccagguucaagugauucucccacuucagcuuccugaguagcuggaacuacaggugugcaccaccacuccuggcuaauuuuuguauuuguugguagagauguggcuucaccauguuggccaggguggucuugaaaacuccgaccucaagugaacugcccaccucagugucccaaagugcugggcccccuuuuauuguauuuuauuuuauucuuguuaacauuuuuuaauagaggcggggucucacuauguugcccaggcugguuucaaacuccuggacucaagugauccaccuaccucagccucccaaagugcugggauuacagaccugagccaccaagccuggcccccaagggucuucuuaugggcucuguaaacuugacuucaguuccugaaagcagucugaucauauaugaagauauaucauuucagucaaagccuugguaaaauuaccagugucuccaauguggucuguuaugaaagaaaacauacucuuauugaacuuaugcaaauaacuauauugucauaaaauaagaauacucacaaauagccaggugcgguggcucacgccuguaaacccagcacuuugggaggcuguggugggcggaucaguugaggucaggaguuggagaucagccuggccaacauggugaaaccccaucuuuacuaaaaauacaaaaauugugcugggcucaguggcucacgccuguaauccuagcacuuugggaggccaaaguggguggaucacgaggucagaaguucgagaccaguaugaccaacauggugaaaccuaucucuacuaagaaugcaaaaauuagcugggcaugguggugggcaccuguaaucccagcuacucgggaggcugaggcaggagaacugcuugaaccccacgaggcagagguugcagugagccaagauugugccacugcacuccagccugggcaacagagaaagacuccaccucagaaagaaaaauuagccaagcgugguggcauguaccuguagucccagcuacucaggaggcugaggcaggaaaaucgcuugaaccuaggaggcagagguugcagugagccgagaucaugccacugcacuccagccugggugacagagcaagacucugucuaaaaaaaaaaaauuaauuuaaaaaugaaaauaaaaaaaguaaacacaaauaguuugcaaauuuuggugaaaucagguagagagaaagacaaauguuucaauuuugcucacaaaaguaucuuuuauccaguugcugugacaaaagaaaaaauuuucuugacugaaaaacaauauaaaaagaaucagcaauguuucaaauuuuaaaaaucauaaaaaucacuuuuauccucuaucaguuuagucccauguaaauaauucuugcucugcuugauguuggguuagcagucuucaugaaugccucagguuuuuauuagaguucuggaagcuuuugcuuaauccaaugguaagaucucugaaguuaccagaaaccuguauucaagaguacuugucaggguuuuuuuccaaaaauuuccuuaaagaugaagcaaauuuuguagcugauuauaaacgacuuuuuuuaaaagaaucaaaguaaaauaaaaauugucggcugggugcgguggcucacgccuguaaucccagcacuuugggaggcugaggcgggccgaucacgaggucaggagaucgagaccauggugaaacccugucucuacuaaaaauacaaaaaaauuagccaggcgugguggcgggcaccuguagucccagcuacuugggaggcugaggcaggagaauggcaugaacccgggagguggagcuugcagugagccgagauuacgccacugcacuccagccugggcgacagaaugagacucugucucaaaaaaaaaacaaauugucuguggaugauaaaaggcuuagaauagccacggucaaagaugaaauugacuaggauaugugguuauuuguguggcacacaccaguuuaucauaauaauuaugauaaugauauacugauaacauauaccaagacauaucagacuuuuaggaaucucauacaauuuuggaacacauuaauaauacgcuuuuauaaauauaacucaaagaaaguuaaacaucauuucuuauuugacaauauuucccauaugacuuugacaucccaaauaagccuaaugugucucuuuuggacuuccagggguccugguuaugcccaaguuagcuugggucaaaaagacuuaauuuaauuuugggaaguaucucaaauauuaaagguuuaaaacacuugauauagaaauaagaaagguuuaaaacacaugaucaaaauagaaucacaggucacuacaaaauaaugguaauuacuuuagccaaaaugauuauucaaagauuucaaaaagcaaaaaccacucugauagaggagauucaguucucaaucaagagaccuaauaaagacagcaugggacaaacucuccccaguuaccuuuucuuugccauuuaugcaaaaguaaauacaucuuuuaccgucucuuauuaauucuacauuacauuuuuauucaaaggagaaaaacaaguuuuacuuuuaggccaggcacaguggcucaugccuguaauccuagcccuuugggaggccaaggcaggcagaucacuugagcucaggaguucaaaaccagccugagcaacauggugaaacccugucucuacaaaagauacaaaaauuagcugcgugugguggugugugccuauagucccagcuacuuggggggcugaggcaggaggauugcuugagccugggaggucaaggcugcagugagccaagauugcaccacugaacuucaucuugggugacaaagugagacccugucucaaaaaaagaaaaaaauuacuuagguguuaguauauuaucuaucauccaauuucagucagcuuugacuacacaagauaagauaaucgauaaucucucaccauuuucuauuaaagagcagaucaaugcucugauaaaaccugguuguuccaacacaggagcccagacucuggccuuacaugagugugcuuuugauauuaauacuuaaguuuuagaaaaacuuauaaaaaauuccuucuuuuuuuuuuuuuuuuuuuuuuuugagauggaguuucgcucuuguugcccaggcuggagugcaguggcaugaacugccucacugcaaccuccaccucccagguacaagcaauuuuccugccuuagccucccgaguagcuaggacuacaggugcacaacaccaugcccaguuaauuuuuauauuuuuaguagagacgggguuucaccauguuagccaggcuggucucaaauuccugaccucaggugauccaccugucucggccuccuaaaguggugggauuacagccaugaaccaccgcgccuggccauuuccuucugauuuuuuuuuuuuuuuuuuuuuugagauugagucuugcucugucacucaggcuggagugcaauggcgcaaucucugcucacugcaaccuccaccucccagauucaagugaucuccugccucagccuccugaguagcugugauuacaggcgugcaccaccacaccuggcuaauuuuuguauuuuuaguagagacgggguuucuccauguuggucaggcuggucucaaacuccugacuucgugaucugccugccucggccucccaaaguucugggauuacaggcaggagccaccacacccugccauuuccuucucauuuuaaccaauuugaucacauacaaaaugucuuuugugagauuaaucuuccacagaccuucuagaauuugcuuaaaucuucaguuuuguccuauacuuccuuuuuauuuuggcauucuaccuuaggacaaaaauuuacuucccuuuucccauuaucauuuugacuacacaaaguucucucucaugcaaaagaaaaauuacucucuuucaacagucuuuaccaaaaacacaucugacuuuauacacucuguaaauagaacuguuucuuuuauaucaaguaguuuuaaucacauauguuaacuacaauuuucacucuuaguaacccaaauuuccagugaaaaaccuaggaaguaaguaauuuuuagcuguuuucuaccagcauuuguagaugaaaauaauuucauaauuucuagaaagauggcuccucaauuuuuuuuuguuaacagaucgaaauauauuuagcuuuucuauaccauauaaaugauucagacguuuuauaaugaccuauuacuucauuuaacauaacaugauauuaaguuacugaaaacaauuuuuguuuguuuguuuuugagacggaguuucacucuuguugcccugguuggagugcaauggugugaucuuggcucacugcaaccucugccuccuggguucaagugauucuccugccucagccucccgaguagcugggauuacaggcaugcgccaccaugccuggcuaauuuuguauuuguaguagagacgggguuucuccacguuggucaggcugucucgaaccccugaccucagguuaucugccugccuuggccucccaaagugcugggauuacaggcguuagccaccguguccagccugaaaacaacuuuuaaaacuaugaaauguucauuuauaaacuuugaucucauuuacauuuauuuaauuuuuucauucuuaacaauuuugccugaauaguucauuaaacaaagcuagccaccaucaauuuauuucuuugcuaaucauuucuauagccugugaaugucauccucccaagcagcuggaacuugaggcauucuccaccaugcccagccagguuuuuuguuuuguuuuguuuguuguuuuuugguaaaaauggggucuagcuauguugcucaggcuggucucaaacuccuggccuuaagugauccucccaccucagccuccugaguagcugggauuacaggugcaagccaccaugcucagcucuugaauuucauuacguaagguugacacuaugaauauucauuuugcauccacauacccacuuuccuauccauucacccauuauucauucauccauccaucauucaccaaacaucuauucagcauauauuuugggccaugagucaaagaacagaucagauccuucccugaccuggaagaguucucuggcugguugggaaagaagcuagcagcaccugauaauuguuuuuuuuuggggggggggacagggucucacucuguugcccaggcuggagugcaguggcauaguggcaugaucauggcucacugcaaccuccugggcuuaggugacccgccccugaccucagccucccaaguaguuaggacuacaggugcaugccaccaugcccagcuaauuuuauuuuauuuuauuuuauuuuauuuuauuuuauuuuauuuuauuuuuugugguagaggcagagucucacuauguugcccaggcuggucucgaacuccuugggcucaagugauccuccuaccucagccucccaaaguguugggauuacagacaugagccaccaugccugaccagccccugauaauucuguucaauucagcaaacacuucuggucacacccugcucccuguggggagugagaacgaagcgagccugcccucaagaagcuccuagucaauggggcagccagaucugggcccagcagcugaguguaaggccagcuguaagaaaggcuaagauggagacgagaucacacccuuggggaaggagagugcagagcagacuuuggggaaaaaagcaauuucaaaaagcagagauauggaaggugggaagagcaggaagcaugaaccccacugaccucucacguaguccagggccagagggucacagacucccuggaauguauguuucaugagggcagcaccuggaacagggcccagcacauaauaggugcucaguuaauacuccauaaguagauguucuuucccagaccccaagcuguuugccuuaaagucccacuugaaaggcuggaaaagcaagucacaggcaagacuuguccuagauaaaguaaagugugaggaaggggugcaaaucaagauuagaggcauaccugauguggaccuccgaggaucagagauguccuagucccagcucauccaccaacuugccauaugacuuugggcaaguuaccucaccuucagaugccuccauuggaaaagaauacaaggguaagaggaggugaccccuguggggggccuguuauuuggaaagugacaguauuacgacuuuuuuccuaacucccuccuguacagaaacucagccaagaauguuuaaagcagcuggcaaucaagaagcagcagcacauugacaacauaacccagauagaagaugccaccgagaagcucaaggcaaguggacauuucuuccucauacccauggaaagacccacauuuccccccagacaaaagggacccccaauauggagccaaugaaaauaaaaaccaacugcgaaggggcagaugguggggccuggagcuucuauaauucaggguucuuuagaaaaagaacacaaaauuacagacaaaauuaggugcaagaccaugaaggggcucugcaagugaggggcccugagcuccgguuuccuuugcuuuguggcaaaucucugguuccuuagugucaucugccagucucuuggaggaauuagcccauuaucccaaauugccuuaaacaaagcaaaacacagcuuaaggaauaugcagauaucucuuuaauuccacugccaugcugaaagaaagcaaguaggguaagaucuguuccacaaauagguacuuucuucacucuccuuucauaaugauguuugaguggauucucuguggauuuugaaugggaacuugaggcugauguuauucuaaguaaccauuuugacaugacaaaguuguuguguuuuuagggccucaggggcuggucauuuccccuugcauccuccguugcucccucccccuuucauccuguugcucccucccccuuucauccucuguugcucccuccuccccuucauccucuguugcucccuccucgcagugagggcuggggugggaggcccuccuggggccugccccacugagagcuggaagaaccccugcucugcacuuugggaggccaaggcuggaggaucacuugagcccaggaguucgagaccagccuaggcaagauagugagacucccaucucuacuaaaaauaaauaaaauaaaauagccagguaugguggugcacgccugcagucccagcuguuucagaggcuggggugggaagaucgcuugagcccugaagcuugagacugcagugaccuaggaucacgucacugugcuccagccugggcaacagagcaaaacccuaucaaaaaaaaaaaaaaaaaaggaaccccugacugauucacacaagaggaggaguggcugugaccaugggagaagcuggcacccaguuucuccugugaccaggccaggccacagaauuggcucccacauuugccuaaaguccauucucugucaguugucuucaugacaguuugccaguacccugaagacguuuguaguucacaccuguggucccagcuuaauagugucucucaugucuucacaagcagaacucugggcuaggagauagacaguaccaaaggauuuagaaagugaaagcugucacguuggaaggguuguggggaggccugaagaucaggcucccugucugcaaaugccugagcagauaugguuugagggcccccaagaauuaggacccauguggagggucuagucuuccccaggccacacuggaagaauugucuugggccacacauaaaauacacuaacacuaacaauagcugaugagcuaaagaaaaaaaaaauauccaaaaaacucaugauguuuuaagaaaguuuacaaauuuguguugugccacauucaaagcugugcugggccacaugcggcccacaggcugcagguuggauaagcuuggccugagggauggccugggguagguuucagcuuaaucuaagccaugguucucuuucucuugacccuuuccccaacuaacuuuuuaacuuuuuauagauuuagaggaaguugcaaaaauaguagaguuuuguguaccuugaccuaguuugccccaaggguuacuuguuacauaacuauagcacacuauccaaaaaaaaaaaaaaaaaggaugguauguguguauaguuuuaugucaacuuaucacauguauagauuugcauaaccaccacugcaaucaaaaugcaggcuauuccaucacugccaaguucuaccuucuucuaggccaagcgagguggcucaugccuguaaucccagcacuuugguaggcugaggcaggcagaucauuugaggucaggaguucgagaccagccuggccaucauguugaaaccccaucucuacuaaaaaaaaaauacaaaaaaaugccgggaaugguggcgccuauaauccaagcuacucagaaggcugaggugggaggaucgcuugaacccaggagguggagguugcagugagccaagaucaugccucuguacuccagccuggaugacagagcgagacuccaucuuaaaaaaaaaaaucuaccuacaccuuuauggucaccucccuacccacuguauccccccgaccaaucccuaaccccuggcaauuauuaauuuguuugauaauuguugcauuugaaaaugucauaaaaauggaaaaugaucuuuugagguauuuuucacucagcagaaugcccuugggauccacccaaguuguugcaagaaccacuaguucauucccauguauugcugaguaguaauauuccacuaauccgauaguaugcauguaccauagagguuuuuuaaaccauuuaccuauuguaggcuguuugguacagucuagggcuauugcaaauaaggcuucuuugaacaguuguguccagguuucugugcggacauaaguuuucauuuaucuguguuagaugcccaggaaugcuauugcugggucauauggcaccugccuguuuuguuuuuuaagaaacugccaaacgcuuuuccagagugguugugccauuuuacauucccaccagcaaugcaugagaguguguuuuucugcaucuuugacaacauuugguauugucacaaguuuuuaucuuaacuugcauaaucuguguguagugauaccuuaucaugguuuuaauuugcauucccccaguagcuagugauguugaguaucuauucaugugcuuguuuaccaucucuacaaaaaacuaaaaaaucauccagguaugguggcacaugccuguagucccagcuacucaggaggcugaggugggaggaucgcuugagcucagaagguugaaauugcagugagcaaugaccauacccacuacacuccagccugggugacagagcgagaccaugucucaaaaaaaaaaaaaaaaaagaagaaagaaaagaaaaagaguuuguugggauuuugauaggaauuguguuaaaccuguuuaucaauuuggggagaauugacauuuuuacuauguauucuuccaauccaugaauaugguauaucuuuccauuuauuuagaucucuguuuucuuucaucagcauuuuguaauuuucagcauacaaauucuguauguuuuguuagacuaacaccuaaguggccuucauaagguaauaagaaaaauggaauuaauagucagcauuuuaaaccugagacauauuuguauaaaaauuuauaguuaggaaauuagaaagauauugccacccuaugccugcacucucaugugggggcagauggagcugagcaauggcuacucccauggcaugggaucucccagcuccacccugcccacuuccuucaguguuaacaaccuggcuccugugagcauuuauauucaauuccugaucaagaaacauauuuuuaaaaauucauccauaauccugcauccugccacuucaggccaaccauuauucacauuuugagauuuuuuuccuguauaugcauaugcuuuuaauguagcuugaguuauauuguacauacaauucuaauauauccccaaucuggaggugaggcauggugguucauuuucuugugugguuugucacguguauuaucaucuugucuccaguagcuauuuaccauagauguccaauacacuguggauugugagugugccccuucagagcacugugacaugagcaucuucaggagaugcuaagaguuucaguagcuccagacucauuuucauauuauuuuucaguuuugaguuuccgugaauuuggacuccaacccugcuuaaugcaaaacuguuguuuuauuuguuuugcuggugauuuucuuuucaccugugacccuggaugaaugacuagauuccucuucuuuucccugggcccggggguggaguuuuucuggugcuaguugauggauggagcagcucuuuguggaucugacuugaugcaggucacuccuuuccacucucagcuggaauguggccagguacucugugcucccccuggauggccaggccccauuguggcuuucgucugcaugcaugcaccucuggcuccacuccuuccaggucacuuagcuucagcuccugccaggucacucacacuguguuuccucuuugguuuuggcaucagugaauuuacuuuguuuguuuguuuuuuuguuuguuuguuuguuuuuugagacagagucucgaucuguugccaaggcuagagcacaguggcgugaucucagcucacugcaaccuccgccuccugggcucaagcaauucuccugccucagccucccgaauugcugggacugcaggugcccacuaccgugccuggcuaauuuuuguauuuuuaguagggaucggguuucacuauguuggccaggcuggucucgaacuccugacgucaagugauccugaaaaugcagucggcggggcucagccccucuguccuacagagcagagccggggaugggcaggaaaugggccugagacacaagggcccagccuggcaccagacccagaaccccugcggguggaauaaggagccucaguugcuggcuccaugccuuucucugugacccgcaggagcuguagggacugagccaaggcuugggaucaaggcaccaauggggggacaugaaccagccuuugccagacugggaacaaaaagauggggacccugccaggccaugcugcugacaaggccacugguguccauugccccugcugggcauggccacucccugccucuuccugccugccauugccaccauagcagagucuaaagaguccccaugcuaacguggucugggcaagguuggacagcaugccuucuuucccugguggugcaucccaugagaggcauccgugggaggguuguuggaagucauacugaguuuucagcaaaacagcgcccuccuuucaucuccucacucuccacaggacccagagguggauucacacagcagcccacacucugagugcaaaaucccccagccuucccugaccggggcuucauggcuguucagcuucuuucucuuccacaguccuuagacccugcucagcuagacucuguuaggcccucacccagccaccagcucucuucaaagcccagcccaguucagcugggaucuucacuuugaaccagugggacccaaaccagauggcguacuuccuuauuucaugaccaugauauucucuugcucucuuucucucucucucucuccccuucccucucucucucuaccccuuucugaccauauugcauaaucagccucaucugcuuauacaagaaguuuucugguggcuguuuuccauacugguugccacugugcugagaguuagaacaagguauagcgucgugaagcuucuuuuguauuuucuacuuuacaaaguggaucuauaaaaacugcuuggagcauaacuugguugggaggagauauuugcucucuugguuucucugcaaagguccucuguguacuuacguugcuucaacauguguucauaaaucaagaguuugaaauacauuuuauuuucuucauuugaucauucaguaaauauauauuuguguccaggcucauugacccauugcaaccauaaaaauguggacuaauucccaggcuagcuuaaagcuauaauccauaggccuguguaugagcuagccucugaaccuauccauaggccugugguaugagcuagccucugaaccuauccucugccuggagcauuggauaggaaacacagauuuagagaacucaucuccuguuugcugccaaaccacaugcugucccccugagaacacgguaucacgggagccugcccaccccucgugacuggcugggugcuggguucauucugcuauguggacugugcagauguuugggcugaggaagggagcuggccuauguuuaauuuuuuuuuuuuuuuuuuuugagacggagucucgcucuguugccaggcuggagugcaguagcacaaucucggcucacugcaaccucugccucccggguucaggcgauucuccugccuuagccucccgaguagccaggacuacaggugcccaccaccacaccuggcuaauuuuuuauaucuuuaguagagacaggguuucaccauguuggccaggauggucuccaucuccugaccucgugauccauucgccucagccucccaaagugcuggaauuacaggcgugagccaccgugcccagcuuuaguguuuuuuuaauuguauaaauaauacaugaacaaauugucauuuuuuaaaauuuaaacaaugguauaguauggaacuacauaagguacaaagugagagccucucuuuucccuuacccccaaucccaugccucuugccaaauaugaccacuacuaacaaacauuuuaauugcacuugcaaauauauagauguauacauauguccauauacagguuuuguuuuauuauguuuuacauaaauuuggauuaucuugcuuauauuauucugcagcuuguucuuuuucaccuguuuuuuuuuuuucuggagaacuuucccugccaggacauauaggucuacugcauuguuuuuuguuguuguuguuuguuuuuggagauggagucucguucuguugcccaggcuggagugcaguggcaugaucucggcucacugcaaccuccgccuccuggguucaagcaauucuuugccccagccuccugaguagcugggauuacaggcgcccgccacacgcccggcuaauuuuuuuguauuuuuaguagagacaggguuucaccaucuuggccaggcuggucuugaacuccugaccucaugaucugcccgccucagccucccaaagugcugggauugcaggcgugagccaccgcgcccagccuacugcauuguuuuuguuguuauauuuucuucuucuuuuuuuuuauggugauaaaauauacauaacauaaaauuugccauuuuaaccauuuuaaaguauucaauucagugguaugaauuauauucacaauguuguauagccaucaccugugucuacuuccaaaacuuuuucauuaucccaaacagaaacucugaaaccaucaagcaauuacuccccauuuccccucucccagcccuugguaacgucgacucuacuuucugucucuauaaauuugccuggucuagauguuucacauaagcggaaugauaaauuauuuguccuuuuuugucuggcuuaauucacuggggaugaugucuucgagguucauccauguuuagcaugcaucagcacacugcauucuuuguaaucgcuauaaauuauuucauuguacgaauguaggacaauuuauauaaugaaccgauauacauaucccauauugaaaauugugccaaauaugucaugguuaacaacugucugaggcuggugcacaggggaauaaaauaauuuaccaaaacagcauugaguuuagaaaggcagauuuauuuagagaaaagggggagauacauugaaagggagcaaugggugagacagcagaaagaagacugucugcaaagaggcaggagcuggagguggaguuuucuaagguugugcugcuugagcugaaugcuugcagacaggaugccugggugcagguggacugugaguugagugcuuguaacaggaugcuugagugcuagugagcuguuugugguugacccuauuucucagaacguucgcuccccacugcuguuguuucuguuucugcuagugacgcccauuuuucaauguuuuuuucuuuucuuuuuuuuuuuuuuuuuugagucaaagucuugcauugucgcccaggcuggggugcagcggccugaucucagcucacugcaagcuccaccucccgggcucaagugauucucaagccucagccucccaaguagcugggauuacagacaccuaccacuacacuugcccaauucuauucucuauguguagaagcuauauacugagaaucuugguacacaaaucuucaugcacaugugaaagcauuuucuaggauauaaguaaaguaagaggaauugcugcaugaaagaauaaauguauuuaaaacuuugaggccaggugcaguggcucaugccuguaauccagcacuuugggggaccaaggcaggcagaucaccugaggucaggaguucaagacccagccuggccaacagugacucccugucucugcuaaaaauacaaaaauuagccaggcauggugauggccaccugcagucccagcuacacggcugaggcaggagaaucgcuuguacccgggaagcggagguugcagugagccgagaucuugccauugcacuccagccuaggcgacaagagcaaaacuucgucugaaaaaaaaaaaaaaauugauagcuauugucguauuguccucuaaaagcgaaguaccaauagacccuaccacccacaguuuauauaaaugcccuacuucacauacccuuacagacuguauuucagucucuuaaaagucuuccaaucuaaugaucaaaaacuauuuucugggcugggcauggugucucaugccuguaaucucagcauuuugggaggcugaggcagguggaucaccugaggucagaaguucaagaccagccugaccaacauggugaaacuccgucucuacuaaaaauacaaaauuaccuaugugugguggugcgugcuuguaaucccagcuacucaggaggcugaggcaggagaaucgcuugaaccugggaggcagugguugcugugagccaagaucgcaccacugcacucagccuggacaagagugaaacuccuucucaaaaaauaaaaauaaauaaauaaauaaauaaaaauuguuuuguauuucaucuaauugauuuauucuuugggcuuuauguacaguguuuuaguuuaacuggaccuucucuuuuguuuguuuuccuuaaccuuucauuguggaaaaucucauauuauuuuaauuauuuuuacuuuuauauuuuuaguacaaaaaauacaaaaauuuguucuaaaaugccacuguuacaccacacauacacauacauacauuuccauauauaauuugaguucuuuuaaaagcucuuuauuuuguacuuuugaccucuuaucuaugcuugagccacaugguuuuagauccuguagauuuauuguuuuguuaucagauaaggcagauaaggcagauaaccucuuaucaguuuucucuuuauugauuuuuuuaaagcaauuuuggcuuuucuuaugcuuauucucucuccuaaugauuuaauaauuuuuaaucagcauguuaagauuuugauuagaauuucaucaaauuuauagacuaauuuagagacaaauagugacuuuauaguaaucaacccucccagucacgaauaugguuuuguauuagguauauuuccacauauuuugcuauuuuuucucccauuuucaaaaggaucuuuauuucuccgugcauuuuacgaucggugaugggcuggugcuuaggaaagcuuugguuuuuauaaguugaucuugugucugacuggccacuuuacugaacucacauuucagacguuaugauuuuuuucauguugauuauucuggauuuccugguuggcagacaugucaucugcaacugguuuuucuguuuuuaggcuaaugcagagucaaguaaaaccuggcugaaggggaaauucacugaacucagauuacuacuugacgaagaggaagcgcuggccaagaaauucauugauaaaaacacgcagcuuacccuccagguguacagggaacaagcugacucuugcagagagcaacuugacaucaugaaugaucucuccaacagggucuggaguaucagccaggagcccgauccuguccagaggcuucagguaaugcuggggucacugcucuuacugcugccaccugccacccacacuucaucucaaguauuguggcauugagcacaguauugacacacuaagcaaguacauggacuauugucuugucaccauguagacugucuugcccccacacagguggucaagagaauauacauuguuaggaagauaauacaccucuugggcuaauuaaauaauauuaacagccaccaauuucaaaggccccuguguccugagcacuguguaguuuagcacuaauauucaccagaacucugcaaagugggcucaccccauuuuauaaacaagaaauugaggcucagugaagugacucaccuggucucacacagcagguagguagcagagcugguaucaggucuggcugucugucuaggucugucugacucuaaacccacaagggacccugccuggcccucugacuguacagucuuuuuuuuuuuuuuuuuuuuuugagauggaguuucucucuuguugcccaggccggaguacaguggugcgaucucagcucaccacaaccucugccuccuggguucaagcaguucuccuggcucagccuccugaguagcugggauuacaggcaugugccaccaugcguggcuaauuuuguauuuuuaguagagacaggguuucuccacguuggucaggcuggucuugaacuccugaccucaggugauccgcccaccucagccucccaaagugcugggauuauaggugugagccaccgcaaucagccugccuuuauagucuuaaauugagacaccccaccugaaaaggcagguguccuugcagcuacugagcacauuucaaaggcugagucacagcuggcucaaugguacuccuuggccacugggcuuuguugaggaagagucuaagaaauagccccuguggcagaucacuugaggccagaaguuugagaccagccugaccaacauggcaaaaccaccucucuacuaaaaauacaaauaucagccaggcgugauggcgugcaccugugaggcugaggugggagaaucacuugaaucggggaggcaaagauugcagugaguaacgagaucaugccacugcacuccaggccggguaacagagugagacucugucucaaaaaaaagaaaagaacuagccccagggauagucauugcuacauuuagagaaagcauguuguugaggaugguguuccugucuacuuuuuucuuuuuuuuugagacggagucuugcucugucgcccaggcuggagugcaguggugugaucucggcuuacagcaagcuccaccucccaccauucuccugccucagccucccgaguagcugggacuacaggcgccccccaccacgcccagcuaauuuuuuguauuuuuuaguagagaugggguuucaccauguuagccaggauggucuccaucuccugaccucgugauccgccccccucggccccucaaagugcugggauuacaggcgugagccaccgcacccggccgaugguguuccugucuuuagggaaccguggaagaaacuguugucuggugucaauaucccugugcagucacuucugcacuagaauugcuuuuccacuaauagagcuccuccuguuuccuucuuugccuugggaaguucagagccaaaucugcuuugacuaaccagacuaaggcuucauggcaaacacuuugugucuaauuuucucuuagcuucauuuuucucgcuauaaagaaaaaucuugccuuauuagaggaccuucacaagacacuuuaaaggcugugggacaaggcaggguacaacuaaaaguggcaccaacucuaaccacagauuaguaugggcucuggcuggaaaauaagacagacaaauaagccagucaacacaaaacccgccaagccagucuccagcuggggauuuccacucuugugucuuuauguggccucagucgguucagccugugucucauugucagcuguuugagccaaauucuggaugaaguguuuuccuaggcauaauggguguugugcuuuaagagaggcaagaugcacaaaguguuacauguaauugucucuuuuuaaauaauggucguuuuuaaggcuauggaauacaaaggaauccuuccauggagaagcaugcuauucucacaucagaaaacgguuucagggcuuugucaucuuuuuuuuucaaauucucuugggccacagcuaaugauuuuaaucauucaccguucccaccuucuauguguucauucguuuauucaucaauauguacugagccaggucacuugcuggacauuaggagcucacaguugggugggggacuugcucagaaacaguuauuuacaauacagcuuaaacaauuuuguaaauaugaagcuagcaaaauuauguccaagaaaugucugacacucucuggcugggagaaggaugcagucugggaagacuucuaggaagaggugaugguaggguugggugcuggacaaugaguaggagcacacuguauauagagaggacgcagagaggacagacaggaacuguguacaugugagagcuugacaggcuggggaaccagcuggggugcagccugacuugaggagaggugaggguauaaggguggggggauugagagacacagcuggauccauaggccauaguuaguucaugaaggccuuaugugccauggaguucagacuuuguccuguaaugagauaggagacaggaauguuuguuuguuuguuuuugagacagggucucacucuauugcccaggcuagaaugcaguggcucaaucucagcuuacugcaaccuuugccucccagguucaagggauucuccugccucagccccuggaagagcugagacgacaagcacgugccaccaugcccagcuaauuuuuguauuuuuaguagagacaguguuucaccauguuggccaggcuggucucaaacucuugaccucaagugaucugcccaccuuggccucccaaagagcugggaggugugagccacugcacccagcccaggggaguguuuugaacugagggaugaaagcauucacauggucagauuagugcuuuagaaaagucacuuuagagauagaguggaagauggacagaggaggccaggaugggaggcuggaagagaacuugggaggaggccacaauguccaggagagagaugaugguggccuggaccaagacaggggcaguggggauggggagaaacaggcaggucaagagaugccacaggaauggagauuggaauuggagaauggguaggaggaauccccagaugaugccuggguuucuggccugagagaugaagggcugggauuucuguucucugagucugcaaaggcaaaaaaguggcugugcucgguuucaugcauugauuuauuccaucauacauauguuuugagaaccugugugucaggucuggugcuagcugcuggaguuugggguuaccagguggugccauguguccucuaucgaccccucauccuacccuacucaucugcccucugagcccccucucgccuccccggagcugcucccugcccacccuggacuuccugcuagugcuuggucuccccuggccagcuccauuccagcgcucugggugugaccuuaggccugguuccccaccaaaaugagguuggacucuauagacuccuggccuccuaggcugaauggggcuugcaggccaucucacagcccccucccaauguacagcaugcugccaggugggaucugccccugcccaacagccaagugcuaggccacccucccucccuccugaggcccucaucuguccaccccuucucgggugggcagcacugccacugccagccaagccugaucaccugaggcagucaucuuccuuccaacuccuggccaggacagagcuucagaaaaugcagccaugguucuuaccugcaaacaugagaauccacuggaacuguuuuaagcaagaaaggaguuuauggaagaguaugagauagcccauaggaucuccaggagggccagagagucgggauggaagaugggcagcaggaaugaaguccagacuccagcagggguuggugccaguauaggccccacggcaccccugcugggcaagacaucaccacucacaccacugaccagagcccccaccacugcugucccucagugccacaugccaccaucacuaccuucaccgucauuuccaaauccacgcuuuggcuuggaggcgucuggucacacuccugcagcacaggugcaaagggagcugggagaggggguuuucuagcuucuccuuagugaagccacauaccacaggaaaguauugaagaggggcuguccaggugcaaaacaggacacauguccccugcgguggccacacccccucagucagcacugcagcugaaccuugcuggccuuuggcguccuucuuagaacaugguuuccugcuccaccuuugaauaagcuccaggugcuccuuccccagggagacugaccucucacccuuuuuguacccaaggcagacccguggcgcagugugugugaggcugaagccucucugggaagggccccgugucagccugacccugccuucugcaugcauagcuggcacagaguagguuucaaugaacacguaaggaaggaaggaaaggaggaaggauggagagggaggaauccccagugccagcacugaaaaaccgcaccuccgcauggcucccaccucagggaugccguauggucucuccagggcucugcuccugcaggcauggccugggcugaccauaggugccaggccaacguggagccugggcaugcugguguggguuuguuccugggugcagcacaggaggcugggaugcugccugcaucucccagagccacccucacccccgugugcccacacaggcauacacggccaccgagcaggagaugcagcagcagaugagccucggggagcugugccaucccgugccccucuccuuugagcccgucaagagcuucuuuaagggccucguggaagccguggagaguacauuacagacgccauuggacauucgccuuaaggaaaguaagucgccgagugaccaacuuuguguccuuaacuccccuaguguccuuuagcccagagacgaaugcaaagaucaucucccuacauccugucucucccacacugaggcccuuggcugggcggucaggggcuccugggccuggugcccaacccacccucaccacuucaccuccaacccuuccugagacugagaccugcccuucuccagucacacugcccugcuucugccccucagauugcuccugggagccugccacaucucagccuugcucugggcucccagcuggaaugaccaacucuuccuccuucucuuccucuggcuggggccaaggccuggcaccccuucgaggcagacuggcacagcugcgcccaccugggaagcccuuuccugccagcccagcccugacucacucucuccuuuagccaucuccccucucccuucccgcuccagggccugcccauguccugcuagagggugcucaugaaguggauacauggaccccccuccuugccccuuguaagcacgugaagggcagaaaccagcuuuagguccaacucugagguccccccagggccuggcacaaaacauguacucaaaaauaucuguucuuugauucauuuaugcauucauucauucauucaccucugcuaucaugauucauucagaacauuuaucaagccccucuuauaugccaggcauagcagggcacaaaacaaagcuccuucuccucuuuuggugcucacagucuucguaggggaagacagaccguacacaaacaugucaggugacaggaacugcuauacugcuauaaagaauaauaaaggccgggcgugguggcucacgccuguaaucccagcacuuugggaggccgagguggguggaugaugaggucaggaguuugagaccagccuggccaacauggugaaaccccaucucuacuacaaauacaaaaauuagccaggcaugguggcaugcaccuguaaucccagcuacucgggaagcugaggcaggagaauugcuugaacccgggagguggagguugcagugaguugagaucaugccacuguacuucaaccugggugacagagcaagacucugucucaaaaauaacaauaauaauaauaauaauaaaccagggcaggauggaagacaggaaagugacaaggaggaggagcuguuuuauauaagcaguugggauggccucugagaaggggacacucaagguggcccaaaggaagcauucauucugcagguucugugggucugaagggccagagagcacaguggucauaggcacggccucuggagcuaggccuccuggguuccuauccgaggucuaccacuuggaacccugcugaacccugccaucuuagacacggcuccucccuuuuccaugccucuguuucugcaucuguaaaguggagaccauaaugcagucgccucuccugggcugcugugaggauuaaaugagcucuuacacauauagcgcucaggcauauuaagcaccacguaugucuuggcgauuaugauugcugcugcuguuacgucugggggagguauucuagacagagggaaaagcaaggguggagguccugaggcgcgaugggagugagcuggccauaucgaaggagcagcaauggggacaacaggaguggacguagggucacaggggagagaggaaagagaucagaauccaaggauuuggacgugggcaacucgcagaaggaaacugucauuuucugaagugagaaagaguauuuaggacuggagggaaugaagugaaccuguuagauuugagaaguuggacuucccauguggugguaucgccucggcaguaggaccuaugauucuagaguucuggggagaggggagaggcuuuugccuugaugaaagaacaacuucagccaaauuaaauuuaaaggaguuuaaaugagcaaugaacgauucaugaauccggcagcccucugagccacagugcacucagagacuccagcacagccacgugguggaagaagauuuagggacagaaaaaggaaagcgacguacagaaaacagaagugagguacagaagcagcuggauugguuacagcucggcguucgccuaauuugaacacaauuugaacaguuggcuacaucugauuggccaaaacuuggugauuggcacaagugcaggcuacggucuguuuacaccuccacuuguuauuguucaugacguacagaaaaauauguaggccgaacuuaaaagauguaaggaggagcuuuaggcaaaacuugauuuaaacagccugcaggugggcuucccacagaucucuacaggccccugugaugagugcugggagugaugggggcggaaggcacuucugcggaggugcugagugagcugcggccccaauagcugggaaggaggcaaccugggcaaggggggaagggugugggggggcuguccaggcagagggcacagcaagugccaagggcccugggugccccugcugugcccgcuuguugggauagacuccccuccuucuuucuuucugagcacucagaccuuccugaggacucagcucuacuuucuuguuuuccaucuuuacccuggaaucugcacaucuucccugagucgccgcccauccuugaguguuggauccaguaguuguucgcgccucagcuccuccuccuauuuaggacucucccacaccagccuugucauccugggguuuuccugucccugugaauucacauaaaucccuuaaaucugccuggcucuugggcgagauuaugcgaaucuccaguugugugguauuuuuagcacgucuuauuugucugcuugcauaagcuccgggcgcucauuucucaacaauuccuuacaggcauaaacugccagcucucagacccuuccagcaccaagccagguaccuuguugaaaaccagccccucaccagagcgaucgcuauugcugaaauguaagacccccgggaguggggauaggguggagacgguggagauggugggauguuggguggaggaggaucauggaaauggaggucccucuuuuuuucucauuagaauuuauuuauuuauuuauuuuaagaacuuguuuuuuaaaaaauguuuauuauuaaaggcaauaaaacaauacauguucauuguagaaaaauuagaaaaugaaagaaaaaaguuacucauaaucccucuucugugaauaacugcuauuauuauuuguccuuuuagcuuuuuuagcacaucuaauaugcauauaaugauauauuuaauauaucuuuuuauguuacaaacguggugucauacuauacauacuguuuugucaucuguuuucauuuacugauauauuaugaacauauauauauuugggauuuauacagugagccacugugcccagcuaauauuaucacuaugugugugugugugugugaccgagucuugcucuggagugcaguggugcagucauggcucacugcagccucgaccucuugggcacaaaugauuuucccaccucagccucccucauagcugggacuaucagugugugccaccaugcccagcuaauuuuuuauuuuuaucauuguuuuuagagguugcauggcauugcauugaauggaugugucauauuuagccaaucucauaauguuggauguuuacauuuucauuucuaaaacaaugcuguaauaaacauccauucuuguacacauuuguugaauugaauuaaugaaugagagaaugaacacaccauaccucauuuucagauuauuuuuuaggaguaauuucucaaguggaauuacugggugucaaccuaaaaaagacucaaucuaaagaaggcucaguauccaguuagcagaguuuauucaagugcaaaguaaccaucaggagacagagggaaaccaaagaauggugaucacugccccugguguugggagggggacagugaauaucaaaacagaggcacugaauaaauuuacauuuuccauacaaaggcuaacauacugauuuaaaggccgagcacgguggcucacaccuguaaucccagcacuuugggaacccaaggcagguggaucacuugaggucagcaguucgagaccagccugcacaacauggugaaacccugucuccacuaaaaauacaaaaauuagcugggcaugguggcaugcaccaguaguccuagcugcucaggagacugaggcaggagaaucgcuugaacccgggaggcgaagguugcagugagccgaggucgcacuacugcacuccagccuggcaacagagcaagacuccgucuuaaaaaaaaaaaaaaaaaaaaaagugcacaaaucaaaaaugugcagaucaaucagcucaaugauuuuuuaaaaaggaaacauauuuuguaaccaccuucagaucaagaaauggaaauuuccacuccccagaagucuuccucaugugccuucuuguuuacuauccccaaaggggauccacucuccagacuucuaggacuauagguuaguuuuaccuguuuuugaacuuucaguagaucauucacacuauacccuucuguguuuugcuucuuucacucaauaugagauuuauccauuuuuguauauugacauacugaguggcuguuauaaauucacuuaguacuucuaagcuaucuacagauuauuuggguuuuuguguaaauaagcaugucaccuaugaauaauaaucuuucauuuccccgaucuuuauucuuuccuuucacuucuuuuucgugccuugaguuacugucuacuacauuuagaacauuguugaauagaagugguuauaaugagcagcauuuucucccaccuuagacauauauccaacagaaaugcauacauaugugaaucaaaagaccugcacaagaauguuaugugaccgaaacacagguucaguugcucaacgcuuugcagaguucaauuaacaagagcgaggucugguauaaagaaagugguuuuauucuaaagauuagcuuaggggaagagguacaggcuccuccugcccuuaacgguaccgccucacuuuuggggcagaaagcagaggcuuuuaaauggggacuuuguaugaauggcaugcagggaaggagcaagcagaugggggucuauaugacucauuuugaugcguuuucuaccaagugguugagcuggugccauugagggcagaacuagguuguaauguggccguugucuugagaugcuguccggguggaagaguucuguugaaggcauacuuuauguuguaaauugacuguugucucuuaaggcaaucuccuggugggagaaaguucugguucuagacccucuaaguagguagauaaguuugcccuguagggacuaucuggugaagggaagguaaugguuauaauuacauuucuaaagagcuaaguagaggcagggcacaguggcucacaccuguaaccacagcacuuugggaggcugaggcaggcggaucaccggaggucaggagaucaagaccagccuggccaacaugaugaaacccugucucuacugaaaauacaaaaauuagccaggcgugguggcaggugccuguaauccuaguuacuagggagccuuagguaggagaaucgcuugaacccaggaggccgagguugcagugagucgagaucacaccacugcacuccagcccgggcaacaagagugaaacuccaucuuaaaaaaaauaaaaauaaagagcuaaguaggaagugggagacaggagaaaaagggggaaaaucuuaaaaauaauucauucucuuucucuuagaaaaaugcucuuuuucuuagaaaacucagucucuguuacacguuuacaguuauagcaacauuagucacaauaggcaacacggaaacaauccaaauguccauggaaaacuguuuggccuuguuuaugaaagcugaauauccacauacccugugauccagacuuaaaaaacaacaacaacaacaacaaaaaaaacuucauguguacauacaugguguaaugcaaagagaaauguuaaugagaguuuaaaucacuacaaacuuuggggaggauaguuuugcaauauguaucaaagaccuuaaaaaaauacccauugacccagcaauuccuguuuuaggaguauauucuacagaagcaaucagauacguaaaaauguaauuguauuagugguuucaaaagcuuuuuaaacggaggacuaaguuaugcguccaaacaucaaaauuuuagaaucuccacuaaaaugcucuugugaaaggauauuaugaugugucaaaaugccucacaaguagaucaaucaauuuuaaaaagcagauuaccuaacgucauguauggugugacaccaauauuaagaaaagcuauaaaaauuagccgggcgugguggugggcgccuguagucccagcuacucgggaggcugaggcaggagaauggccugaaccugggaggcggagcuugcagugagcggagaucgcgccacugcacuccagccugggcaacagagcgagacuccguuucaaaaaaagaaaaaaaagaaaaagaaaagcuauaaagcagcaaggggaggggaaagauaggaaguacacacacccuaauguuaacagugauaggauuaguuuuaauuaaauuuguauuaauuggcaacaaauuucacggcacaaaauacagacaguauaagggaugugcagcagagugaucucuucuuccccuuuccccaagaccccgccccaggggcagucgcgguuuaaaggggucugucaccccuuccuugggccauuuccgcgcuucgcauuuugugauuugcacgugcguugguggguucccgggggcggggcgccgcgcuggccccgcccaccaggugcgucccuugucucgcccccugcagacgcgcgcacgcccacgcuggauccugacacgaugcacgcgcgccugcgccuguccgccgaucgccugacggugcgcugcggccugcugggcagccuggggcccgugcccgugcugcgguucgacgcgcucuggcaagugcuggcucgugacugcuucgccaccggccgccacuacugggagguugacgugcaggaggcgggcgccggcuggugggugggcgcggccuacgccucccuucggcgccgcggggccucggccgccgcccgccugggcugcaaccgccaguccuggugccucaagcgcuacgaccuugaguacugggccuuccacgacggccagcgcagccgccugcggccccgcgacgaccucgaccggcucggcgucuuccuggacuacgaggccggcguccucgccuucuacgacgugacgggcggcaugagccaccugcauaccuuccgcgccacguuccaggagccgcucuacccggcccugcggcucugggagggggccaucagcaucccccggcugcccuaggggccaggaccggcgugacagccuccagguacgccgcagcugcccagucucgccuaaucuaccuagaucagcguggcugguccccuuacugccugcuucuuagggcccucucccugccccagcuuuccccgaccaaucacgccuacagugcuuugaagguuuccucuccuaggcuaguuucaaacaggcccuaaacaagucugcugcugcccucucaucagaccuccgcacccucaccccaccaucacuuacacuacuuuaauccaguuccuucaaagugauacccccacagguaagcccucagcauccugaauacaucauccgcagccugggaaccuucucccucguacagcacaggaaccugacacauaguaggcacacaguaaacguuugugaaugaaugggagucauccaguccugacucuucugucucuugaggucccuugaaucuuccgcuuccuccccaccgauuucagcguguccacaucacagcucccuccagaagcugcaagagcuucuuagcaguuccuggucugaacccucucccaguccucaucuuccacccuaaaacuagagugaucuuccuaaaacuucacuuaaccccucagcuaugaaaaggcuuccaggaguuuccaugaaauaacaaaaaaaaauacaagcgccucaccuuagcauucaaggcuugucuagucugcccaaaauuacuuauccucaccuagcuccuaccacucuucuuagagacucuccagucagaaaugugucgcauaguuccaccuccacaccucucugcugccagcacauucaugcagaaaagucuuuucaccugucucagucuuccgcaggcuuaccugcgccaggaagucuaaccaaggaacaagaaucucacuaucagagccacaaaucugggaccugucuuuccaacuaaauuggaggcuuuggaagggcagcuuuguccuauacucucuccacccugaaaaguucccagaaagccccuucccucccaagcagugaauuaauaaccagcaggugccuaucacugaguaacagaagagcugaguuaggcgggccucacaggucacccagccagaucucaucuggggagucugagguccugaaagaaagcagagcugcguaaaguuaccccggggugauauaggggggccagacgugugccccguucacccacccccaggcaagcaucugaccuguccccuggcccagcccuuaggcccagcuuucaaccugcuuacucauuucucaggggauuuugggaaggaaucagcaggugacaguugcuaagcaaccaaagggggugguguuucccaacugucuugggacaaaaaggguaagagcacccuuagauccagauguugccaaggaaacccagagugcccagcugucuggaaugaagugacagagguagaaaacaguaggcccucacaggaggccaccuucgcuagcagggagugggaggcuucuuuccagggauuugugucuccguucugaagguucugcguccuguuuugucaauucccuagacgguuuugaaguuauauucuguuaaagcaucuucauaggugcuuggugggaggccaaggucgccgaauccucgugguuuaaauagacuuucagugcauuaguuugaaccauauaaaacugacaauuuucaauaguuuuugaguuaaaaauggcacuuuugauaugagacaauguagcagaauaccaggcagacagaaccuugcaaacaccuuaacuucuaaccaaagacuuuaaaacucuggcuggacagaguuuuaagcacuaugcugcaggaauccugagaaaaaggggaaauuaauucuauuaggaauggcccaaacugaauugugacaggcagaggguguuccugacagagggaagaugaauacacuugaccccaacauuucugcccaucccugaugaccaagaccucuucccagacccacagcugcaggggccaaguaauaacagcucuuaauaguuuauaaugcacuguuuuaaugcuuuacgacuaaacucaucugauccuuucaucagcccuagaggguagaaaguuuucccaauucuacacauggcaaaauggagacccagagucacuugcccaaggucgcacagcuagugguggagcuggagucugggcccaggcugugaguuccaggucugugcucauggccaccaggcccuacugcucagggugaaugcagcuggucucuggccagugccuggugcucuggccccucucguggagcuacugcccaugaugcuuuccuagugccugguuacucugcgagacuugagucuaccuuuggacugccuuccuugggggucugagaugaggccuuauggcccagaggggaacuugauucaaaaauuugggauucauguagcagagacagagcuagacuguaaaggucacaaacuagcugugucaaggcccgugauagccagaaagcggcaguuucaguccauaucaauugugugaccagggcuagucacuuuuuacuucucagugccaucuauaaaauggggauaauagcacuaccuaccaagugcugugaggcucaaaugagccaaagguuauaaacuugccuuaaaacuauaguccuauacaaaaauuagcugggcgugguggugcaugccuguaaucccagcuacuagggaggcugaggcaagagaguugcuugaacccaggaggcggagauugcagugagcugagauugcaccacugcacuccagccuggggacagagcaagacucuugucucaaaaaaaacaaaaaaaacauauauacugcuguaucaugccaggauuuaucagcauucccaagggagcuugcacgguacugaccgagugcugagacuacugguauucccagcugccauguggcagcagcaggagcuacuagaauauucucagcacaggaaugaggcuuccuugguuuccaugucuguaaggguuacugaucacuuaccuucuucucuuucagacuugaaucuguagacauuucuuuauugauauggcaaauugcuugcagauauuuuuaaaugacagcaauuuucuaauauuugguuuaauaaaaugugaauaaugucccuuuuaaccauggucuucacugggaguucauguugcuucaagucccuagcacccagugauacccccacagguaagcccucagcauccugaauacaucauccgcagccugggaaccuucucccucguacagcacaggaaccugacacauaguaggcacacaguaaacauuugugaaugaaugggagucauccaguccugacucuucugucucuugaggucccuugaaucuuccgcuuccuccccaccgauuucagcguguccacaucacagcucccuccaguucauguugcuucaagucccuagcacccagacccagaagggccuuuacucauaucuuauuccuuacgcagccuucugguaguagucagcugcucccugauuaacuaucuccagggauggggcauucacugcuucugaagauaacucauuaaaguucucacuuacguguaaacaaacccugacucccaccuguucccauccaagaucguauuauagcuugaacuccuggucucaagcaauccucccaccucagccuccuaaguaguugggauuacaggcucacacaagcacgccuggcucacauaccaccuucuaacauauugugugacugaaucacuaugcuauggauuuuuaugcaucugcccccaucugaauggaaguucucugaggaagggauuggggcuuguucauggccauauacucugugccuaaagcagugccuggcacaaagauggcccucaauauuuguucagagaaggaacacaugccauuucccucucuuugcucugaaaggagugcuuucagcauuuucugccuacaagauccuuugaccaguccuuucucugauguggagugacugcuauacaaugccaacuaaacacagaggccaagggcaggaaagggauaaagacaauggagaaguaaagggcuguaaggaagugagaaugaaggcuuaaaggaaaggacaugugcagccagcucucaccccucucugcagccacccagcaacuggaggauauggacuuuguuuggaaccaccccuucuucuggugcucuguuuauaaugcacuguuggccagugcacuaagcuggccaacuugaaggagagauugcaucacuggaucuuuuucugucuccagugggcugacacagggccuagcccagaaacaucugcugucuaaggagcagguggagguggaugacagccaggucccuggagaccgccauuccugcccucgccucacucaaacacaccugacagcaucagcaagggaacugagaauucagagaauggcacuuuauuuuuaagacuugauuuuuuugccaugauuaucuaccaauucuuccaugauggugucauccucuucaacagugaccaggaccuucuugcccacuagauuaaagaugucuucaggaggauagccuuugggcucacccaccuucacggugagcauguccauuguuagaauggugccuuccggaauuuucacuuuggccaccacagacuugcccagcuguggacaaaaugaacauucagugccagcuucacagaaguaacuagugcacacuacuuuacuuuacacucaaggucccugaucagucuuccccaggcaguaccuugggagcaggcacucuguugcccccuacacugcucagaauaucucauacauggcaggaauucaaccaguauagauugaauucagagacucagaggaggagccuuuacaacaaagugcaaaggaaagggcugaggcuauguaggcggagccagguucaaaucccagucugugggguauaggccacguuuuaguuucucugucaaauggaaacuuauccugucagaugacuguaaggauuggugauauuacagaauguacguggaacauagaaugcucucaauacaugcaaacucugauucuuuugguuaccauucagcucaguaucucauuguaaacauggggaaacugaggcccauacagggugggugacuuggccaggguugcagacagccaagaugaaacauaacauagggaugagauucuuaacuccugacacaccguucuccagggcacacaccuuaccgccacuuuguuugguaaaauagaaauaugaaggacucauaagauggugaauguggcuguuaugcagauggcaagaaaaggagcccccgaggaaggggcagauaauacaggcagaugagggaaugaaggguaccugaagcucaugaccaguguuugucuucucuauaaaugcuuucaaauaaauuacguguuuuauuacucuauauccuccacguaagaguacaaggaaucaauucugcuuggaauguggugccaggaaaaaaugucaagugauaaucaugcauccuguuauguuuuacugucugcucagagagccaaauuaagugcucagcuguuauaaaucuuacucugguuucuggucuaauucucuccuguuuccucuauaaagaaacuauuucuuuuuacuuuauuuuaauuuccugguauagaugcaucuuugauuuggggaagcagguaggccccacuagaauaaaaggugacaacagucccaggcaugccugguguuuggucuuugccuugaccccgacagccuacagguuaggugugugugugccuggcagccccaggaugccugccuggcucuaugacucagaaggcaagaagguccaggccacggcuuccaggaagcccugauagucagcaugccaggcagugcuucuaggcccaccaguuccucugucugaaggucacuguugcacaaggaauagcugcaucaucacccacccaccucugcaacgacucacugcccuucccaccagugccacccuggcuuaggaaaugccacaggcucuucugguaccucagggaacaccgugccuaaauguuucucagggcuuaccugcuccaagggagcccagacuugacuuauuccagggccucacuccuguuacauauucuggagucuaggaguacuggggccaugggcuucagagaauuaguggaagacucuaaugugacccuagguggccagagaaacugcuaaaguuagauaacaugugucuccugcugcugcuacaggccagagugacaugcauuacugaagagaagccugaagaagcugacacgggugggagcacauucacugaucauuucaucagccuggcucagggagggcugguccugaccaucccucucaggccagccuauccuuuuuccacacacggcagcagaaccgaguagaguccggcaggacacaccuucucauugcaggccaucucacagggcagcagcugcuugguuggggagcccagggcacgcuccacaagacgcacugaccgcaccagcucggccaguucuccaggcuccagcgaggccgaguggucacuccccuuccaggucuuguccaaaguuaugugacguuccaacaccuuggcccccagagccacugcggccacagauaucgcuaugccuguuucaugcccagaauacccuaugggaaugucaggaaagagcuucugauauuccuuuaaaauggaaaaagaaaaauaacauuaaauaucaugcugcuuuaugcauauucuccaggugaagcguaucugguugagccccgguuuagccacucacuagcugugcagccaggggcaagauacugaggcucucugagccucucuuuccuagggaugauaauaauaccugcugaguguugcuguaaaugcaugagaagcacucagcacauuguaaaugcucuaaaaaugguuacuguuauucuaaagaaugcauuuuaagaauguuucacauugcacaauacaccaagaguaacaacagaacuauaaaugaaugucuaaccucauucaaaaaccaucugucacauuuaauuagccugagcugcugaaagcaagugugcuauaugcacaaauaucaucaauaauauacacagcccaaucucaaaacaauccuuuggugaaaaugauaaauaauuaauccguuaucuauaauucacugaaugcaacaaaagacacucuaagaugggugagucuuguuggugagggugaccagaaagcugaguacaguagaaagacucagguagcguguauuauuauuuuauuguuauuuauuauuucuuuuugaaacagagucuugcucugucaccaaggcuggagugcaauggcgugaucucagcucacugcaaccucugccuccuggguucaagcgauucuccugccucagccuccugagcagcugggacuaugggugcccgccaccacgcccagcuaauuuuuguauuuuuaguagagacaggguuucgccacauuggccaggcuggucucaagcuccuggccucaagcgguccaccugccucagccucccaaagugcugggacuacuggcaugagccacggugucuggccucaggugggauuuaacaaaagauuaggaggguuagguggcaaaggccuugaaaaccaggcuuaagggugugugauggagugcggguugcuacaaguuugaaaauucaaaccacuguacuaugugcaggcccaagaugggauaggcuggcagaauaacuccugcaauguguagugucaagagagaggacaugacagcaccuugaguggggacggagauacacugaaaaggaaaauagcuggggucacgucuacuaaacuguuaauuaucggaaucucugugggaugggagugcaggggauguuuacuuucgacauuacauauuucacagaaaucauuuuuaaauuuuaaaaauaacgugauuuagauaagcuguaagugaagcaaaaacaggauugggagggacagaaaguuuagguaaaaagagaguaaugucaguuuucaaaaaggcuaacuuuuuaaguuaauggcuguauaacaacauguaagaaagcuuauauuauggggaaaacaaugucaaauacuauacugaaaggaaaauauaaaaggaaaacaacugcaauaucaggauucuaguauguguggauagauagauagaauuccauuaauguuacuauaauaguuuuaaugauaauuacauacauauuuucgaauaaaguuaaauuuccagugcuacaggaagaacugagagagauggcgugagacaguaagagacaaaggccuagggggacaugcccagguucuaguuccagcuuugccaccaagcugcugugggaucucaggcuucccgacuugggacuggauuucaccaucugugaaaugacugaguaggcaaaaucgugggagagaguaauuuccaucaaggcugucacuauaacuaguaugagccucagggaugcucagcauuagaaaauaagagagucagcaaauaaagcagaaaaagccaggaaguuucaagaaggccuccuauaacucaguaugaaaaaagaugaauauuuaucuguacgcuaguguucauagcagcaucauucacaauagccaaaagguaaaaucaucccaaaugucuguugacagacagacuuuuuuuuuuuuuuuuuucccccugagagucucacucugucacccaggcuugagugcaguggugcaaucucggcucacugcaaccucugccuccugaauucaagcgauucuccugccucagccuccugaguagcugggaccacaggcacgcaucaccaugccugacuaauuuuuauauuuuuaauaagaagggguuucaccauguuggccaggcuagucucgaacuccugaccucaggugaucugcccaccucgaccucccaaagugcugggauuacaggcaugacccaccgcgccuggccaagaaaauuucauuuacagucacccucuuuagaauguaugugcuuccucaacugcuuagcucgaauuugauuugguaacagcaagacugucaaaggauguucaaauuauaaaguaugccauguuuguuagaauuuugguuauaaaaaagacuacgccuuccccauaguaaauggcccaagaagggaacccccucccuccugcucaccgagaugacccgcagguugacguccucaggcuggagcggguaugcgcugguacacugcaagaagcagaaguugggguugaggggcuucacgaucugauaaacuugcuucaugguguccauugacugcaucccacuggagaucaccauugggcgaccugaguaauccagcaccaacaccaucagcacuuucucuuuagagguucugacucuccccaacacaucccaacugcuggucucaucauucaacugaacuccacagacaucucuuaaaacacugugccagccccugugggggaacagagaggagcuuguuggguuccugcccucggccacaggaaaggugggcuccccucugccccccgacaguguucuugagcaaaaggaacugaauuaaagaggcagaggaauuucacacugccaagaggaaaaugaguaucuuaucugauuaauagguuguauaccauggcaguacaguagaaugagugcugauucaagagugugaaugaaugugagguguggagcugccacuucuagcugugccugggcagaguacuguccgucucugagucucagaggccuccccugugaaauaaguaucaagcaucauaaucaugaccuguuucaguccuaggaguguuaugaggaucaaaugaaauuguucauguuguaaaaccacuuuacacgaucaugucccacugcggucucaaacucaagcaauccuccuaccucagccucccgaguagcuggggccacaguaaugcaccaccauacccagcuagguuuuauauauacugucauauccuuaauuucuuauaaauuuuaguuaaaaaauuuucuaggacaggugcaguggcucacaccuguaaucccaacacuuugggaggcugaaguaggaggaucacuugaauccaggaguucaagaccaaccugggcaacauagacagaccuugucucuauuaaaaaaaaaaaaaaauucuuaaaaagaauuucuaaaugucuuauaaaaacugucauauucuuaauucauuuucuuucaaauuagcuuacaaaaaauggaaguacaggcugauugaaaagagguuucuggcagggcacaguggcucaugccuguaauccuagcacuuugggaggucgagaugggaggauugcuuuaggccaggaguucaagaccaaccuggccaacacagcgagacccuaucucuauuuaaaaaaaugaaaagaggcuaaaauuugucuucaugaaaucugcugaaagugggccaccaugaggggaguaaaaauaugaagguuuggacucccuucgauuuuaagucaaaaauuagacacuuaccuuuuuuggcugucuuuuccagauaaggaaaauuauuagugucuccagauccaacuuugaaaaauggaacauucaguucaugcaggaauucaacugccaucuacaaaaaucaaagagggagcuccuuuucaccauuguccaaaaacacuguuguuaugacaggcaaggaauaacauacaaguagaaaaaccccucaucuuaggcaguagagggacgcucagcaacuugaaagcaggcaaagauuuguucucagucauuucauucaaaugcaaacauucauuugcauccacccauccauuagcccaacaaacguuuggugcuggucuuugcuggcuacaggaaucuggaaaagggcugggcgugguggcucaugccugcacuuugggaggccgaggcgggcagaucaccugaggucaggaguuugagacuagccugaccaacauggugaaaccccgucucuacuaaaaauauaaaaauuagccgggugugguggcgggcaccugugaucccagcuacucagaaggcugaggcaggagaaucacuugaaccugggaggcggagguugcagugagcugagaucaugccacugcacuccagccugggccacagagcgagacuccaucucaaaaaaaaaaaagaaucuggaaaagaaccuuuccccuggccagacccuaccugccccaggggcccaaggccaaaugaacaaacaugaaacggucaugaccuaauccugacccagaaaaccaggcagugaaaacaugaauagccucaaaggcuuucccuucuacucggccaaacgagcaggaaaaggggcuauuucaauucuuggcgaaagggggaaaauggagcauuuuuuugcccagccucuacauaaggauccauggcuggcagggcccauucaacccgagcccuuucaggccucaaagcacgcugccuacuuaaaagugaaccucagucacuuuuuucagauauaacgucacugcuugagguuaccuauuuagugcucuucaacauccuucucuaguauucaucaacaagacucaggaaauugguaaaugucagcaaaugcuugcugaaggaaucaguggaucacaaguuauaagaguaaaaucucaguuugcugucaaauuauaagaacucaaaaacuuuuuauuaucauuucuuuccagcuucaguaagguguaauugauauacuaaaaacugcacauaauguaauuuggugaguugggacuuaaguauacacuacugcuaccaucagcacaagaguaauaaacauacacaucaccuucaaaaguuuucuugagucccuuuguuuuguuuugaaguuggaaaucaaaagucgaaaaaaucaaugucucugaauggugacucagaaauaaguuagggcuuagugaguugcucacacuugaucacaugggcacaaaucuuucccucucccagggaaguugcugaaaugaaaugcaaacucugauuggucuaggaccgacggaccgacggaccaaccaaccuaccucccuuccugucuccuucccucccucccuuccuuccucccucccucccuuuccucccuuuccuuccucccuuuccuucccucccucucucccuuuccuuccucccucccucccaccguuuccuuccuuuccucccuuccuucaccuuucucacugcucuuccucugcuuuauuuuuaacucuucucuuuuccccuuccaucuuuuucuuuucuuuugugguagagacggggucuugcuauguugcccagacuggucucaaacuccuggggucaagcaauccuccugccucagucucccaaguagcugggaccacaagcacgugccaccacauguggcuaauuuuuuuuuuuuuuuaauuugcuguggagauggggucuugcuauguugcccgggcuguucucaaacuccugaccucaagcaguugucccacccuggccucccacagugcugggguugcaagcuucagcugccaugcccaguaccuuccauaccuuuccaccucacuccuuccuguuugugucucauaacacugcuaacuagcccuaagacagaacugaaaaaacaucaguuuuaaauauauuuuuucaauaaaaucuaauuuuccuacccuucucacuucauuuggcagaugaagagagugcuuucuguuuaaagaaggaaccuuccacugaguuuucuuuuguauaauguucaucuugugggagugugguguggcccaccagggcauaaacagaagcagaaacccccccaagagaggggcagagcgaucggggcaaggaggggggacaagugcagaaaaacaccuugugaaagcuuaccuacagaggcuguaaaaucugcauggaauucuguaauuuucaaguaaagaaaaaggccaauuccugcuggaaagggaaggggcgccucauuuugccgccuccuggggagccagcgccacccaguggacauuuagaaaacugccacucagagccaucgggcaaagggaaucugaguaaucuggaagauccuaacuuucagcccuaagacaguaucgcugugccuaggggcuacuacaggcugggucagcaacuggugaccccuuucucuucagggacuccuugacuuccccuagccugccgaccgugcuaucggguucccucuaucugggguuccaugcagcccggcagccucagcacuccucucucccuccugccccauagcacaaagucugugggagucugaagggagcucaggcauguacaacucuccucgggcucccagcugaguucaacaugcagaaaugggucccauggauagccucguuugggagaaacacuacccugccuuaaugccuucuuagagggucccaguaaaucaacuuagcugaguuccaaacccaguguuucccaaacuuauucgacucagaacuuuauuaauucuggccaggcaugguagcccaugccuguaaucccagcacuuugggaggccaaggcaggaggaucauuuuagcccaggaguuugacaccagccuaggcaacauggcgaaaucccguuucuacaaaacauauaaaaauuagccggguguguggugugugccugcagucccagcuacucaggaggcugaagugggaggauugcuugaacccaggagguugaggcugcacugagcugaggucgugucacugcacuccagccugggugacaaaacaaaaaauaaaccaaaaaacccuuuauugauucuaaaucaauuaaugaaugaggguggacaacacgugcccacagaaccccauuucuguacuguguccugugggacacucugggaacugcugaucugagucagggguaaggaaagagaggaguggagcugagauuuuucuaaagucccuuccucuccccucagguuuuggauccuucaggauuggaaaaaaaaaaaaagaagcccaggccaggcgcgguggcucacgccuguaaucccagcacuuugggaggccguggcgggcagaucacgaggucaggaguuugacaccagccuggccaacauggugaaaccccgccucuacuaaaaauacaaaaauuagcccggcguguuggugugugucuguaaucccagcuacucgggaggcuaaggcaggacaauuacuugaaccugggagguggagguugcagugagccaagagcaugccauugcacuccagccugggugacagagcaagacuccgucucaaaaaaaaaaaaaaaaaaaaaaaaaaaaaaagcccauggugaugagcuggggagaacagggagucaggggaaggguguagccacaaauaggcugggccagccucagggcagcagccugucagagggcaccgugccuaggacagaggcaggugcuggagggaagggcggcuuugcugggauggccacugugugugaggagagcaugucccucaggagucaccuuuuuggucauggcuuccauuugccuucucaauagaacuuuccuuuuagacuaaagacauucugcuguuucaccugaguuccacagccuuggugcaacuuucaaccagaagcccugacgguuuucuuggccuuaauaaaauucugccacaccuuaaccuuuccucagcacacagagaacgcccuagaacagcauacaguguggagaaaauaugcauucaauaaaugccuguuucuauaaggaaguuaggguagguaaacacugggagccacuugcuagguaaauacagaacaaggaaccaaucuaccuccaacaguuugacagagggcaagguaaauuaacucucguaaaggcucuuaaagaaugcacuuuccugccgggcacgguggcucccgccuauaaucccagcacuuugggaggccgagguggguggaucaugaggucaggaguucaagaccacccuggccaacauggugaaacucugucucuacuaaaaauacaaaaauuagcugggcaugguagcgggcaccuguagucccagcuacucgggaggcugaggcagagaacugcuugaacccgugagguggagguugcagugagcagagauugcgcaacugcacuccagcuugggcgacacagcgagacuccgucucaaaaaaaaaaaaaaaaugcacuuucccucacugccugugcccuaggucaggcaggggacuagcuggggacaaaaggcauuccucauccagaggaaccuaccugcccaaauaggcugaggcagaaaaacuccaaaggguucugagucacagaacagccaucgcugggugaguguagaccuggcccugugcuggcaccccacggguuuagcucccugaauccuccagauagccccaggagcaucuuaacaauccuguuuuuacagacgggggccacugcggcuccaagguuacaugaggagcccaagccacacagagugugagcaccaggagcugagcucagagagccugacucuaaaacacccaucacagacaccaagcaaaugggcugccuggggagcagagggaaggaaaaccaaggaggaagccccgcugcaaacaccagacuccucccuaucacccaacugcuccggguucucaaccgaugccaccugcagggcacggccuaaagaagugacuccgccuuggcagccucacgggcaaggaggcaccuuucuccuaggucagauccaggagcucagggagcuugcauuuccaggaaacguggacggaagcagaaaaguccccaauccaggugcaagucaccuugaugacaucuucccugguucugcgcugacucaggacaucagaauagagagaaccacuggaugguagcuuggucacacacggaaaaugaaaugguggcccaggcagggaaggggcucaccaaggucacacugagaguuaaggacaaagccaggacaaguacccagaugucccagccugcaaguacccagauguccuagcccuuagcccagguugcuuuccuuaauuguaacugauauucacugaauacugauuguguacuaugcuuuauauuaacgaucacauuuaaucuucacuuucccucccagauggguucugcuaggaagcccacuuuacaacugaagaaaacaggcacaaaaagguuaaauaaccuccacauggauauaccaaaaauaacaggcagagccauauucaaacuuaaaaucugacccuagaguccauucacuuggccacugggccauauagcccggguaugggccacacagcaggguguguaccacagagcuggggugugcaucauacagucggggguauguaccauacagcugagguguguaccauacagucgugccaucauauagccagguacacaccacacagcugggguauguguauacagcauucagcauggagucccaaauguuuucaucuucaaauucuuaaaaauuacuaaggaggccaagugcaguggcucacaccuguaauccuagcacuuugggaggccgaggugggagacuguuugaggcccagaguuuaagaccagccugggcaacauagggagaccccaucucuacaaaaaaauuuagaaauuagcugguugugguggcauggaccuguagucccagcuacuaagaaggcugaggugggaggaucgcuugagccugggccgucaaggcugcggugagcuaugagcuaugauugugcugcuacucuccagccugggcaacagagugagacccugucucaaaaaaaaaaaaaaauuacuaaagagucugcagaucuuuuuuauuuuuauuuuuugaugugguuuuauuuauucguauuugcugaauuaaaaauuaaaauugugaccaggcgcgauggcucaugccuguaaucccagcacuuugggaggacaaggugggcggaucaccugaggucgggaguuugagaccagccuggccaaaugguaaaaccucaucucuacuaaaaauacaaaaauuagucgggugugguggcggguaccuauaauccuagcuacucaggaggcugaggcacaagaaucucuugaacccaggaggcagaaguugcagugagccaagaucacgccauugcacuccggccuggccaacagagugaaauaaauaaauaaaauaaaaauuuaaaaugaaagcugggcacgguggcucacaccugcaaucccagcacuuugggaggcugaggcaggcagaucaccugaggucaggaguucaagaccagccuggucaacauggugaaaccccgucucuacuaaaaauacaaaaauuagcugggcaugguggcauacaccuguagucccagcuacuugggaggcugaagcaggagaacugcuugaaccugggaggcgaagguuacagugagccacaaucgugccacugcacuccagccugcgugacagcaagacucugucucaaaaaauaaaauauaaaauaaaauagaggaaucuuuucuuaauuuuaaacuuugaauuuugagauaaugguagauucaggugcaacuguaagaaagaacacagagagauacuauauacucuucccccaguuucccccaaugguaaugucuuguaaaacuauaguacaauaccacaacugggugaaugacauugacaaagucaaccaaucuuauucagauuucaccauuucuacaaguauucauuucugugugccuauauuuaauuauaugcaauuuuaccccaugcacagacucaugugagcacugccacggucaccauacagaagguaccaugaugccacugcuacaaggaucuuucaugucaccccuuuauaaccacauccccuuccccuuacuaaccuuuggcaacuacucaucuguucuccacugucauaauucuguuauuuccagaaugucauggaagcagaaucguacaguauguucccuucugcauaugcugcuuucucacucagcaucauuuccuugagaugcauccaggcugcugcacgcaucaauaguucauuccuggcugggcgcgguggcucacgccuguaaucccagcgcuuugggaggccgauguggguggaucacaaggucaggaguuugagacuagccuggccaagauggugaaaccccaucucugcaaaaaauacaaaaauuagccgggcaccauggcaugugccuguaaucccugcuacucaggaggcugaggaaggagaaucacuugaacccgggcagcggagguugcagugagccgagaucacaccacugcacuccagccugggcaauagagugagacuccguuucaaaaa

SEQ ID NO: 192889 - RNA, 21629 nt, Homo sapiens
uucaguagccacuuucaugccaacucuuuauuuccauaauagaaaaucuuuuauuuccaccuuuaguguucccugcuagaauagaugaccacaaaacccaggccagaaacguucuggucugccgugaacaguccaggaggcacuuguucugcugcuguggaagucgcccugacucggggaggaagggacacgcaggugguaucagucuugcucaaguaaacaggcuguuuuccaaacauugugacuuggcuacugaguggggauaccugguuucauuggcaaucuuccaguaucucucucgcaaaaggaacgcugcacuuuuugguugucucugccgagugaagauccccuuuuuauuccccagcacucucgucggugcuacaaaaaaaaaaaaaagacacaaagcgauucagaugucuucugaugggucaaguuagaaccagucuggagcuaagguaggcacuaaauagaaaugucuuuuuuuuucuuuuuucucccuguugcccaggcuggaaugcggugacacaaucauagcucacugcagccucaaccuccugggcucaggcaauccuccugccucagccucuccagcaccaccaugcccgguaaucuuuuauuuuuauuuuuuaguaaagacaaggucucauuauguuguccaggcuggucucaaacuacugggcucaagcaaucugcccuccuuagccucccuaaagugcugggauuauaagcacaagccaccaugcucagccaaauguccucuuacaguuucaggaugcuugcucugaagugacaauuuauggguugaaauauuuaaauaccacugcucugcccaaacacccagguucccugguguguuaauuucuaguuuucuagucuguuaggggaaaaaaacccaaaacaguggccaggugugguggccaacgccuguaaucccagugcuuugggaggcugaggcagguggaucaccugaggucaggaguucaagaucagccuggccaacaugaggaaacccgccucuauuaaaaauacaaaaacuggcugggcacauuggcucaugccuguaaucccagcacucugggaggacaaagcaggcggaucacaaggucaggagauuaagaccagccuggacaauauggugaaaccucaucucuacuaaaaauacaaaaauuauacaggcaugguggugggugccuguggucccagcuacucaggaggcuggggcaggagaaucgcuugaacccaggacgcagagguugcagugagcugagauugugccacugcacuccagccugggcgacagagugagacuccaucuccaaaaaaaaaaaaagcacuaaaaguuuaucuuuuauuugcaaacuaagguuuacaugcuggguacccagcugucugguaacuggguaggcagagggcuagggguaucugggacaguuacccuugaaaagccuugggccuuucugaagagauagcgccuagugggagccaggguccugaccagccacaggucccugcgugggaccuacucauggaguucaaaguccgccggggcugacguccagcuuggcagcacccaccacugguggucauuaggccugagcugagccugguggaggagcacagcuggcaacgaccugucagggcugugcucucaggacauucucuguccccaguaagaccaccacuaaauggaaauguuaaauggaaagggggcuuuccccaccaaaagguucaagacuguuucuuccauaagugaacacaggcaucgccaaguacuucaucaaaugcagcccuuacgacaccaacaaggagguggcauuauccccacuggacaggcuuaugaaaagcuuaggugacuugcccaacgugaugcagcucauuucuuuuuucuuuuuaagaccgaguuucagcuggccaugguggcucaugccuguaaucccagcacuuugggaggcccagaugugcggaucaccugaggucgguaguucaagcccagccugaccaacauggagaaaccccgucucuacuaaaaauacaaaauuagccgggugugguggcgcaugccugcaaucccaguuaaucgggaggcugaggcaggagaauugcuugaaccugggagguggagguugcaguaggcugagauagcgccacugcacuccagccugggaaacgagcaaaacuccgucucaaaaaaaaaaaagagucucacucuauugcucaagcuggaguacagugcugugaucuuagcucauugcaaccuccaucucccagguucaacagauucucaugccucagucucccaaguggcuggcauuacaggcaugcgcuaccacacccggcuaauuuuguauuuuuaguagagaugggguuucuccauguuggccaugcuggucucaaacuccugaccucaggugaucuguccaccuuggccucccaaagugcugggaucacaggcuugagccacugcgcccagccugcagcucauuucuuaccgcauaaagccucgcaccucuccacaaaacugccaucagggauguccccagaaaccauuuaucacaggugccacgcagaggacagcuuccuguucuccuuuucccuuuaccucuuccuucucaccucaucuuguucauucauucauccguauuccauucucacucuuacgcuuuaccuuucaaaggccugucuuucccuguaaguaauguauuauaauucccaccauuaccacaugcuucuccaacccaccaaacugcuaucuucaguuuaugguaaguccauaaacuaagaagaaaugggacacauucauugcgaacuuggcagccccucauccauccucacaagacaccgcagauguuauucucuuugaagaccaaucuuguguuuuaaagacaagucucacucuguuguccaggcucuugugcaguggugcaaucauaguucacugcagccuccaacuccugugcucagguuauccgccugccucagccucccaagcagcugagacuacaggcacacaccaccacgccuagcuaaucuguuuauuuuuuguagagauggggucuugcuaugcugaacaggcuggucuugaacuccuggccucaagcgauccucccacccugaccucccaaagugcugggauuacaggcgugagccacuacaccuggccugaagacuuguaaaugcugccaaauucaagaugcguugaaacucaccuguauuugauaagccugcuuuucgcaaguaauauacaacagacugaaauaccuuaaguuucucaggcuuuguacccuucuauggaauaaugaguguaucccaaaaguaaauccaugaugaggucccguuuuucguuccuccuuggcuacaaaauagacaaggaaaaggcaagccagccauuuccgauucacuauagcugacucuccuguuugcuuuuugaccguauuugggaggcgggggccugauugcuuuccuacuuccuaaacacaacuuacuuuuccuagaaaauucucaacgcaaccuacauggauuaaaccagcuuccccaacuuuguuuccaauauucuuacaauugaaauggccagaauuggaaaggcaaccugaaaaaaugaggacggguacguuaucccaugagccaaacugccacuuacacuguucagucaugaaaucggcaaaauuccaaaugagcucuccaaccacguauuuucugcguuuuugauccagacccagaugguacugcucuagcagacuuuucugguacucuucagugaacaucagagguggauccuaggauucaaggcaaagagaauguaagagucagaacuggcagaauuguaaauguuagauaaaaauaaagauccacuugauggugaccaaaauaucugucuucacagggggcuauagugacugcaggacucacugaugcugggguaaagacagccagggaaugauguaacccagaauaaaaaaggagguuuaaaaaaaaaaacaaccuuaaugagcagcugcuuuauuuauaaacguaauuugacauucguuucacauuacuuuuccaccucuaucugcugguacagucuuaaggcuaaacuacacuacaggcaaaaauaugucuuucagucaggugcaguggcucaugucugucaucccagcaauuugggaggcugaggugggaggacugcuugagcccagguguucaagaccagccugggcaacauagcaagaccccaucucuacaaaaaguacaaaaauuagccaagccuaguggcacacaucuguggucccagcuacuugggaggcugagguuggaggacugcuugagccccagagaucaaagcgacagugagcuguguucacaccacugcacuccaguuugggugacacagugagacccugucucuaauaaauauauauauauauauaaaaauuaaauuaaauuaaacucaaccaaaccaggcugggcaugguaccucaggucuguaaugccagcacuuuuggaggucgagacaggaggaucacuucagcccaggauuucaagacuagucuaggcaacacagugagacccagucucuacaaaaagucaaaauauuagccaggugugguggcgcacgccugcaguucaagcuacuuggggcuaaggagggaggaucgcuugagcccaggagguugagcagugagcugugauuaugccacugcacuccagccugggcaacagagugaggcugucucaaaaaaauuuauuuaauuaaacuaaaucaauucaguuauccuagucauauaucaagaccucaguagccauguguagcuaguguguaccauuucagacagugcaaauauagaacauuuccaucauugcaaguuuguuuuuuuuuauuuuuugaaacaaggucucacucugucacccaggugggaguacaguggugcaaucauagcugaaugcagccuugaccuacugggcucaaacaauccucccaccucagccucccaaguggcuuggacuacaagcacucauaaccaugcccaacuaauuuuaaauuuuuuguagagauggggucuauguugcacagacuggucucaaacuccugggcucaagagauccucugaccuuggccucccaaagugccagcauuccaggugugagccaccaugcccagcacugcagagguucuaucagcacugaccuagacccucucaagaguuucuuaagaauucagagcuagggcuuggcacgguggcucaugccuguaaucccagcacuuugggaggccaaggcgggcggaucacuugaggucaggaguucaagaccagccugaccaacauggugaaaccucaucucuacuaaaaauacaaaaugaggugggcgugguggcgcaugccuguaaucccagcuacucgggaggcugaggcaugagaaucgcuugaaccagggagguggacauugcagugagccgagaucgcgccacugcacuccagccuaggcaacgagagcgaaacucugugucaaaaaaaaaaaaagaauucagagcugguuaccuuuucaaagaggaugcgcaagcaaauauauccaagagccacuuccccuacuugacuaguuugcagaaguggcauucuguaagcacgauaaauuuaagggugcaaacagaacagcgcaguccacuguggguggcuguucccugugugucaaccaggagcugugacaaacaagugugagcuggcuggggugggaaugaggggcuggaugggguucaggaauccacaggaaaaaaaaaaccucacaagacaaaccaacauaucuuuggugaggaggacaaaaaaaugagauagauuaaaaaaaugacgacaggcugggcauggugucucaugccuggauucccagcacuuugggagucugaggcaggacaaucacguaaggccaggaguucuagaccagccugauagacuccaucuuuacaaaaaaauuuaaaaauaggcugcacauggugguucaugccugucgucccagcuacucaggaggcugagguggaagaauuacuucagcccuuuaguucaaggcugcagugagcuaugaugacaccacugcacuccagccugggcaacacaacaagacccugaaaaaaagaaaaagaaaaaaaggcuagcacaguggaucaugccuguaauuccagcacuuuuggaggccaaggcaggaagaucaauugaguccaggaguuugagaccagccuggacaacauagcaagacccuauaucuaaaauaugaaaauuaagaaaaaggauauuuuaguuggugauuauggugccaacaugggcauuccaggcagaagaaacagcucaagcaagagcaggagagcaagcgagggcaguggaaacagaucaguggcugggauagaggggagaaggggaugaaaacccaggagagagcagaggacacugaguguccugaccagagguuagggcuuuguccugugggccugggggagccaaugacaggacucccaaaauuuucaacuguggcuggugcagaggcucacaccuguaaucccagcacuuugggagccugaggcagaucacuugaggccaggaguucaagaccagucugggcaacauggcaagaccccaucucuacaaaaguaaaaaaauuagccaggcguguuggcaugugccuauggucccagcuacucaggaggcugaggugggaggaucacuugagcccaggagguuaaggcugcagugagcagugaucgcaccaccacacuccagccugggugacagagagauccggucucaaaaacaaauacaaauuuggaucuguuagaaagaccacuugggcacgggugauaggaggcuaucuggaaacaaagccaguaaggaggccaccucugaggaccaagugaguggggcacaggccuggcuguuggcggugagggaacguggacggggccgugggaggagagcccaaagcugaagcgaggggagcagugcagugggcgcaggucaggcuggaggaggugagugacaucucugcccugagagaacacacaagcagaaagcucaacacugcuuaccuggugaaacccugcaaucguuucugcuccauacucgcucugaauaaugggcuucugauacuucuuauaccaguucucaaacuggguggccagcugcagcugaaucaacuccaggugcccguagucgugauaccaagaguaguagcuguucaaacagaucacauccacauacggagccuaggaccagagcagcagagcccguucagcacucaguagacagcaugacucagcauucacacacugcgggggcuccucuggcagagaagguaagggggauguaaucccagcacucugggaggcugaggcaggaggauggcuuaagaccagccugggcaacacagcaagacugcagcauuacaaaaaauaguaguaagaaaauuagcagggcacgguggcucaugccuguaaucccagcacauugggaggccaagaugggaggaucacuugaucccaggaguucgagaccagccugggcaacaucacaagcccccauuucuaccaaaaaaaaaaaaaaaaaaaaaccuagaacgggaacagcugccuccuggggcugagaacguccaaguguaccaauuuagauccugaaauuacccugccauaggcaagaaacauggucacaaaguggcccagaggagguaggccugggacuccacacugacacucaugacgugcgccgcugggaagggcugugagaggcacagcagcugccaacgcacagcccucagccaaagcccagggcccccaccacuggaacugacuccucuccaggcagcacucccaucacugggcuuccccucaccuugcccuggagaagcgcugccacccgaggggccgaugcagucauucucacagaaaaucuuuuguuuuguuuuggagacagagucucgcucugucgcccaggcuagaauguuaguggugcgaucucagcucacugcaaccucugccucccaccaucaggugcuucucaugccucagucucccgaguagcuaggauuacaggcgugcgccaccacgcccagcuaauuuuuuguauuuuugguagaaaugaaguuucaccaguuggcugggcuggucuugaacuccugaucucaaguaaucugccugccucggccucccaaagugcugggaugauagguguaagccaccaugcccggcugucacagaggaucuugagggagcuuucacaaggcagcacuguggacugcagagggccagaaaagucacuccaaggagcagggcggugacgaccgaguaggaccaccccaagcuucagcauagcggugcuuacagcugagcagcaggggcuucuguguccaacuggcuaguuucuaaugcguccugaacacauuucuuucuaguaaaaaugcuggccgggugugguggcucacgccuguaaucccagcacguugggaggccaaagugggcagaucaccugagaucagcaguuugagaccagccuggcuaacauggcaaaaccccaucucuacuaaaaaauacaaaaauuagcugggugugguggcaugcaccuguaaucccagcuacucaggaggccgaggcagaauugcuugaaccugggaggacgagguugcagcgagcugagauugcaccauuucacucaagccugggcaacagagcaagauuccaucucaaaauaaauaaauaaauaaauaaagaaugcuaaugucagccaggcacugcaacucaugccuguaaucacagcacuuugggaggccaaggcaggagaucacuugagcucaagacuuugagaccagccugggcaacauagagagaugccaccucuacaaaaagauauaaaauuagcuaggcgcaguggugaaaaccuggagucccagcuacucgggaggcugaggcaggaggaucacuugggcucaggaauucaaggcugcagugagcugugauugcaccacugcacuccagccagggcaagagaguaagaccuugccucuacaaaagaaaaagaaaaacucaaguuccaacccuggacguacuaaaucaggaccucagaaugcagagaucuggcauuucauaaaaacuuccccuagagauucucaucagccaggugugggccagaugaacucuaagcucccuuaaaucuuugauguuuuaugagucuauuaaaucgaagugcaaaaaaugcugaguccaaacugagcaaacaaaucccaucucccuaugcccagccuccuuggauugagaaagccacacugccuggcgaguaagcagggggagaauucucauuaacccaaagaccaucugugaaaacagacuggcugcggccggggugugguggcccacaccuguaaccccagcccuuugggaggccaaggcaggaggauugcuugagcccaggaguuggagaccagccugggcaacauggcaagacccugucucuaucuuuuuaaguaaaaaagaaaaugaaauaaaacccagacuggcagcgcaugguucuuccuggcuguucccaugaccaggcuucaggacaagcccaggcaaaggcagggagaagugggguggggacccccaggcucacccccuugucugcugcauaguuagaguugcucacaaaggucacaggccgggagggguccaaggauuuggugugagcgaucaccauccuguccacaaaaggcagaagaaacagguuccaucaguccaggaauggcucagacacccucccauccucucugucccaucuuccaccgccagaacacaacacggggccaggcacgaugguucacaccuguaaucccagcacuuugggaggccgagguggguggaucacuugaggucaggaguucaagaucagccuggccaacauggugaaaccccaacucuaucuacuacaaauacaaaaauuagcggccaggcgcaguggcucacgccuguaaucccagcacuuugggaggccgaggcgggcagaucacaaggucaggagaucgauaccauccuaacacggugaaaccccgucucuacuaaaaauacaaaaaauuagccgggcgugguggccggcgccuauagucugagcuacucaggaggcugaggcagaagaauggcgugaacccagaaggaggagucugcagugggccaagaucaugccacugcacuccagccugguccacagagcaagacccugucucaaaacaaacaaacaaaaacaaaggggaaaaaaaaaaaagcauggagccgcugcuuucuucccuaacuugagauguauuuuacauaagggcauaugauccucuaguccuagaccgagcucucuaacaucacuccuucuacccccaucuccgaauccuauacccccagaggagcagccacucuuccagguacacagagcugaggucacuaggcuggacacuggcaaaaaugagguugacgcccugaaacagcucuugaacacaggagguggauggaugcagauuugggagggauauuuauuaaugcaucaagcaaacggagugcaggcugggaggcaggcauggggcuaggugcgaggugcucagcagugacucaaaucuaaguccacagguccugggcagugggaguggagacgcaugcagagaaauggugcaagugccgggcaaggcggcucacgccuagaaucccagcacuuugggaguuuuaccagagaccaggaguucaagaccagccugggcaacauagcaagaccuuguuucuacaacaaauuuaaaaauuaggggcgggcaugguggcucacgccuguaaucccaacacuuugggaggccgaggcggguggaucaugaggucaagaguuugagaccagccuggucaacaugguaaaagucuaucucuacaaaaaaauacaaaaaaaaccuagcugggcaugguggcaugcgccuggaaucccagcuacucaugaggcugaggcagaagaauugccugaacccaggagguagagguuguagugagccaaaauugcaccagugcucuccagccugggcaacaagcaagacuccaucuugcggaaaaaaaaaaaaaaauuuaaacuuagccugacauggccgcacacaccuguggccccagcuauuugggaggcugaggcaggcagauaaccugagguugggaguucgagaccagccugaccaacacggagaaaccccauaucuacuaaaaauacaaauuagcugggcgugguggcgcaugccuguaaucccagcuacucgggaggcugaggcgggagaaucacuugaacccaggaggcagagguuguggugagccgagauugugccauugcacuccagccugggcaacaagugcaaaacuccaucucaaaaaauaaauaaauaaauaagaagaaauggcccuuagaagggaagaaaaacccaacagagggacccgucugugcucagagcuccuggcaccugcccgaggccuccacaguacagacuguuuuuguuuuuguuuuuuugagagacagaaucucacucuguagcccaggcuggagugcaaugacaugaucuuggcucacugcaaccuccaccuccugggcucaagcaauucuccugccucagccucccaaguagcugggauuacagacgcccaccucuguguuccgcuaauuguuuuauuuuuaguagagacaggguuucaauaucuguuggccacgccggucucaaacuccugaccucaggugauccacccaccuuggccucccaaagugcugggauuacaggcgugagccaccgcacccagccuagacuguuguugaagccuguuuuccucuucucuuuccucaguucauuucuucuuuuacgcccucccccaucauugcucugccuauccgaaggcuguggcuggcacagaucagaaaagaacccccuagccucaaguuccaaacccacacucuccaacagccaggcucucagaugggaaacuucaaagccugugacagccuggcugaaccucuccagccuggguggcucccuccaaauccugccccagaaaacaggcaucuccucuggccaccucccaaagaagccucaaacaccugcuccuggaagccuguacucuuccccuucgcaacaaagggccuguccacccaguccugcugagcacaccccugugcccccaagcucugaauuguccuuggcccaggcugcaacaacuucucagagccuucugccugcugcagacuuggcucagcccaaagcacugcaugaaauuggggugugcuguaugagucaagaggcauuucuaccaccucuccugcuucuaccccaagugaaaaauccaacucugaacgcugaguuagaacugcacgauuguaaggaagaaaagggggccagguguggugguucacaccuguaaucccagcacuuugggaaggugaggcaggaggaucacuagaggccaggaguuccacgccagccuggcaaacauggugaaacccagucucuaauuagccgggcacgguggcucacgccuguaaucccagcacucugggaggccgagguaaguggaucuccugaggucaguaguccaagaccagccuggcccaacauagugaaaccccgucucuacugaaaaaugcaaaaguuggccaggcgugguagcucacgccuguaauccgagcacuucaggaggccgaggcaggcggaucaugaguucaagagaucgagaccauccuagccaaaauggugaaaccccgucucugcuaaaaauacaaaaauuagcaggguauguuggcgugugccuguaaucccaacuccucaggaggcugaggcaggagaaucacuugaaccuggaaggugaagguugcagugagacgagauugcgccacugcacuccagccuggccacggagugagacuccaucucauaaaaaggaaaaaaggaaaacuuagcugggcgugguggcaugugccuguaaucccagcuacucgggaggcugaggcuggagaaucacuugaaccugagcggcagagguugcagugagcugagaucaugccccugcacuccauccugggcaauagagggagacugcauauccaaaaaauaaaaaauaaagcaaaaauuagcugggcgugaugacacacaucuagaaucccagcuacuugggaggcugagacaggaggaucaccugagccugggaagucaaggcugcaguaagccaaaacugcaccgcugcacuccaaccugggcaaccagagugagaacccauuuugaaaaaaaaaaacagccccagcacagugguucaugggugccuguaauccuagcuacucaggagacugaggcaggagaaucacuugaacccaggaggcagagguuguaaugagcggagaucaccccacugcacuccagccugggccauauagugagacuccaucucaaaaagaaaaaaaaagaacaaaaaagaaaaccacaauuuggguggguagauauuugguccccugaacuaucuggguauggacggccuucccauugggcuggacacgaggccgaucuugaacagcacaugcccaccgaggccagccaccugccagggucuccuucccacucuagccgagggcagggagggagcacucacuucaaguaguagccagcagauucuaggugggacgcaggcucguuggccacagaccacaucacgaccgcggggugguucuugucccuacgcaccacuucuuccaucaccugcauguggugaugcagagaaacguuguugaagaacugccugcgggccaggagggaagggacagagggucacggugacgcccccgggcugggcaggcggagcaggugcacagcagagacucacggcagcgccaggcccacgccgggacacucaucgaugaccacaaucccauagcggucacacaucugcaucacuuccucugcauagggguaguggcugguacggaaagcguuggcaccaagccagcgaagcagguugaaguccuucaccagcagcggccagucgaagcccuucccucggaucuaggagauagcagagccaagugaccccugucccugucgaagcugcacuuccucugagagccaggacccuggagagccaccccaugagcccccucuccauuuggagccauuugccucauugcccugagcugcccucaacugcaggacacagggaaggcgaaaguggagggugaccagaagcagccccgacaaggacccaggagccccaacacacguccgcauccucaugcuuguugacaccguggaaauagaaagguuucccauugaugaggaacuggcucuuggugacagccacagugcggauccccacagggaguguguagaagucagacacaggccccagugacgucugugcagucagcugcaccuaugacagccaaagcaccaggugugagcaccccgacagccugagccccauccggccugcccuccagcaggaaggccccucgugcaccccagcagcugccucugggccuguaagcagagaugcagcaaucagagguucugcccuacccuggcugacccugggaaccugcccuucaaaacauggccuucccuuugacaagacaagguggcucaugccuggaguucccacacuuugggaggcuaaggcaggaggaucacuugaguccaggaguugaagaccagccugcugacagacugagaccccaucucuauaaaaaaaaaauguuuuucuucugagacagucucagucugucccccaggcuggagugcaguggugugaucucagcucacugcagccucugccuccugaguucaagcaauucuccugccucagccucccgaguggcuggaauuacagguguucgccaccaugcccagcaaauuuucauauuuuuaguagagaugggguuucaccauguuggccaggcuggucuugaacucuuggccucaagugauccacccaccucagccucccaaaaugcugagauuacaggcaugagucacucugcccaggcuacaaaauuuuuuuuauuuagccagacaugguggcaugugccuguagucccagcuacucaggaggccaaggcaggaggacugcugcaggcugagaguucaaggcugcagugagcugugaucaggccauugcacuccagccugggugacagagugagaccaucucaaaaaaaaaaaaaaaaaagaaaaugggccucccaccaagggugagaaacaucagaaagcucagaggaccaugccugcccauccaccugucuugggcuccugcugaagccagggucaccacaugggggcaaaagaccucccuuaggcaugucccaaaccaccauuaccuccaaugaauacagauaggcagggcguucgugcaucagguacggccaccagaggcugacaccuggcaccuuaaguuggcccugggucccagucccauucgccacgacuuuguuuucugcauccaaaagacgcacuuccaacuugaacagguuacugcccuugacagagaucugguaauucaccagcccugcaagaaacaagagagaccagggcugagggagggacacgaccugagucacacaaacaggagcgcccugcagccaccgcugccaggcagccauuuguuucuguugcuuuuuuuaaauuuaauuucuuauuuuuuuuuuuugagacggagucucacucugucccccaggcuggagugcaguggcaugaucucggcucacugcaaccuccaccucugggguucaggugauucuccugucucagccucccaaguaccugggauuauagacgugcaccaccaugcuuggcgaauuuuuauauuuuuaguagagauggguuuugucauauuggccaggcuggucuugaaccccugaccucaggugauccacccgccuuggccucccaaagugcugggauuacaggugugagccaccgcacccggugcuuuuuuuaauuuaaaaaaagauuuuggccaggugcaguggucacaccuguaaucccaacacuugaggaggcuggggugggaggaucgcuugagaccaggaguucaagaccagccuggguaacauagggaaaccacuucuucccuaaaaauacaaacaaucagccggucgugguggugcgugcuugcagccccggcagccccagcuacuugggaggcugaagugggaggauugcuugagccaggaguucggggcugcagugagcuaugaucuugaggcaggauagguagucaaggaagugaccgugucccucagacaugccaaccacggcacugagacacgugacgugugaacaagcauguacagcuacuacgcaugugcaaccagaggacggcccagaacgugcuuacaguaacaccucuucccagcuccuuaggaauucaucacggaagacucccagaaagggaguuuccccaguaauaaucggugcugucucauccuuacgagcagccuguccugaauucugugucucagggugaacugugcauuuugcacuucacuauuuuuuuugagaugggggugucacucugucaccuaggcuggagugcaguguugcaaucucagcugacugcaaccuccaccucccggguucaaacaauucucccaucucaaccuccugaguagccgggauugcaggcucacaccacaauguccagcuaauguuggcuaagcugguuugaacuucugagcucaagugauccacccaucucggccuccaaaagugcugggauuacaggcaugagccagugcacccaggcuguucuaaacuuaacuuccaaaauaccuuuccuuggcaauaaauugcucuauggugcauugucuuugcugugggauucuuuuuuaaauucuuuuuuauucauuuauuuuauuuuauuuauuuauuuuuuucuuagauagggucucaguauguugcccaggcuggucucaaacuuugcagcuaaagcgauccauccaccuuggacucccaaagugcugggaugacaggcauuagccaccacacccagccuaaauucuuuuaaacuuagaaccgcggccccacaacggcugucaauaaucucaccacugcacuccagccugggccacagugcaagccucaucucagaaaaagaaaaagauauauauauauuuuuuuauuuuuauuuuuugacauggagucucgcucuguccccuaggcuggagugcagugaugcaaucucagcucacugcaagcucugccucccagguucacgccauucuccugccucagccucccgagucgcugggacuacaggccccugccaccaugcccggcuaauuuuuugcauuuuuaguagagacggaguuucaccauguuagucaggauggucgcgaucuccugaccucgugauccccccaccuuggccucccaaagugcugggauuacaggcaugagccaccgcgcccgcccugaaaaagauauauuuuuaaaaagaaaaaaaacuuaaaacaaaaauuuuucuuaaauacagaccgagcgcuguggcucauuccuguaaucccagcauuuugggagacugaggcggguggaucccgaagucaggaguugaaccagccuggccaacauggugaaaccccaucucuacuaaaaauacaaaaauuagcuggacgugguggcacacgccuguaaucccagcugcucaggaggcugaggcaagagaauuguuugaacccgggaggcggagguugcagugagccaagaacacgccacagcacuccagccuggacaacagagcaagacuccaucucaaaaacaaaaaacaaaaacaaaaaaaacaggguaucccagcugggcacaguggcucacgccuguaacccuugcauuuuggcaggccgaggaggguggaucaccugagguuaggaguucaagaccagucaggccaauagagugaaacccugucucuacuaaaaaaaaauagaaaaauuagccgggcgugguggcgggugccuauaaucccaguuacucgggaggcugaggcaggagaaucgcuugaacccgggaggcagagguugcagugagccaagaucacgccaucgcacuccagccuggcgacagagcgagacuccagcucaaaaaaaaaaaagaagaaaaaaagaaagacagggucugcgucuguugcccagaccagagugcagugguguggucauagcucacugcacccuugacaucccaggcucaagugauucuccugccucagcagcugggacuaccggcacacaucaccaucccuggcuaauuuuuuaauuuuuuguggugauggccucacuauguugcccaggcugcucuugaacuacuggccucaagugauccuuauaccagggccuccuugcaaagugcuggaugacaggcauaagccaccaugcccggcgccccccccaccgaagcugccuguuccuugagcacgauguguagcaaggggagauggagugagaguagcaccauagagaagggacaggauugccaccccgagcugugugacguuaggccagaccccucuucuccuagcgaggucaaccacacgggugauuuugggagcccguauccgcucacacaggcugaauuuuagcuucauagguggaagggaaucugugaggguguagagaugcugggagcaccuuuuuccugggagagcuuuccaaacagggaacaaacagagccacccugggccccgcugagaggauccuaccagaagcccucaccacugucuugcuccacgcugguggugacggugaugucaucgauguagguggugggugucguguacagaaguacagaccgcugcaguccagcguaguugaaaaagucaaaauauguguucuggacaaaguaacccuugggauaccuaggaugggaggacugugguuugcugggcccuugcucuggguccccugaccucagcucacaggccucccuggccuccccagauccaaggccuccacucugugaaggccacccagucccuaccaggaagaccacaggguggggcgggaaggugggugugugcaauggaggcaggaugguacccacuuggaggugucagucagguauuggauggucccugguggcaggguggugggggugaguguguuguugauggcgauagugauucggagccgggagggcaggggccccaccuggaccagguugcugaugucggccucgaaggggagguagccccccucaugcucuagcgugucgaccccauucacccacugcagacacaggagauacggggagggggcugcaggucagggcaugaggaggcgcccuacuaucgggcacucccucacauaaccugcagcauggggcuccggggccuuccagccagacgggaagaaugacaucccaaugggguagaucaggcuaccuaucccccuauacagggcacagcccccagggcagggcagggcaggaccccccaccaucccaccccagcauacaugccguggguggcagcuggaggucccaugcuguucagcagccgugcccccccacccgcccugccugcuccuggccgcacugaccacgauggcauaggaaugggcacugccaauccucagcaccacucuugugcgcagguccuggguccaucgcuccggcaggaucaccucccguucguaccacacccagccgacaaaaugccgcagacgccaguccuggcugaugucauugaagcuggagggaacuggcauguccacgguggggccugacuguggagagaagagccgggcucagcuccuaggcccccaaaaggguccaggaccagugugcugcacggcugugcccccaggccuagcacaagcccugacacauagcggggauucuuggcagaaaggacagauaacuugcugaugacaggucaacugccagggcgaucugugcaccugggccaguggggccaggaguuccuccucagaguggauggggcacaauaucuccugagacaggagcaagcccagggccacaucccagccagaggcaagaagguucagaccugugacuaagaggcagauggccacugccugucacagggaggaaggcugguuggaggaauggggggagcuuugcuuaggacacugugaguggggugcacacuggcacccagcccccuccucuuucccuccuguacugaaugcugcaaagucagaauaagaggauguagaccaggcaaaagccgcccagaccucacccaguuccacuucucugcagaucacauccaagucaggaggggaacagggguggcguccugggccugaugucauguccuguccucuaugugaaccuugaaaaccaagggacuuccugccucggcagagcugaccucaggacaucuaaacugucaccuucucccgauccccgggcccagcucugugcagugcaugccgcuguggccagaguguguggguggcucaugccaguaaucagcgcuuugggaggucaacgugggaggauggcuugaggccaggaguucgagaccacccuggguaaauagugacacccuguaucuuuuuuuuuuuuuuaaguuuuuuugccuuuuuuuuuuuuuuggagacguagucucacuaugucgcccaaguuggagugcaguggcauccugaucucagcucacugcaaccucuacucccggguucaagcaauucuccugacucagccucccaaguagcugggauuacaggcaugaaccaccacacuuggcuaauuuuuauauuuuuaguagagaugagguuucacccuguuauguuggccagccuggucucaaacuccuggccucaggcgauucgcccgccuccaccucccaaagugcugggauuacaggugugagccaccgagcccagauaauuuuuuuuuuuucaauuagccaggcguguuggcacccccuaaauugcaaggcuggggcgggagaaucgcuugagcucagaaguuaggcuggcgccacuccgccccagccugggaaacaggugcaaacccagucucaaaaaaauuuuuaaaaauuaaaaauaaauauugaaaggaaggauacugcacagacucagccuuuaccucgggaaagggcucggcaagagccuuuucuccuccugccuaauccgccccggcccuccagggugcuccuguucccccgucccccaagccggcgcccccaagcccguugaccuuuaaccuccugcgggccccagcucggagacgcccaggggaagaagucugcggggggcccgggcuccccuacucccaccgccgggcuuucgggcgccucccggcccugccccgagaucgcaccucccacagcggccgccgguaccacugcuccucgaagccccggcgucgguugucagagaagucggcgcggaagcuccagaggccguccagcuccuugcacucccgcgacgggcucuccuggggguacagcaucccgcccugcagccccagcgcgcagccccacaacaacggcccgagcgccgcccaggcaaccgccgacccccgggccaugcuucccggucccccgcucggccaccgucugcggcgcuaagaaaagcgcgggaggugcccguagggcgggucgcgugacgcgccggugucgugaugcgccugaagccauccgcgccaucuugguugaggac

SEQ ID NO: 192890 - RNA, 5524 nt, Homo sapiens
aaacuuggagagacgcaggacaggaucccggcggcagaaggacggagagaaaggggaccccgggacgggaaaggcgcagagcaggcgcgggcggcggcggcggcggggcagggcagggcgggcgucccggcagagggcgcgcggucgcccugucgcccuccgccccgccggggucacagugcccccucccucgcgcccuagccgcccugccgggcuauuuuuacgcgcggacaccggacaccggacaccgggcuggggcggcggcggcggcggccgaggcggccgaggcggggccgcaccggggccgggcgucggggccacacgucgguucgcgggucgccggggcugcgcgcgccauggagccgcggugcccgccgccgugcggcugcugcgagcggcuggugcucaacguggccgggcugcgcuucgagacgcgggcgcgcacgcugggccgcuucccggacacucugcuaggggacccagcgcgccgcggccgcuucuacgacgacgcgcgccgcgaguauuucuucgaccggcaccggcccagcuucgacgccgugcucuacuacuaccaguccggugggcggcugcggcggccggcgcacgugccgcucgacgucuuccuggaagagguggccuucuacgggcugggcgcggcggcccuggcacgccugcgcgaggacgagggcugcccggugccgcccgagcgcccccugccccgccgcgccuucgcccgccagcuguggcugcuuuucgaguuucccgagagcucucaggccgcgcgcgugcucgccguagucuccgugcuggucauccucgucuccaucgucgucuucugccucgagacgcugccugacuuccgcgacgaccgcgacggcacggggcuugcugcugcagccgcagccggcccggugagaggcggggcguggguggagacgggcgggguuugggaggagaugggcgggguccagaggggaccuggccaaucauaaggcggggccaggggcugcgaggggugggccagccgaagacagggugggcgggaggcggggccugaggauccgggucggaggaccugccccaucagaaggugggguugaggucagugagaaacccggcgugaagagggcagggcccuugaugcaagggguaggaggacaggaaccuuaaaaaucacagcugaggggggccaaggagagccugaaaacuccggagucugugcggcuggguggugaaagccaggcccugaauaacuccagcugagggugcuggagcccgaggggcgacaguaggaggaaucuauggaaagaaagccagguugaggggccagaggagggggccuagggcucggcuugcagagaaggucuuuuuuuuuuuauuuccugugagacagagucuugcucugucgcccaggcuggagugcaauggcgcuaucucggcucacugcaaggucugccucccggguucaagcgauucuccugccuuagccucccaaguagcugggauuacaggugcaggccaccacgcccggcuaauuuuuguauuuuuaguagagaugggguuucaccguguuggccaggauggucucuauuuccugaccucgugauccgcccgccucggcuucccaaagugcugggauuacagacgugagccaccgcgcccagccgcauuauacucugggcugggacuguggagggcaaggaaaagcuaggcacaaggugguggggccagggcagggaugcuccccaucuagaaaaucaacacuggaggcgggacuuugagagagaagagguugcacccuacucaaacaugaguucccacgcaugaaggggcagggaccacgucuccagccacccaccaggucaggcaaccagaaagucagcggcccagggaugaucccugggauccugggaggaagucugggauaaccaggucacggagggccuuggcgcagcggcuacugaccaauguguaaagaggagcuggguauuuaaaugaugauuaaggcuguccccguguccuagccccagccugacccucccugaacacuuuccucccugcaguuccccgcuccgcugaauggcuccagccaaaugccuggaaauccaccccgccugcccuucaaugacccguucuucgugguggagacgcuguguauuuguugguucuccuuugagcugcugguacgccuccuggucuguccaagcaaggcuaucuucuucaagaacgugaugaaccucaucgauuuuguggcuauccuucccuacuuuguggcacugggcaccgagcuggcccggcagcgaggggugggccagcaggccaugucacuggccauccugagagucauccgauuggugcgugucuuccgcaucuucaagcugucccggcacucaaagggccugcaaaucuugggccagacgcuucgggccuccaugcgugagcugggccuccucaucuuuuuccucuucaucggugugguccucuuuuccagcgccgucuacuuugccgaaguugaccggguggacucccauuucacuagcaucccugaguccuucuggugggcgguagucaccaugacuacaguuggcuauggagacauggcacccgucacuguggguggcaagauagugggcucucugugugccauugcgggcgugcugacuauuucccugccagugcccgucauugucuccaauuucagcuacuuuuaucaccgggagacagagggcgaagaggcugggauguucagccauguggacaugcagccuuguggcccacuggagggcaaggccaauggggggcugguggacggggagguaccugagcuaccaccuccacucugggcacccccagggaaacaccuggucaccgaagugugaggaacaguugaggucugcaggaccucacaccucccuagagggagggagggagggcaggguggagggcaaggcuggggggaggggauuggguuuaggaagagcuagguuaagucguaacgaguggggaaacacugagucuuguugggucuuggguugugugguuugguagcuccuguggguaccuccugaagcagcagcgaauggcaauggguuguguuguguuaaugaagacucaauugguucauauuacucugaguugugcaaagcucauggagccuuuugggguaguguugagauagguuuggucguaucauuuugugaguuuccuaggucaguguuggguuugguuggguugugagucugggauagugugguccagcugcauuguguaggauucugugguuugguggguccccuagggccauguugggucaaguuagauggucccccauggcauuguugagaucgaaugugugugguguuaaguuucguugagacaugguggaaauuguguagcucugugauucuuccaggggcauguuauuuuagguucugugaacuugcgagucauguagaaaugugaagaguccagugguagaauuugagcuuucuaggucacauuggguuaaguuuguaugaccaaaugaaucuuguaggguucuguugggcuuaacuguguagagguguguggcuggacauuuuucguggccacagcgaguugaguuguguugaauuguacaaccauaugagccuuguaaggccaguucaguugggucaugccacuguuugagucucauagggccaugcugaauugaguuccauugaguugugucacuaugugaguccuacaggaaguuggguugaguuggacugugcgaacgaguuccauagggccacaucgggcuguuuugcauuuagugguagcaccaggacccaaaggaaauagcaguggggaagcaucauguaucugggagcaugcaguggcgagggcucugggaggugugccgagcuggcuccccagcucgcuguagggggcgggacuggauucuguauccaugggauuggguguucauccagaggcgacuggguaaauuaggaagagguggaugcuccuccuguuuaccccacauccacuucauugugcuguucacucccauucuccccuacaguuuuaugcucagacauggaggucagagccacaagggaaaggggagagggggagaaaacuguacucuguccagacaugauagagggacagagccaaaaggauagagaaagagacccagaaaaaggaagagguggaaacccagagagacagagacccaaagggagagaaacagagacucagggagagggagacaaugaccuggagggugggguauggcagagacgcagaagagaggaacagaaauccagaguggggagacagagaccaagagcaggggauagaagccgggcgaaguggcccaugccuguaaucucagcacucugggagaccgaggaagggggauugauugaggccaggaguucaagaccagccugggcaacauggugagaccccaucucuacaaaaaauacaaaaauuagcugagugugguggcacaugccugugaucccagcuacucaggaagcugaggcagaaagaucccuugacccugagagguagaggcugcauugagccaugauugcaccacugcacuccagccugggcaacagagggagcccccgucucaacaaacaaacaaaaagagccagugggggagggagggacagagacccagagggcagcgucagacacccagaguuggagacagaacaacagagucucagggaaagagaaccacaauagaaaaaggcagaaaaggccgggcgcgguggcucaugccuguaaccccagcacuuugggaggccgaggugggcaaauuacgaggucaggagauccagaccauccuggcuaacacggugaaaccccgucucuacuaaaaauacaaaaaaauuagccgggugcgguggcgggcaccuguagucccagcuacucgggaggcugaggcaggagaauggcaugaaccugggaggcggagcuugcagugagccgagauugcgccacugcacuccagccugggcagcagagcaacacucugucucaaaaaaaaaaagaaaagaaaagaaaaagccagaaaaaguuggugccccugaacccaagagugauguacagucuauuccauagaaucacagaacaauccugaaccaggccugucaccuacccucccugcagcucaggaaggcugucagacaggcugggggccucacucuguuuuccaggggagaaaccugagucucagagcaggggaguggcuucccaaggucucacagcuuguccccaggggccaggcaggcugucugucugcuucacauguccccaucagccugcugggacacacggguccuccugagucccguagccucauuucuuacagacggggaaacugaggcucagagcagcagguguuacccaaggucacaaggccgaacauuuucagaaaucuuucagaacucaaagggcauuuagaggaagaaggcugaaaucacuaacacauauagggcuuccuuugguaucaaaguacuuuacuuggguuaauuuauua

SEQ ID NO: 192891 - RNA, 5524 nt, Homo sapiens
uaauaaauuaacccaaguaaaguacuuugauaccaaaggaagcccuauauguguuagugauuucagccuucuuccucuaaaugcccuuugaguucugaaagauuucugaaaauguucggccuugugaccuuggguaacaccugcugcucugagccucaguuuccccgucuguaagaaaugaggcuacgggacucaggaggacccgugugucccagcaggcugauggggacaugugaagcagacagacagccugccuggccccuggggacaagcugugagaccuugggaagccacuccccugcucugagacucagguuucuccccuggaaaacagagugaggcccccagccugucugacagccuuccugagcugcagggaggguaggugacaggccugguucaggauuguucugugauucuauggaauagacuguacaucacucuuggguucaggggcaccaacuuuuucuggcuuuuucuuuucuuuucuuuuuuuuuuugagacagaguguugcucugcugcccaggcuggagugcaguggcgcaaucucggcucacugcaagcuccgccucccagguucaugccauucuccugccucagccucccgaguagcugggacuacaggugcccgccaccgcacccggcuaauuuuuuuguauuuuuaguagagacgggguuucaccguguuagccaggauggucuggaucuccugaccucguaauuugcccaccucggccucccaaagugcugggguuacaggcaugagccaccgcgcccggccuuuucugccuuuuucuauugugguucucuuucccugagacucuguuguucugucuccaacucugggugucugacgcugcccucugggucucugucccucccucccccacuggcucuuuuuguuuguuuguugagacgggggcucccucuguugcccaggcuggagugcaguggugcaaucauggcucaaugcagccucuaccucucagggucaagggaucuuucugccucagcuuccugaguagcugggaucacaggcaugugccaccacacucagcuaauuuuuguauuuuuuguagagauggggucucaccauguugcccaggcuggucuugaacuccuggccucaaucaaucccccuuccucggucucccagagugcugagauuacaggcaugggccacuucgcccggcuucuauccccugcucuuggucucugucuccccacucuggauuucuguuccucucuucugcgucucugccauaccccacccuccaggucauugucucccucucccugagucucuguuucucucccuuugggucucugucucucuggguuuccaccucuuccuuuuucugggucucuuucucuauccuuuuggcucugucccucuaucaugucuggacagaguacaguuuucucccccucuccccuuucccuuguggcucugaccuccaugucugagcauaaaacuguaggggagaaugggagugaacagcacaaugaaguggaugugggguaaacaggaggagcauccaccucuuccuaauuuacccagucgccucuggaugaacacccaaucccauggauacagaauccagucccgcccccuacagcgagcuggggagccagcucggcacaccucccagagcccucgccacugcaugcucccagauacaugaugcuuccccacugcuauuuccuuuggguccuggugcuaccacuaaaugcaaaacagcccgauguggcccuauggaacucguucgcacaguccaacucaacccaacuuccuguaggacucacauagugacacaacucaauggaacucaauucagcauggcccuaugagacucaaacaguggcaugacccaacugaacuggccuuacaaggcucauaugguuguacaauucaacacaacucaacucgcuguggccacgaaaaauguccagccacacaccucuacacaguuaagcccaacagaacccuacaagauucauuuggucauacaaacuuaacccaaugugaccuagaaagcucaaauucuaccacuggacucuucacauuucuacaugacucgcaaguucacagaaccuaaaauaacaugccccuggaagaaucacagagcuacacaauuuccaccaugucucaacgaaacuuaacaccacacacauucgaucucaacaaugccaugggggaccaucuaacuugacccaacauggcccuaggggacccaccaaaccacagaauccuacacaaugcagcuggaccacacuaucccagacucacaacccaaccaaacccaacacugaccuaggaaacucacaaaaugauacgaccaaaccuaucucaacacuaccccaaaaggcuccaugagcuuugcacaacucagaguaauaugaaccaauugagucuucauuaacacaacacaacccauugccauucgcugcugcuucaggagguacccacaggagcuaccaaaccacacaacccaagacccaacaagacucaguguuuccccacucguuacgacuuaaccuagcucuuccuaaacccaauccccuccccccagccuugcccuccacccugcccucccucccucccucuagggaggugugagguccugcagaccucaacuguuccucacacuucggugaccagguguuucccugggggugcccagaguggaggugguagcucagguaccuccccguccaccagccccccauuggccuugcccuccagugggccacaaggcugcauguccacauggcugaacaucccagccucuucgcccucugucucccggugauaaaaguagcugaaauuggagacaaugacgggcacuggcagggaaauagucagcacgcccgcaauggcacacagagagcccacuaucuugccacccacagugacgggugccaugucuccauagccaacuguagucauggugacuaccgcccaccagaaggacucagggaugcuagugaaaugggaguccacccggucaacuucggcaaaguagacggcgcuggaaaagaggaccacaccgaugaagaggaaaaagaugaggaggcccagcucacgcauggaggcccgaagcgucuggcccaagauuugcaggcccuuugagugccgggacagcuugaagaugcggaagacacgcaccaaucggaugacucucaggauggccagugacauggccugcuggcccaccccucgcugccgggccagcucggugcccagugccacaaaguagggaaggauagccacaaaaucgaugagguucaucacguucuugaagaagauagccuugcuuggacagaccaggaggcguaccagcagcucaaaggagaaccaacaaauacacagcgucuccaccacgaagaacgggucauugaagggcaggcgggguggauuuccaggcauuuggcuggagccauucagcggagcggggaacugcagggaggaaaguguucagggagggucaggcuggggcuaggacacggggacagccuuaaucaucauuuaaauacccagcuccucuuuacacauuggucaguagccgcugcgccaaggcccuccgugaccugguuaucccagacuuccucccaggaucccagggaucaucccugggccgcugacuuucugguugccugaccugguggguggcuggagacguggucccugccccuucaugcgugggaacucauguuugaguagggugcaaccucuucucucucaaagucccgccuccaguguugauuuucuagauggggagcaucccugcccuggccccaccaccuugugccuagcuuuuccuugcccuccacagucccagcccagaguauaaugcggcugggcgcgguggcucacgucuguaaucccagcacuuugggaagccgaggcgggcggaucacgaggucaggaaauagagaccauccuggccaacacggugaaaccccaucucuacuaaaaauacaaaaauuagccgggcgugguggccugcaccuguaaucccagcuacuugggaggcuaaggcaggagaaucgcuugaacccgggaggcagaccuugcagugagccgagauagcgccauugcacuccagccugggcgacagagcaagacucugucucacaggaaauaaaaaaaaaaagaccuucucugcaagccgagcccuaggcccccuccucuggccccucaaccuggcuuucuuuccauagauuccuccuacugucgccccucgggcuccagcacccucagcuggaguuauucagggccuggcuuucaccacccagccgcacagacuccggaguuuucaggcucuccuuggccccccucagcugugauuuuuaagguuccuguccuccuaccccuugcaucaagggcccugcccucuucacgccggguuucucacugaccucaaccccaccuucugauggggcagguccuccgacccggauccucaggccccgccucccgcccacccugucuucggcuggcccaccccucgcagccccuggccccgccuuaugauuggccagguccccucuggaccccgcccaucuccucccaaaccccgcccgucuccacccacgccccgccucucaccgggccggcugcggcugcagcagcaagccccgugccgucgcggucgucgcggaagucaggcagcgucucgaggcagaagacgacgauggagacgaggaugaccagcacggagacuacggcgagcacgcgcgcggccugagagcucucgggaaacucgaaaagcagccacagcuggcgggcgaaggcgcggcggggcagggggcgcucgggcggcaccgggcagcccucguccucgcgcaggcgugccagggccgccgcgcccagcccguagaaggccaccucuuccaggaagacgucgagcggcacgugcgccggccgccgcagccgcccaccggacugguaguaguagagcacggcgucgaagcugggccggugccggucgaagaaauacucgcggcgcgcgucgucguagaagcggccgcggcgcgcuggguccccuagcagaguguccgggaagcggcccagcgugcgcgcccgcgucucgaagcgcagcccggccacguugagcaccagccgcucgcagcagccgcacggcggcgggcaccgcggcuccauggcgcgcgcagccccggcgacccgcgaaccgacguguggccccgacgcccggccccggugcggccccgccucggccgccucggccgccgccgccgccgccccagcccgguguccgguguccgguguccgcgcguaaaaauagcccggcagggcggcuagggcgcgagggagggggcacugugaccccggcggggcggagggcgacagggcgaccgcgcgcccucugccgggacgcccgcccugcccugccccgccgccgccgccgcccgcgccugcucugcgccuuucccgucccgggguccccuuucucuccguccuucugccgccgggauccuguccugcgucucuccaaguuu

SEQ ID NO: 192892 - RNA, 50849 nt, Homo sapiens
uaaagagacaaagaaacuuuauuuauacaaaacuccaccccuucuguuccacucuccucagcaaacacagauaacaggugaugaaacuaaaacacacagacgagcauuacucaacccaagguucccgccuucccuagcaccugaggucugggccaacaugcaggguaacuggugccuuaugccugcugucuggauugcccggcccacaggguggcugagcauauuuauucuggggguuccaugcauacgaggagcccccagccauacagcugggcauggguguuuggcagcaaauugucccugcuuuagucauagcaauuuuucauguccucuguugcuccccuuaacugaacaccccuugacagccgggauucugccuccagcaucaaccuaaggaagcucuguuaaaugaaugagcaccucuaggcaaugaccacccucccugaaguucaauuucucaucgauuucccaaggccgcccaagucauucccuugauggcuguguuaguuucuaggcucggcuucuaguucagugagacagaggcaggugggccuccacgugggccaugaucuggugggcaaaacaugccuugggcaguuacaacagggacagucugcugcagaagcuguggagggagcagccaacaacucguucacaagucgaggugcccaagggccucaguuuuccugcaggggccugccguggggcacggcgacccagugcccucuacucucaugggauguggcgagcccagcccaaugcugggcgggguccagucucugcagcccaguguuaggccaacgucaguggggccaaucaccuucauaccaugguucuucaagucuuuuggaaaucugccagccuggcugccuuccaggagguggcauuucccaggcauggauaagcccuaguccucaucugcagacucagcaacaagaggacaugcaccuaagagacccucauguaugugggucccacggagacaaaguucacgauuuugggggucuggcuugagcucugagcauugccaggggcaggauggaaggaugaugaggauuuacucuucucugagaugcccgagggugccagggaggccggacacagacuggccuccaguggaaccccaccuggagaggggucuggggcccucagggggguuguagggggcgaggaccugucuccacagcagcagccacagcaaggacuggccaugacaggggucuggccaccauccuccuggccaugacacuguuucagguggccgcacagguggcagguaagggcugaguagacaaugccacugcccaggcuguccacaagggggucuguggccugcuccuggggaagugggggcuuuggcauguccucuaccuuuucccccggcuccagacccaggugcucuggggagcugcuugggagaugugagcucugcggacugcgagguggcucccuguccaguccaaaggugaacaaggggacagggacuggggcaggguccccagggcagccaggaaugaggucuuggaaaggcuuauaccccucuuccccacugcuagccccaaacccacauuucucuggggacacagcacugcuggcaagcaggcuugagaaggccuuguaaccagccucuccugggggacccaagcccaccaccgcacuggccugggugccacccugcuccaccgcauguacaaacuccugauagccacuggugggggccgagacgggggcugcagcugccccaugcuggaggacauuucggcggaggaucugcucccagguuucuggcucagguuggggcacagugguuggcucagagagcugggggacacagggcaucucggguucuacuuccuccaggugucuggccagcagugggucuggacccagcucucugggacacggugacuggcucagggaguugcugaagcugcgguaagcaggguugccugcgaugacgaggggcgucucugugcaagucagguugucuggacucugggucgggcuggcaggaggacuuggcuccagguggagaggcugcuccuugccccagggaggugccuccuugggcccugcacuugggaacucaucccagggcaugugagcacucguacuucccgaagguggaagaaggcaugacucccccauguccugcuggcaaaagcccccauucuccucuccgagcagguccaggaacaggcucucuguuagccgggccacaaugcccucccuucccuccuggaagucaucccugcugcucucaggcgaugcacagaagcucccuuuuucuuccucuaccuccuccuccuccucacacuccaccggggccucaaacaacuccacacaucgcaccacgcugaugcucucuggccagaggacugucuugcugaucuccacugggcaccaugcugauuuuccagagcccuggaaaggcaucucuuuggcagccuugugaggaucuucaucccuuuucauguugugcuccagaaaacagggcaagagcuugguaagacaauucuuccagugucugcaaaagcaaagguuggucaggguucaguuucgacacuugaaaaacuccuauucauucuucaaagcccagccugaaaucaccauguccugauggcugucuacuucagacaugccuucuaacguuauaaucaguaauugaucagucuauguugcuagaaugagaaaucccugaggguagggucugugucuuugggauuucgggaacccagcacauguccugggcaccaaauacaagcucagaucuguugaguaagaaaaagucuuuauggaugaugauaauuaaaagcaacaccauuaucccaagccaugaccaauuagaaaggauauggaagccgggugcgguggcucacgccuguaaucccagcacuuuaggaggcugaggagggaggaucgcuugagcucaggaguuugagaacagccugggcaacagagcccaagccgucucaaacaucucuacaagaauuaaaaaaaaggaaaauuagcugggcauguugguguaugacuguagucccagcuacuuagaaggcugaggcuagagaaucacuugagcccacgaguuugaggcugcagugaaucacugcacuccagccugagggacacagcaagacccugcguccaaaaaaaaaaaaaaaaaaaaaagaugcgggauccuaggguugaagcaggguccuggacccccuuuaguuucuggaguauggaaagguccagcaggccccagggaagaagcuaaggaggccacaguggcggggcaacacagcgagagcuugucuuuacaaaaacuuuuuuugguauuauuuuuuuugagacaagagucucacucugucgcccaggcuggagugcaguggcacaaucugcgcucacugcaaccucugccucccggguucaagugauucucaugccucagccuccugaguagcuggaauuacaggcaaaaaccuuuuaaaauagccaggcgugguaaugcacaucuguaguaucagcuacucgggaggcuaagaugggaggaucacuugagcucaggaguuugaaggugcagugagcuaugaucgcaccacugcacaccagccugggccacagagugagauccuguauauuaaaaaaaaggaggggaguguucaggauaguggcuauuugccgacaaguauacaauuaggucaagauuuuaacaacaggcacggcugcucugguuguuaacuauaacagcacucccaagggguaucaccauguaccugacacaccagugaaacucagggggcuuggccagcaguccacguuuccagaacaccccuccuccugccgucccuugaaggcuaaugucacagggcaauuaccgaaugcagggaagagaaggcagacauggagcuaggggcuugccucuccaauucuaucaccuucccaaugcaugcaggcugugaccuaaguucagauacauacgggcacuuggcugguuccuggccucgggaccgcuucucccacugugaccccuaaaauacagagacagccaaugaaagagcagaguggccuugcagcccggccuggaguacggcaaugcucaggaagggguacaagccucgacaucacacagaucagaaguccaacaggucacuuacgcuuucugagcuucagauuccugggaauuaauuacauuguccuaauauuuacagggacuguggucgauggcaaaaguggccacagaggagugcucugaaucuccucccaucccuugaaucuacacuggcccugggacuugcuugggcccauagaaugugauggaagugauaucaugccagugcugcgccuaggccucaagaagccuugggacuucccacccuugaaaacugagccacucuguaaacaagccugggccggccugcuggagagugagaggcacauggcucaggcaccugcacugucccagguaaaagucagccaacuaggcugggugcaguggcucacgccuguaaucccagcacuuugggaggcugaaguggguggaucaccugauauuaggaguuccagaccagccugaccgacaugaagaaaccccaucucuauuaaaaauacaaaauuagccuggcgugguggcacaugccuguaaucccagcuacuugggaggcugaggcaagaaaauugcuugaacccaggaagcagagguugcagugagccaagaucacgccauugcacuccugggcaauaagagcaaaacuccgucucagaaaaagaaaaaaaaaaaaaaagccaacugucagacacggagggaggcuacggggacgggucagcucaauucagaucugcccagcccagcccagcccagccucccccgccacccucacugcugagcccagccccaaaugccagccugcagaagcauaagcuaaauaaaguuguuguaacccucuacauuucggggucguuuguuacacagcaaacacuaacugauacauaaauggcacuugguauuugcaagaggcuggaauaugcacuuuauauguauugucucaauaaauuccaauaucuguccuaccagguaaacacuguuauaacccacaagaggaaacugaggcucagagaauuaagcaacuugcucaaguccacacugccagugaguggcagagucaggauucaaagccaacaccacuagauuccagagucccuggaaaagcaaggacccucagaccuucucuucuagacaggaccuauaaucccccuuucuccuaccuagagaacucucaucuugcucaggcaaaccccacccacucacccacaggaccaucgccuuggggaagcugacuccaccccuggcuuaggggugggauacauuucaggccaaugagaacccggaagggauuugcuagugcuucgggggcaguuuccuaugcuuaagaagaagacacagaaagccugucacccucuccuuccuccacuccuucuggccucuagcccugguacuggcaccuccccagggaaugacacagugaugaugacccaagggucauucucccaaggggagggaaaaaaacaggaaaccaaccccagagaagcccaccccaggcugggauugccaaggggaagggcgggaaagccucuggucugcuaaugaccucauucggcuucugucucugucuccccugcaacccuccugacugucuauuugccauuccagaagccagugaagguccuuaacagcccagguguucugaaccacacuucuucauguacacagucccacauguccucauccacgccuacuccuaccugagcauccuggauuauuauagccacgaggcggcugcgggcuggguugggaaucugaucccaccauucuuucuuaauccugaaaaacaaaaggaaaagguguugaucucugaauuauugacaggugaacgcuccucccauaaaaguggucguuaucaccaauacuuauuuggcaucagagaucaggcugauuaguuucuggaggucaaaccacugacucaucauucuaaccuggugacauggauucuauugcuaacccuauucuacagaugaggagagugaggcccaaggagguggagugacagcugguagguggcagagccagguucacacucccgcauucuguuacccagcacagaguuccugaggaggccaccuauguccucagugggaaugagaccccaggggauuaggaaagacucaaacugcagagagaggauucuagguuccccucaacaaucccuuuuucagagcagcugagggcaaaugaccagggaauggccugggauggccugggaagcugggggaccuacggagaaacacaacccuucucucuuccuggccugccuggggccauggugcaucaucacugggagguaagguccucagaccgcuucugaauuagccucugcccaugguuucaauaaauaaacacauauuuauugagcaccuucuauguuugacucacugugccuggcccugaggccacaacagugaacgagacaaagaugccugccuuggugaaacugaccuucaagagggaaagauggaugauaaauggagacagaaaugcuuauaugaggccaggcaugguggcucacgccuguaaucccagcacuuugggaggccaaggcagguguaucaccugaggucagaaguucgagaccagccuggccaauauggugaaacaccgucucuacuaaaaaugcaaaacuuagccaggcaugguggcaggcgccugcaaucccagcuacucaggaggcugaggcaggagaaucgcuugaacccggaaggcggagguugcagugagcugagaucgcgccacugcacuccagccugggggacaacaugagacuccaucucaaagaaaaaaaaaaaaaaacgaaagaaaugcuuauaugaggucauucauucaugguaauaagugccaugaauaaagauaaagggguagaaguucaagaucagccugggcuacauaagugacagccagucucuacaaaauguaagaaaauuggccaggcacaguggcucaugccuguacccagcaccuugggagaacgagguggguggaucacuugaggucaggaguucaagaccauccuggccaacauggugaaaccccaucucuacuaaaaauacaaaaauuagcugggugucguggcacacgccuguaaucccagcuagucgggaggcuaaggcaggagaaucgcuugaacccgggaggcagagauugcagugagucgagaucgcaccacugcacuccagcuugguuuuugagacuccacucugucccaaaaaauaaaauuaaauuaaauuaaaauaagaaaauuagccaggugugguggcaagcgccuguugucccagcugcucuggaaguugaaaugggaggaucucuuuagcccaggaauuggaggcugcagugagccguaaccgcgccacugcacuucagccuggcuaacagagugagacccugucuaaaaaacagaacaaaacaagaaaccaaagacaaagaacagcaaagaggcuggcaugcugggauauagugauggggagugggaagagguacaggugauggggaaacugaggcucagagcaaggcgaucaguccaagguugcucggaggcaucagugacaagauauggaggggaauuugcauucccugccuaccuagugugugcugggccaagagugggcacuuucaucaaucauguuaauaauccuuagccaccucuaauccugacuuagugagguugagcuugcuagucccauuucagagaugggaggacugaggcucugagacaccaugauuccaagggcuggcaagagcucucuggaaacgaggcuccuuccaccaccucccagccacucgccacucaucuccucccucagccuuuacugugauuuggccucuucuggcugaugaaauauguucucaccaucacugucacucugcaaagcaggaaccccaggcucagggguuucagcaacuugucggccgccagcuaccaagcuccaaggccaggauucaaacccaggucuccugacuccaucagggcaaucgucgcaaauuccucuggcuccuaccacaugcccccagaugcccccaguugcccaggcacccagcguuguaaggggaugugggaugacuccaucuugcuuaucccuggccagcucauucuccccagucagggccccccucaaauuuucccuccuuggagagccuuauccuggucccccuugcaaaaagcaccccagaagaucucuggccugcacccuggucuagugcauucagagagugggucacuauggaaaaccaccuguuugugauugauauguauuuucagucuccccaguaggaugccgguuuuagaaauguggaguccugguugggugcaguggcucacaccuguaaucccagcacuuugggaggcugaggcaggcagaucaugaggucaggaguucgagaccagccugaccaacauggugaaaccccaucucuaccaaaaauacaaaaaauuagccgggcauaguggcaugcgccuguaaucccagcuacucuggaggcugaggcagaagaauugcuugaacccgggaggcggagguuacuguuaggcaagauugugccacuauacuccagccugggugacagagugagacuccgucucaaaaaaaaaaaaaaaaaaaaaaaaagaaaaaagugggguccuugucgauauguucucagcucuacucucaagguguguaguagcugcucaguaaaugcguauuauugacugagaggacugcaaaggggcagacuagaggggcaagucccugccacccugcacuccagagggacugcucggcagcacugggcccaggacucacuuggugaugcugacauagcacaacaggcagacggccaggaugacaaugcaggaaacgcugacgcccagcaggaggugcugcucgaagggcucccuguaggcuggaagugggaggggaagccaugagcugaggucagccaugguacagccugggcuccacuucccaggacuggagacccagggucaggacccucguccgagacccuccacgaucugaccgccgaccaccccuccaccucaucuccccaccacucucccucuugcacauugaguccucgucacaccggccaccucauugcccccugcuccuccaaagcucagugccaccuccagaucuuaaacuugcugcucuuucuuuccggaagcacagaagucaaaugcaccaacuuaggagccggauggcuccuugcugugugacacaggacaagucccuuaucuucucugugccuccgcauccucaucuguacuaugggguuaaugacagaauugaucgugcagggcuguugcgaggaugacaugaugaaucaauagauaaugcacucagaacagaguggccuguccacaucauuagcugccaucaucucaacacgguugacuucuccuuguucacuuucaucgucacauucuccaaaaaguuuuccccgacacccucccuaccguugcccccugcccaucgcuccauccccuuccucugcuuuuauuuucuucccagcacucacugucauccagauccaugugauuucuuucuuucuuuauauguuugcuuuuugucucucccuccagaaugucagcuccacaagaguggggauuucuaucugcuuuguucaucgccgauuccccagugucuagcacagggcuagccauguaggaggaacucagcaaauauuugcugaaauaaugaaugagggucccauacauuguuaucuguuucauacaagcuaguucccuuccccaugccaauggcagaugagaaucaauucaaaacuuucccaagcaccugguucugugcuggguucuggagauacagccauggagacccugccuauggagcucacagcccagggcaggagacacguggcucaacugauauccacagugcaggaugagcaaugcugagagggcugugcgguggcagggucaggguacugccagcugccacugcaccuaccacguugaagaaucuucuuucauugaguuuuuacgacagcccuuacuccucccauuauacagauggggaaacugaagcagucuucuucacucaacagcuuuuuccucucucccuugucagggagccaugcccacccuaaggcuugagccaaucacgauuauccuguuccuuuuuccaggcauuugaguucccagucuuccuugcaaugagcaaguaauaacaguaaccauguaacauguaacagucuuggccaaugagauguaaggggaauuuugcuagggaagcuucuagaaagauguuugcuuccugauuaaaaaagagaugcacaagguacacucucucguagcagccuuuccuuuccuuccugcuuuauguaagacagugugcaacggccaaccugagggcauggguggcaagucuaaggauacaaugccaccaugugaaggauggcagaagggaagacagcagaagggaagagauaucacuuggcugcuguacaaaacccaguagguccauuuguaagacuucauuuuaugugagauaaucaauauuucuacugcgaaagaccugugggauaccucacugaaaagaguuguuucugggauguagguuccaagugagaaaguucccagccuccuuuguggcuauguguagucaugugaccauuuucaccaauagaauuugagaggaagugaugcggcccacuuccgggcugucugcuuucaagaagcagaugugaucuccauaaucacgccucuucugcuggcuggauacagacaaugguggggcccuagagcagggauucuucacuugggguugauggaccaacauggcugcagguagaauucaggggucugagaacuuggaugggaaagaaauuacaucuuuacuuucccuaaccucucacaccuagcaucuccuuccauuaagaauggaggaaggggccaggaacacuggcucccacuuguaaucccagcacuuugggaagccaagaugggaagaucacuggagcccaggaggucaaaagcagccugggcaacauagugauacccugucucuauuuauuuuaaaauuuuaaaaauaaaauaaaauacaauuuuaaaaaaagaauggagggaagagaccccaguaaugacagcaucacugauccuguccccagcaaaacaaaacucacagcuauucucauaucacaucacaauuucaguaucauaaaguauuauuuaugcuuaucuacuuugaaauuacaguauuuaugcgagcuaccccuagaacuuauuauuuauagaucuuaauaaagaagcacauauaucucuagauuaaaaauguguuuaaauguuuuauaacugcauuucaauacaauuaguuuccucuguaguucuauuuauuuuauuuuauuucauuguauuuauuuauuuuuagagaugggcucuugcucugucacccaggugggaguaaagugguacgaucacggcucacugcagccucaaacuccugggcucaagugauccucccaccucagccuucccaguaccugggacuacaggugcaugccaccaugccuggcuaauuuuuguacagauggggguuucacuauauugcccaggcugggauuuuauguauuuaaaaauauucugaaaugagguccauaggcuucaccaggcugccaaaggaaaccaggacacaaaaguagguaagaaucuuuguccuggagaaugacggcaccacaagauggaaagaaccucacuccccagauuucuacagggagggaaaccaccuacaaaccagcaacauucacguuagcuuguuacgugagcaagaaauauauucccauaguguuaagccauggaaauugugggcuuguuuguuacugcagccuagccugccuaccuggcagauacaccacggcagguguaucuaauggcaggauugccauuagaggcauccuaugauauaaaagcccagagacucagccaggggaagugucuggccacaggggaagaauggagaguggagauuaccauugcuuaggccucuugauacucacaguugugccacuuggugcuggggcuccacucacuccaggugguguuauagcacugagcccaggcccucacccgugcccuguaggaaaucccagacuucagggugcuggcugcgaugcggagggaggguucuagguaggucacguuauagauucugaacugguagagaaaagggagauguuagggcaccagccgggggcgaggggcaccagugcccacccugguugcugucguuagcugaccccaccauguuuaagagccaccagccuggguauuugguuguucguccuguucaggccauugcuugccaccucuguaacugugaccaggcuacagcaacaugcgucaggcuccucgacuaauuagcuguauguuacuuaggcaaguuguuuaaccuuucugaguuuucgugagauaauucaaucucaucuguaaaacaaggguaagagucccuacuaccacuuccuggcugugugaccuuaaguaagugacauaaccucucuggaccucaauguccucaucugcaaaaugaagauaauaaaagugccuaucucccuucccgcaggguuguggugauaaggaaauggguuaauauacguaaguauuucaaauaggguuugguauacaaaaagcacugggugaucuuucuaaaggacuggcagggucgaggcaucucucucuguccuucaugggcuuccuagugucuccauggucaaguccaaacucacuggccuagaauccaaugcucugcccaaccuagccucuacugagaagugacuuccaagaucuauuguuaaguaaacaagggaagaugcagauguguauguguucucugcuucuuuuuauguuuuuuguuuguuuguuuguuuuuuaaagagagauggggcugggcaugguggcucaugccuguaaucccagcacuuugggaggccgaaguggguggaucacuugaggugaggaguucaagaccagccuggccaacauggugaaacucugucucuacuaaaaauacaaaaauuagcugggugugguggcgggcaccuguaaucccagcuacucaggaggcugaggcagaagaaucauuugaaccugggaggcagagauugugguaagcugagaucaugccacugcacuccagccugggugacagagugacgacuucgucucggaaaaaaaaaaaaaaaaaaagagagagagagagauggcacagugaucacugcagacaaaccuaagauggccccgaugauccccacuuugaaucacaucuuugugucaucuggucuucucgagugugggcaggaccugcuacuuguuucuaacccacagaauaugguaaaggugaugggauauauagaggauuucauggaugugauuauauuacagaagacuguaauauccuacuugcuaggcaagucucucugccuugauggcuuugcaaagggcacaugggaaggaauucaggguuaacuacaaccaacagccagcacgaaacugaggcucucaguucaacagccugccagggacugaaugucaccaauauuguaugagcuuagaagugacccuuccccaauugagccucagaugaaacugcagccccaucccacaccuugauuauagccucacgagacucuaaagcagagaaccuggcuaagcuauguccagacucccaaccacagaaacuaugagauaauaaauggguguuguuuaaagcugugaagcugguaguaccauuauuaugcagcaauagaaaacuaagacagcgaugacugaacacacacauuugcuuguauagacauaagcucucucuaaaggaugcacaugcccucugccugcccuaaccuugccucccuuucccuucuggcaagagacagacagcaguggucagucucugggaagaaaaacaggaggcuggagucgggagagaaacauguuuccauucuaaguccuuuuguaccauuuguauuuuuauuuuguguaacuauuacuuuuacccuccaaaaaagcuuuaaaaagugauacaugaacgcuauauucaugacugacccugauggcaagugagcaaccugaguucucauccugucaccccucucccugcgagauccagggcuaugcaccucccucuccucuuccucagcccccggcaguuucuuccugguuacuggcagcuccauuucugcuugugguuggaagcacauuuggggaaaccuggugcaaagugagccaaggggagguuuuuucacaagaaagaagcaaaguuccaaaagauugcuggagcaacuacagagaguucagagauuuuccuauuacagagggagcugaggguggggugugaguuguggggagacuggggaagggagagaaaauucucacucucuuuugucuuucuuucuaaacaugagcaaacaagaagcaacagcuagauguaaguuaccgaagaaaucuuacacccuggaagggagcugggaacugggaaauguuuuacuaagaaacaaaagagaaaucugagcuuccaaagaacuacuugcgguuugucuguuuuuuaacaagaaggacagguguuugggagaccaucucugagagaaauguccaugggaggaaaaagagcacaggcuugggaguucaaauacugggugcaaaucucagaucugggcuggaugcgguggcucaagccuguaaucccagcaccuugggaggcugagccagggggaucacuugaagccaggagauccagaccagcccggacaacauggcgagacccugucgcuacuaaaaauacaaaaaauuagccuggcgugguggccugugccuguagucccagcuaccugggaggcagaggugggagaaucaccugaucccaggaagucaaggaugcagugagccaugaucacgccccugcauuccagccugggugauagagugagacucugucucaacaacaacaacaacaacaaaaacucagcccugccauuuccagcugugugacccugagcaaugugccuggcacauaguaggcauauaaaauauggaaaccauuaugaggcaggcauucagggcucuaacuaaacuuuuggcuuuguuuggugcuuuaucgcuacacauauucccacaucccccaaccccauaauccucaaacauuccaugaauuuucacacccauaaaccuuuuaucaugcaguucccucugccuggucuaccguucccuucuuuccccaucuagaaaacuccuaugcauccuucaaugcccaagccaaaacucccccuccacuauggaaccuugccuagaaauuaucuaggggaaugaaugaguagcucuagccccaaaauucuauaguaaguuccuaauguuucuuucuggaauuuaucccacucaguaugagccacaguuggugccuauagugcuguggcagaugcagguggacacccgcccagcuuuuaugccaucggguuuaggugcccacugcuuaggacagaacuccacugccugcaacuccagggccaacccucauuagucuaagccaauugugccaaucccaucaccuggccuaucauucaucagaggggagcauguggccaagcucuggccaaucacuaaauucuuuauguucagcucuguucuugggaagggagagaugggguaucucaguugccacuguuccacccacaagagaagcuggacuucauucuucugccucagaccugguaucuggaggccuguggcaucccugagcaccaacauaccccuaagccauagcccaggcaugcugaccaauccaaucccaugacuggcaucuggugccacgucuuaaaccuggcuggcauuuuagccagcacaguccugcuuccucuuccccaguuuccccuggggaagccacuccugccuuauuuucaguucaucugguuuggauggagcugagcccaccugcagcccuagaggcagguaugugacuccucccuggacaagcagggcccuccaccagcacccucucuccacccacagccagugauugguucagaggcuggcacagcaucgaagccaggccacugagcagcagccuuaggacucuuauuagaaccgucaagaaaaaaaacccuuuucccacuguggcuuugggauguaggccuggagcaacuaguaggcauaucugccacuacaugagggaagagccugccuaaaaacgaagccaguacagaauaaagcagggcgcagagcuggacagguuccuagaagcuggauccagccaugccugaaggcagaucuagaaauaugaaaauauuaaauaacauaucuuuggacucugaaggugguaccuuucucuuccccccagcccauccuugggacucucuguaggucuugcacaggccuggggcaugagaaggagauuuauugaccaaacaaaacuugccccacucucuagcaucugugcacuccuuccccccaugccccccgcuuucugagccucugcugugugagccaacugccccauuccugcucuuuccccauaccuggcccagugccaaaggggaaaccagaccugagagauauaaaucgacaccccuggcuuggccagauugagaggaagcagugacagacaccagcaugggagcuuaagguggcgggugccugcucccugagagccaaccaggcccagccugggccccugggaugcacagagccggcccucacaaaccucaaggaacaaaugacagaccagugugugggacagcgggcagauggggaucucuguggccuggggcacucaagagaaagggcacauggcuuuuaggacacaugugggccaaacaggggagcucaucuguaucacacaccuuguacugucauagcccugugggcgggugcucuugucacuccuguguuacagaugaggaaacugaggcacaaagagguuaugggauaugcccaacaucacacagcuggcgaguggcacagcaggcauuggauugcagcccugugggaccccaggucccauauguccagagauugucccuccaaugggaaugugaggaagguggauucaggguggggaaacauggguggcaggaaaugaccucccugcacaccagcagaaaaauagggggacucagccacccacuguggacggccccugccauuacugaccugauaguuuccuguaaauccucucgcccuuuuuaaagaugucaauacauguacuuaagaaggaacuccacuggccaggugcgguggcucacaccuguaaucccagcacuuugggaggccaaggcgaguggaucaucugaggucaggaguuugagaccagccuggccaacgcagugaaaccccaucucuacuaaauauacaaaaauuagcugggcacgguggcaggugccuguagucccggcugcucaggaggcugaggcaggagaaucgcuagaacccaggaggcggagguugcagugagccaagaucacgccacuguguuccacccugggugacagagugagacucugucucaaaacaaacaacaacaaaaacuccaccaacacuacugugaagggaaugucaggaccagcuuccauggggaacaaccaacaaacugaucuuguuuucuugggaaagucuaagccugggguguggccucugcucucuucauuaagaggaauuaguaaacgagucagcuguauggggacuuccuccuuaacccguuggccucaaaagggaacugacacgggucacugucucuugagucaguauuauucucuucaauaauaggguuauucaagugagcugucaaugugccaccuacgaucacuugugucccccaaacugggaaacacagauguggcccacagcccuaccuuuacagaggaggagcggcaugcagagauaacuccccuucucugaugugagggguggggggccaggaagcaaagggacuugccuagugcagagccaggugagaagccaggucucuagcuccugggauuugcuauccagccccagggcuugccucccaggcuccuggcuccagggacugggccucugcuggucacccacccuguuccccagaggucacagaaaaacgucaaagcaugcccacucacaucugccgggucguuuucacuccaaauguugacugcauaggugagaugauuauacagguaauugucagggggauacggguugcuccaggucagcagcagagugucggagacauuggugugaacugucagguuuccuggggcccuggguuucacugcgggagaagcggccucuaugugaggaucuaugcagugacucccccaucacccagcccagccccggccuacaaaccacagccaccacccagauuuuuggucgacaaaaccuccauagcauacuucuggagcaccacacagauucagagccauagcaaagaagauuauaauaacaauaauguugcuaaaauucuacauagaacuuuaguguuuauuaauuacccuuuuuuucuucuuuuuugagacagggucccacucuguugcccaggcuggagugcaguggcacaaucccagcucacugcagccucaauagcccagggcucaagugaucugccugcgcugggcucccaaagugcugggauuccaggcaugagccaccgcgccuggucuuuacuaaccaccuuucuacagugaaggcaaaguguaugagccaaaguaacccaaacuucagccuuuuaaaaaaucuuuuuauuuuuauuuauuuuuauuuuuuugagacguaaucucacucugucgcccaggcuggagggcaguagcaugaucuaagcucacugcaaccuccuucuccuggguucaagccauucuccuaccucagccucccaaguagcugggauuacaggcgccugccaccaugccagacuaauuuuuuguauuuuuaguagagacgggguuuuaccauguuguccaggcuggucucgaacuccugaccuccggugauccgcugggcucggccucccaaagugcugggauuauaggcaugaaccaccacacccggccucaaacuucagcuuuuacagcugcauccuucacaccuuuggccacaucucuguacuuuaugaugauuuacugaguauuuuucuuuauuuugauucaucuguuuuaaaacuuggucuccuuugaagcaaucauauccaugagaccucagguuuuuauuccugugaugcaugucauaucaugcaucacuggaauacaacgcauguuuuaaacuccugucaccacagcccagcaagcucaagggggauuccugcagggacuccggguaccagaagaaggucagccuuccacggucaagaccauccaaagccgcagcagcugaccaguggacacagaauggaaggaauguucccaguucgguuuucaaucagcagcaggcaugccuuccagcaagcacaccucaucucaauacgccuuccugggcacuuaaguucagggguggaaacagcugggcugaagggggcuugguggucuacugcgaccagcuccguuucaaaggugggaggacugaggcccaggcaggggcaggaaucccaucagauuugggaaaauacaggcggcuuccuccugcuguugcuaugaccccaccuccuccccugcccaccccacccucagcccaggcagcugugggaacacacccagccaccccugccgcacuccgcccugcucaccaugcucgcugggcuugaaggagcccuuccacagcagcugcugcccagcccacagguccaguguauaguuauccgcacugaccacgucauccaugagcagguggcacacgcaccccgcgccuccguuguucucagggauacacgugugggcucugcagacacaggggcuggguuaggcuggucaccuguaggcuggcugggccccacagcuguguccgggacaugccuccaggaaccgcaucagacucuuccagcuucccgaucacggaugugaggacagaucugggggcuugggagcggccagggugugcuggggcagccgacuaggguugccucucuugcuggccacagccucuuaccacaugcaccaaggaugcuccucacaccugccuagcugccggcccugguccugggacuuagcuuguuccugaaagcccaugaaagggaagaaccgguggcacuaauuaauuuagaacaacauaagcucugcaucgcacaguuuggccaucguaagauaauuccaauguuccaccuuaacagccaacccacaucucacgggcuaggccaggggucugcaaacuuuuucuguaacaggccagauaguuaauauuuuggacuucaaaggccacacaauuuccuuuuuuuuuuuuuuuuuugguuauuuguauaaauuuaggggguacgaguuuuuuguuuuuuguuuuuguuuuuuuuuccugagacaaagucucacugucacccaggcuagaguacagugaugugaucucggcucacugcaaccuccaccuccugggcucaagcaauucucccgccucagccucccuaguagcugggauuacaggugugcgccacuacacccaguuaauuguuguauuuuuaguagagauggagcuucaccauguuggccaggccggucucgaacuccugaccucaagugaucugcccaccucggccucccaaagggcugggauuacagccgcgagccaccacagugcccggccuuacaagugcaauuuugauggcaagccucagaucuguucucacuggauaugcugccuaguggugaagucugggguucugguggguccgucacccaaaugguguacacuaugcccauuaaguaacuucucuuccuucaccccucucccacccucccaagucuucaaugucuguuauuccaugguacauggaauaaugcccauguguacacauuauuuaacucuuacuuauaagugagaacaugcaguauuugacuuuccauuucugaauuauuucaauuaagauaaaggaggaggccgggcucaguggcucaugccuguaaucccagcacuuugggacgcugaggcggguggaucaccugaguucaggaguucgagaccagcuuggccaacaugaugaaaaccggucucuacuaaaaauacgaaaaauuagccgggugugguggcaggcaccauuaaucccaacuacucgggaggcugagacaggagaaucgcuugaacccgggaggcagagguugcagugagccgagauugugccacugcacuccagccugggcaacaagagcgaaacucugucucaaagaaaacaaacaaacaaacaaacaaacaaaaaacauaaaggagggccaugcaguuucuguuacaacuacagcagccaguguguuccaauaaaacuuuauuuacaaaaacaagcagugggccggauuuggcucacgggccauaguuugccaaucccuggacuaagccaauggaaacaaagcacagcccaucuaccuuagaauaaucauggaauaccaccuuuacuggugaacgcugcaugcuggugugccguauauccccagucugccccguaacugugugucuuguguacgugauuauguccugggcaccaguguaacgaagcauccugugcaccauggaguagcccagggaaccaccugacuccuaugccauguguccugguccauccaccaucacagaggacuccacucucaacaccguacuccucaaucaagggucuaguccagugguucucaaaguguggucugggcccaccagguaaaacucuuuucaucauaauacagggacguuauuugccuuuucacucucucucacuggcguacaguggaauuuucuagaggcuacaugaccugugaucauguaauugaucugaagauuuguugaaugcgggcuugcauguuguugggacuuaaaauuucuccauuuugggccggauacagcggcucacgcuuguaaucccagcacuuugggaggcggaggcaggaggaucacuggagcccaggaguuugagagcagccugggcaacacagugagaccuccauuucaguaagaaaaaaaauuuuuaauuguuuuaauuuuuuaaaaauuacaccauuucuucauugcaaguucuaauuagguaaacauagaaugauguguuaccuacaccaaagcccuuuggguccucacucauuuuuaagugugaaaaaggguccugagaccaaaaagugugagaacugcuggucuaguccaguauuccagccguauccaugugccacguggaccaacacucccaccaugcgcuccacuguaucuuacauaacaugucccuggagaugggaccuccccucuaacaccauauaaacagcagcaaaccauacucagcauccugcacuccagcgcaccaccuggacccagcucacucuuggggcaaacccuuugggcacaaccuccccaaaccuccagcuccagcgcaggcuuacucggagagcagaaaaaccagcugguacaacaggcggagcucggugcugcaauuggugggaccauucaucuuccacucgcaaguagagaugcucauguagucggagacgcaggugggcuccugcaagaccuucauguucccuggggagacacaggagcagccugagcggcccaggaacucaaugcgugagggggacuugcacccaaacaggaccaaggggaauagcacaaaagcacagugcaggcaaaguugagggccagcgcccacagagcuggggccaggaccagggcugcuggagcuucccagcuagugucgggaugacuguggaagcugaagaaauacccaugggugcgggggccauuagacaagaacgaaccaagugcaccuuuaucucacacaaacuugacaacuuguucuuggccaaauuaaagggaaaauauguagcaguuuaaggagugccauuccaucacaccaagccucugcccucgagcuaggggaagugccacuuccccauuugcccacuaucugcgccccucuuugucuccaccccuuucugcccucucugugcucaggaggcugauaccacagucuucaucaccggguacccuuggccuuuaguuuccgguuggguuuggccaaugggagagaggagauggaugggcuggaggagacaucgggguccuucuccuuucagcgcccuccuagcuugucaguggccauggcaggacuggaauuggcaggauguacacugaguuugcuaaaccaccugagcaugagaccacucaggcgccuccaugcucccaugcucagugccacgcccaucucagcugacaacaacuugcauaagggcuuaccauguuaaggagcugucuuagauagcaaauaaauauuccaagcuuaucucauguccaaaacuaacuccugauucccgccccuccccaaaguaccuucucuucuggcauccuucugcauuucagaaaugacaaccgcguccuucccaguaguuuaggucagaaaucuuggagucauccuggccacuucucuuucucugucuuucaccucaauuccaaucuguccucaaaucuaccucccagagggauccggagccucucaucuccuccacuccagaccucccuccagaccuccuggcuuccacccucuuccuuucuccacacggcauccugaagaguccuuuggaacauaauggaugauauggauccucugcucaaacacugcaaggucuuuuuugauucagccacucugucaccuugcugaccuucacugcucccuccugcugcucacucuccuccaccacauucccuccugugcucaacccucccgccaggcucagugcagggccucucugccaagaaugagccuuccccagacaucugcacgguucccgcuuccuccaagucagcucaaugaggccuucccugacuucccuacuuucaacugcaaucccccccacuccacccagcuuccccaacccccucuuaugcuguucuguguucuuuccccaucaccuucucuuuuuuuuugacagggucucacuuucucacgcaggcuggaguggaguggcgcgaucacaguucacugcagccuugaccuccugaguucaagggauccucccaccucggccuccugaguagcuggggcuacaggcgugcacugccacaccuggcuaauauuuuauuauuuguagagacaaggucucccuauguugcccaagcugaccucgaacuccugggcucaagcgauccuccugccucggccuccugaagugcugggauuacaggugugagccacugcacccggcucccaucacuuucuaacaaucuuuagaauuuacugauaaucagggccacuugucauuggcuguccccucccacugcaguguaaucuccauaaggccaggugacauacugcaggacccuggcacgccauuaauagccaacaaaugaaugauugagaaguggugacuuaccagagcuugccaccugcagcaggaccaggcagcucacagggaacaggagcccagagcaaagccaccccauugggagaugccaaggcaccugcagagagagaggaagcagguuagugcugaccugugcuuccagcagagcucaucuuauucaauaugcaacccuccccugcccuggccauuuauuuguuuguuuguuugcuuguuuguuuguuuuuccgagacagagucucgcucugucuccaaggcuggagugcaguggugcaaucucagcucacugcaaccuccaccucccggguucaagcgauucuucugccucagccucccgaguagcugggauuacaggugcccaccaccacaccuggcuaauuuuuguauuuuuaguagagacgggguuucaccauguuggccaggcuggucuugaacuucugaccucaugaucugccccucuggucuucucgaagugcugggauuacaggccugagccacugcggcugcccagccaugcccuggccauuugugucucugccgacaacagguccuccacguucacagagcucucucuauaaucaugaaacaacacccagacccacaaaguccagagggugagcuacacaacaacuguccugggagaugcuucuggauguggccuuccuuggacaacccucuacacauguuucucugauuauuuccugagguuuaaauaccugcucugucacugacuagaugugaaccuugagcaagcugugcuuccaugccucaguuuccuuaucuauaaagugggacuaagaauagccccaucugauugagguguuguggggauuaaaugagcuaacacagacagagcccuccaacagugaccggaacacuuuaaagucucaaguaacguuacaagucagcuuaguccauauaggcugcuauaacaaaaauaccuuagagcagguaauuuacaaagaacagaaacguauugcucuauugggugcaauggugugcaucucuagucccagcuacucgggaaggugggguggaucacuuggaguccagggguuugagaccagccuagggaauauagugagaccucauggugaauuuuugaaaaauuguuuuaaauuuuauuauucaggccagacacaguagcucacaccuguauuuccagcacuuuggggagccaagguggguggaucaccugaggucaggaguucgagaucagccuggccaacauggagaaaccccgucuguacuaaaaauacaaaaacuagccgagugugguggcgggcaccuguaauuccagcuacucuggaggcugaggcaggagaaucgcuugaacugggguaggcagagguugcagugagucgagaucgcgucauuguacuccagccugggcgacaagagcaagacuccaucucaaaauaaauaaauaauaaauaaauaaauuuucuaaugcauaguucuggagacugggaaguccaagaucacgacacuaggagauccagaucuggugagagcccauuccucacggacgaugccaugcugcugugucuucauaugacagaaggggcaaacacacuuccuucagcccguucaugagggcacuaaccccauucaugaccaaccacagagcccucaugacuuaaucacuucuccaaaggccccaucucuuaauaugacuacaaugggaugaaguuucaacauaugaauuugggggaacacauucagcccauagcaccagcuauuaucauuaagaaaaaaauguucagaagccaggugugguggcucacaccuguaaucccagcacuuugggaggcuaaggagggaggauggcuugagcccaggaguucaagaccagccugggcaacagagugagaccuuaucucuacaaaaauuaaacaaaaucagccaggcacgguggugcaugccuguaauccuagcuacuugggagguugaggugggaagaucguuugagccugggaugucaaggcugcaguaagccaagaccguaccacugcacuccagcaagacccugucauaaaaaaaaaagaaaagaaaagaaaacagaaaguuugggaggcugaggugggcggaucacgaggucaggaguuugagaccagccuggccaacauagugaaacccugucucuacuaaaaauacaaaaauuagccaagugugguggcgcacaccuguagucccagcuacacgggaggccgaggugggagaauugcuugaacccaggaggcggagguugcagcgagccgagaccaugccauugcacuccagccugggugacagagugagacucugucucaaaaaaaaaaaaaaaggaaaagaaaaaaaugcuaagaagcagaaucucacggagucaaguguguacuuuuccccagcacuccugguacauaacgucaaauacccuccaaaaaguguguacuggggccgggcgugguggcucacaucuguaaucccagcacuuuaggaguucacaaccagccuggccaacauggugaaaccugucucuaccaaaaauacaaaaaaaaauuagccgggcgguaguggcgcgugccuguagucccagcuacucaggaggcugaggcaggaaaaucgcuugagccuaggagguggagguuguggugagccgagauggcaccacugcacucuaggcugggcgacacagugagacccuguugcaaaaagagaaaaaaaaaaaaaagaaaaagaaaaaaagaaaacagcacgcgcuggguuauauucccugcaacauuucaagugcccauccuucacuucccgcuugggucucucuccugggaucuuauucaaaaaagcagcucccaggcuuuguucugcuagugaguaguucuuugccauuaacagcauuucucuuuuggugcucuggcuguguuucuguggcacaggaaugguuccaaggcuaaccucacaggcuugcagcaaacaggaacggagguguugccucugaagcacugugugcagugucuggggcaucauaagaacuuaaggccaccucaggagcucuaggccccugcuggaugcucuccgagugacuugggcacacuugaaggcccuccccccagcagggcuccaccucccucuccaccugggcccagcacccaugcauccuacgccugccaccuacacuucuucuuuuuuguuuuuuaacauuuuauuuuauuuuauuucauuuuauuuuuuugagacagaguuucacucuuguugcccaggcuggagugcaauggcgcgaucucggcucacugcaaccuccgccucccagguucaagcgauucuccugccucagccuucugaguagcugggauuacaggcaugggccacacacccaacuaauuuuguauuuuuaguagagacaggguuucuccaugcuggucaggcuggucuugaacucccgaccccaggugauccgccugccucagccucccaaagugcugggauuacaggcgugagccacugagcccggcugccaccugcacuucuuaaacacaccaaacucagucccaccuccaugccuuuucucucucuguccccuccaccuggagggaccuucccuuccucccuuuccuuuuuuuuuuuuuuuuuuuugagacagaguuuacucuguuacccaagcuagaguguaguggcacaaccucgacucccugcaaccuccaccucccgggcucaagcaaucuucccaccucagccuccugaguagcugggaccacagaugugcaccaugaggccuggcuaaguguuuguauuuuugauagagauggggucucauuauguugcccaggcuggucucgaacuccugaguucaagcgaucugcccaccuuggucucccaaagugcugggauuacaggcgugagccacuguacccggcccuuccucccuuacgcgugcuuuuccucucuuccccuaauuuaugauggugcaaaaucaauggguguucaguagaagcaguacuuggagcacccauacgaccauucuguuuuucacucucaguauuccauaaacuacacaagcuauucaacacuuuauaacaaaacaggcuuuguguuagaugacuuugcccaacuguaggcuaaugcaaguguuccgagcuaaguuaagcuauaacguucaguagguuaggaguaugaaguacauuucugacuuaauaauauuuucaacuuaugaugaguuuauggggacaaaaccccaucauuaagaaacaucuguguaugagacacauaaacacacucacauaucuccauaaugaauaaauuaccccaauaccucagugugcaugucagaaaaacaaggacauucucugcauaaucacaauacaaccaucgaaaucaggaaauuaacagugaugcaucaccacuaucucauccacggccccuauuuauguuuugcuaauugccucaauaaugcccuuuauacguccaggaugcaauccaagaucauucaucacauuugauuaucaugccuuccuagugaccaggucuuggcuucuaaauacuauucuguacugaaaggaaccagagcgccuuagagaaauagcugauuccaggagaaggaaaaguaccagauaggcuuggaauucuugugccagacaauaaggaaguacucagcagcuagccugaccuggacaaaacaggcacauuuugagcaucaaaaugaauauuaugguauccacuuguaacccuuggaguuaaaguccaggagucuguauugacauagaucaauaaauggaggaggccgggugcaguguggugugugccuguaaucccaacuucuugggaggcugaggcaggaggauggcuugagccugggaguuggaggcugcagugagcuaugaucgcaccaccgcacuccagccugggcaacagagucagacuucaucucuaauaaauaaauaaacagggaagaagggaaagcucuauuuuacuaugacagccucaaaguaacucccugcaaaacuuguauuguauauuaacuaaugagugaaaauacauaucaaugaacguuacaauacagaaaccuggcagacaccaccuucaccaagugaucuaaacucaccaacaagaaugggacaaauccccaacaucaccucccugaaacaauuccugagaagagcacagcaugucuuuuccuggguuccugccaaggaugcauacaucauuuggaaacgucagacaaauguacaccaagggccagucuauauacaagaacuggccgcugcuccucacgaagugccaggggugcaaaggacaagccagcgugggacaucugucccuuuuuaaauugucugucauccugacagccagggucugucccauucacugccgaguccccaguaucuacaacggugccuggcacauaggacguguucaguaacuguuuguugauuaaauucauuuuggacaugauguggggccccuaacuggcucagcaugaggcugcaaagcucucucuaggggaaggcucuguaucggcucaaagguugaacucgucuuccuugcugagaguuacaaaaguaaagucucaaguaaaggaggggcgggaauggggugguggguuccugacacugauuuccuuggcaaguccuaguaacuuuuacucucacaacuacacagaugcccacaguauccuguggcagagauggcaaaggugucacuuuagccucaauuaugaauaaagagaaacagagaggccaagacgccuguccaaagucacacagcagaagacuuucaugguaaaguccuccagggaaacaggggagucaacaacccugucaagauucacuaaaacaucccagcauggcgucaggauugauauccuuaaucuguuguggaaggcacgcccagacuuacgcaugcccaugugcacacacacgugccgcagcuagcuucucagggaugugugggugcuacauuucaggagagaucacagaugcagugggagaagaggcuucccugaacaucagaggcaaaaagaacaaagaugcaggugaguaaaagaauuaaaaagauaagugccagguuaucgcguucaaguacacggcaagaggagaugauuucaaguucccauucuaaaucaagagacuccuggcugggcgcgguggcucacgccuguaaucccagcacuucgggaggcugaggcaggcagaucaugaggucaggagaucgagaccauccuggcuaacauggugaaacucagucucuacuaaaaauacaaaaaauuagcugggcgugguggcgggugccuguagucccagcuacucaggaggcugaggcaggagaauggcuugaacccgggaggcggagcuugcagugagccaagauugagccacugcacuccagccugggugacagagcaagacugucucagaaaaaaaaaaaagagauuccugaagugguggaguuggaaggggucucagcggucaccugccaagcucaacugccaaccuggacaaggauguccugcgaacaccccacuucugacaugcugcuaggcaguuucagcccauaugccaccacagauggagcaaucacucucaggucucaguuaagcagagccauuggaaacagccuccuuauguugagucaaggcuuugugugaacaaaaucccugcuugcccagcacuuaccuuguacuugacacuuugcuaggugcuuuagaaguauuaccucaccgaauccacacaagaauccugaaagguaggcuguuaucccaacugucuagcuaaggaaacugaggccagagaggccaaauaacccauccaccaggucccacagcugguaaaaggucagagcuagaaucagaacccacguuuguuugcuuccgagcccaccguggauuccaguauaccaguuccuucaaucucaucuccuaaaacugcaggcugaacccaauaagaugaaauaaaaugagccgggcagaguuggccauccugcuugucaauuucaaacaacaguuccgcaaguguaggauaagaaaaucugacugagcagcagaaaaguccugaggauuuuaucaucugcaaaaucuccaaaagccaauggugaagcagcaacuuaaaaaaaaaaaaagagucacccgaggucauauuaacagagguauccauuuauagacuguuacaucucacaacagcagaauauacauucuccucagguucauguggaauaaucaccaagacagaccacauucugggacauaaaacaaccuuaagagauugaaaacauuagaaaucacacaacauaugcucuuaggccacaauggauucaaauuagaagucacuagcaggaagaaagccagaaaauuuccaaguauuuggagauuuaaaaacacacuuccgaauaacauauggaucaaagaagaaaucacaagagaaacuaaaaauauuuuuaacuaaauaaaaaugaaaauauagccuaucaaaaucggugagacguagcaaaagcagugcuuagagggaaauuuauauuauugaauguauaucuuagaaagaaaguucuaaaaucaauaaucuguuuccaucuagaguacuagaaacagaaaagcaauauaugucuaaaacaagcagaagaaaaaaauacaaaauuggagcauacaucaaugaaauuaaaaauagaaaauuaaucgaggaaaaucaaugaaaucaaaaauugguucuucgaaaagaucaaugaaauugauaaaucucuaccuaggcgaaucaaaaaaaugagagagaaggcacuaauuaauaauaaugugauauggccuggcucuguguccccacccaaaucucaccuugaauuguaauaugaauuguaauccccacguguugggggaaggaccucaugggaggugauuagauuacgggagcaguucccccaugcuguuuucgugacagugagugaguucuccugagaucugaugguuuuauaaagggcuuucccccccuuuccuuggcgugucuccuuccugacgucaugugaaaaaggaugucuuugcuucccuuuccgccaugauaauauguuuccugaagccuccccagcccugcagaacugugagucaaaccucuuuccuuuauaaauuacccagucuugggcauguccuuagagcagcaugagaacaaacuaauacuauuguaaauuaaagaaaaguuauuagagguggcacaugccuguagccccagcuacugggaaggcugaggcaggaggaucacuugagcccaggagguuaaggcugcagugggcuguguucaugccacugaacuccagccugggcaacagagaaagauccugucucaaaaaauaaaaaauaaaauuuuuaaauuaaaaaaaaguggcacuauauaaugauucgggaguuaauucuccaagaagauguaaauaacaauccuuaauguguaggcaacuaacaacaaagggucaaaauauguaaggcaaaaacugagagcagcaaggagaaauagagaaaucugugugauuauucugaauaauacuauuauuggauaauaauaguauuauuacuauuacuucaacucuuuugguaaucgacagauccagcaggcagaaaucaguaaggacacaguugacuugaacagugcugucaaucaacuggaucuaagugcagugugcaaccacaacuuggcaucccuuuggaaggaauacugcugucauguaugacaacaaccaacacagagagggccugauaaucccaggaggccuagaaagucuuuaccuggaaagcucugcccuccuauacugggcagccucaccauucacuuaaacacacagaguuuaccacaugccaaguuuucuuuuacaucuuuuacauacaagaaugcauuuaauaaucuaugaaauagguaauauuauuuucuccauuuucagaugaggaaaccaaggcacagaaaggcugagugauuugucugagguugcacagcugugacagucaugggucuuaaauccagcacucaagcuccaaagcuuugguucuuaacuacuaucugucuagaagucagagaccuuaguguuuuggggaucaaugaccuaucugagcaucuaauguaaaccccaaacccuguuucuggcaaggugcauacacuuaauucugcauuccauuuuagggguucacagaaucccugaagcccaagugaggaccucaggucaaaggccuguccucuaagcagugggcagcuuuugagggucuuugagcaggggaguggcaaauuuuugagaagucuggggggaugugggcaguuagcaguugcugcagaugaggcucacccugccucuucuccacaucacagccagagccauuuuaaaaucagaaaugagaccagggccagcucacacauccaaugcccccuggcuccuaaagggcuucuucacaggggccacagauccccaggggguucacagcucauuagagaagcaucucugacuuagaauaaaauccaagcccuagagugaaaaaagccaguucccagaguacacaccccgugacuccauuuauguaacauacuugaaaucacauaaccauggaaauggaaaacacaucagugggugccaggggcugagggggugggucaggaagggaguuggauguggcuauaaaaggagaauuugagccauccuugugaugauagaacugugcuggauccuggcugcauacacaaaccuaugccgugauaaaauugcauagcacuaaaccacacaugcguacgcaaacacaaaaaugaguacaaguaaaucgggaaaucccaauaaggucaguagcuuauaucagugucaguaucccagcugugauacuguauuacagauuucuacaaucuugcccucggggggaacagcauagaagcaggggucucucugugauuucuuuuucuuuuucuuuucuuuuuuuuuuuuuugagauggagucucacucuguugcccaggcuggagugcaguggugugaucucggcucacugcaaccucuaccuccuaggcucaagugauucuccugccucagccuccccaguagcugggacuacaggcaagccaccaugcccaacuaauuuuuguauuuuuaguagagaugggguuucaucauacugaccaggcuggucucgaacuccugaucucaagugaucugcccgccucagccuccaaaagugcugggauuauaggcaugagccaccacgcccggcuucucuaugauuucuuccagcuguguguaaaucuuuaauuaucugaaaauaaaaaguuuaauuuaagaaaaugaagaaaagagccaauuccccugcuuaucccucuaacauuccccuccuauccccucucccucuucugcaauccuccauuggccucagcccugggauacacucccagcucucccuuuuccaagcauuugcaccagaaacacuucagaagccuucucugaccccccucaacuaaugcgggcccucccugugacuucuuaucacagcacccuguuuaugucugucccaguacuuaucacuaucucuaaucagauuaaugagguuacauguaugaauguuuauuuuauuucaagaugcagauagcaaagauagcuuugacugcaaaauguuuucaacuucccuagauuuuuuuuuuuuuuuuugagacggagguuugcucuguuccccaagcuggagagcaguggcgugaugucggcucacugcaaccuccaccucccggguucaagcgauucuugugucucagccucucgaguagcuggaauuacaggugugugccaccacacccaacuaauuuuuuguguuuuuaguagagacaggguuuccccauguuggccaggcuggucuuaaacuccugaccucaagugauccacccgccuuggccuccaaagugcugggauuacaggcaugagccacugugucuggccuagauuaaaauaugccauaagaaaaagacagaacucaaguguguuaguccauuuuugcauugcuauaaagaaauaucugagacugaguaauuuacaaagaaaagagguuuaauuggcuuauggcucugcaggcuguacaggaagcauagcacccguaucuacuuggcuucuggggaggccucagggagcuuuuauucacggggaaggcaagaggggagcaggcguacauggugacagccagggcaagagagaggagggaggugccgcacacuucuaaacaaccagaucuugugagaacucacucacuauggcaaggacagaaccaaaccaugagggacccguccccaugacccaacaucucccaccaggacccaccuccaacacuggggaucacauuucaacaagagauuuagagaggaugacaucccaacuauaucagcaagcaaaagacuagaaaaagguagcaaucuacauuaugaacgguuaauggccuuaauauaugaagaguucuuacaaaucaauaagacaaacaucccuuuaagaaaaauaggcaaagaacauaaaugguucacaaaagacauauuccuccaucagaugugaaauagccaccucaauauacugcuaguuuuucaaguugggaguauaauagguaaccucaaauuuaaauuauguauuugucuauaaaugcauuguuugccucccucugagagaccacaagccccaugagggcagagcuuuaugucugcugugcucacugcuuuauccccagugccugaaacagugccugacacaggcauagcauguguacaauaaacauauauuaaaugaaugaaugguuuaaaagucagcaauaauaggcugggcacaguggcucacgccuguaaucccagcacuuugggaggccgaggcagguggaucaccugaggucaggaguucaccaacauggugaaaccacaucucuacaaaaauacaaaaauuagccgggcaugauggugggugccuguauucccagcuacucgggaggcugagaggcugaggcaggagaaucgcuugaacccaagaggcagaggcugcaaugaguugagaucacaccauugcacuccagcccgggcaauagagcaaaguucugucucaaaaaaaaaaaaauucagcaauaauaaauucaacaaucuuuuuuuuuuuuuuuuuugagauggagccuagcuuugucaccagucuggagugcaguggcacgauaucagcucacugcaaccuccgcguggguucaagugauucuccugccucagccuccugaguagcugggacuacaggagcacgccaucacaccuggcuaauuuuuguauuuuuaguagaaacgggauuucaccauguuggccaggauggucucgaucucuugaccuccugauccgccugccucagccucccauagugcugggauuacaggcaugagcuaccgcaccuggccucaauaaucauuuuuaaacaugaaccaggucccaagcuuuuguccauaguuaacuguauaugcaguacuuauuuugugccuggcccuguucuaaguacuuacaauauauuaaucaauuugguucucccaacgacccuaugagguaggugccauuaacauucccauuuuacugaugagaagacugaggcacaaaaaggcuagagcacuugcugguggucacagaaccauaaccuaggcauugucacuccaaaauccacguguuuaaggacugugguugcugacccuugaaaugcaguccccaaaacccuggaacuuuguccggggagccccacuggccugagacccauuggccugagacccagagacagcaagugacaaggccaaggucacagaguuaggaagcagcaaagucagugaaggccgcagccaggaaaugagcagaagcaugggccugggaaaacacgcccgccaccaggagaacacacuugacucacuuuuuuuaaaaaacucgggggagauuaagugauuaagccuugaaaugucagaagccagcagcagccuggaagcgacccagcaggacucuucccgaacccacagcggguggcaggggggcagggggcggaggacugggggcgcacagggggcgguacaggccuucugcucuucuucccucugggcaggaaaccuggcuuggaggaggggcugguucugcagacaggaugcaagcaccucugugacagguggcauguggagaggaauccagggacagcaggggccucgggugggggcuggggcuuuggagccgcugaccccugaaacuccacgacagaaacuggccugaaaccucagcuccuguggcgcaaucaguuagucaugcuacuuauaagaaaccagcccagagcuuccucuggcuucugggacagcugggcugggcuggcaggaagcuaggcaugcacuucuuccugggacaguaaccuaccuagaacugggguuuccagaaauggcagccacgucgguggccccacugggauaguaaggcaggccaggccagggccccagaauggcccgggaucugccugguuggcuccguccccagcccagccagugggagggaggggaggcaacagacuggcucugcagccaccaggaacacaaaucggcccccuccaccaacagcacccaccagccucccugugggccugcuguggcucaaccauccucacccacuugcucaaguaccucacuuauucuccuucucuuuuuugcuuuagagacagggucucauucuguggcuagaaugcagucgcaccgucacggcucagugcagccuugaacuccugggcucaagugauccuccugccuuagccucccaaguaguugugacuacaggcacacaccaccaugcucgaauaauuuuuaaauuuuuguagagauggggaucucucucuguggcccaagcuggagugcuauggcacaaucauagcucacugcaaccucaaacuccuggccucaagcaaaccuccugccucggccuuccaacaugcuacaggcaugagcugccguguccagccaucuccucauuuauucuugcuguggguguuuuccaaguacugccuaugugcuggcuauuacagaugcaaacaggccauucauucauucauuccuuucuucuuuuaacaaauauuugagcaaggaagaaguugccagagcguuuugagcaaagaagugacaugaugagacuuuaaaaaagaccucucuugcuuggguggugggggcacggguagaaguggguagcagugaggaggcuaccacacuggccccagagagaggugccagggcucacaccaggcugcggagauggggagguugagaaggggcugaauucuagaucuguguugaagacagagcccacaggauuugcugacaggauggaugcuguggggcgggagagagaacaggaaggcuaauaggagucaagaaugauuccacagccauuggccuuuuccaagauggcggccuguggggguagcccgugugacaagccagccugcugggcaagcugcaggacuucagauuagcagaggaggcuguuagcaggcgcucagggaagacccucccucauccuagagggucagguuucuuuaucggggaugcaccagaguucucucggggaggggcccgacauacagcaggcacucaauaagugagcauguguauuuuauuuuauucuuauuuuaacagguauacaguguuuccuuggugccagacacuggccuaggugcuuuaagcccucccuaugagauaaguauaauuauuaaacccauuuuaugauucugaagguucuuuuuuuuuuuuugagacagagucucacuguguaguccaggcuggagugcaauggugggaucucaguucacugcaaccucugucucccagguucaaguaguucuccugccucagucucccgaguagcugggacuacaggugcccacaacaacgcccagcuaauuuuuuuguauuuuuagcagacacaggguuuugccauguuggccaagcuggucucaaacuccugaccucaggugauccacccaccucagccucccaaagugcugggauuacaggcgugagccacugcgucuggcagauucugaagguucuuaugagagggcggggugagggagggaaugagggaagacccagcgaauaggcaggcaggagggagggcacggcccacuucccacccuacaagcggggcccuuggcuggagcaagggggagaaggacuggcugggauggcagcuggaagguuggcaggccggggacaacaccgucugccaagccauggcaguagacucaaacucugucucuagggcaguggggagccagugaaggcucuuaagcaggagaggagcgggcugagcugagagcuggcgaagagggggcagguuugagccuguuugggaggaggaggcagcagggacuugguggcgcuugguggggaaagcaggcuggggagagcggggacagagggaaaguggccucaggcuggggugguggggaggaucccagggacccuucccacgauggagagccgagaagagaagcagauuugcuggggaagaccacgcgcuccggcgcacuguggacacuuugaguccacacagucaacaggcaacuccauccgggauccuggaagccaggccugucuucagaagauuccagaggcccaaaggaggaaacagagccugaggaaacuguguccagaagccaccuacccaggaacagcagccagccuggccuccaucuuucugcaaccuguuaucuugcuuuauuucucugcaaucuuuguggcauauugcacacucgggccuuauguguuuggugcucauauccccuacugcaaggccagcucacacaaggccagugucgaucccgcucacagccaucuccccagagccuagcacggugccuggcacacagcaggugcuccaugaauauuugcugaauggaagaacgacaggaugaauuccccuggcugugagcagggaggccugguuggucauccccaauuuuccaccucucccugcugggcaaacacuagcaaauccuggcuuggaguccccuuaaauguccuaaugcaggcacagaucucagccaccucggggcccugaccuccagagagcugguuaucgacuaucacucacuguccugagcagcggacaauggccucuuggcgccagggugcugauuagauuuugacugucuuagugacagcuauggcuccuagcuggccuccuucuugaggucugcagaggucacugugacuggccacguguccccucuuccuucagccaugagaggccaugcccugggcccuucugcccuugguuucgccccuccccaacugggugcaacuuugcucaccagccuuggcauugguuguaccagucucacuaacaaaaaaaagcacuugaaggcugggcgcgguggcuccuaccuguaaucacagccauuugggaggcugaggcagguagaucacuugaguccaggaguucaagaccagccuggguaacauggcaagaccccgucucuaccaaaaauacaaaaaaaaauugccaggcaugguggcacaugccuguagucccagcuacuaagggagaugaggcaggaggauggcuugagcccacgaggucgcagcugcagugaacugugaucaugccacugcacuccagccugggcaacagagugagacccuaucucuaaaaaaaaaaaaagaagcccuugagccucacucacucacuuaaccauggacccaauccaaggagcauugcagauacaauuaauaucaucuccauugcagagauggagaagccgaggcccagagagggucaggaaccugccuaaggaugcacagcuagugagugggcugggauuugaacccaggccuuuggcucuggagugcacagcacagugccuggcacagaagcagucauaaacuugcuuuuuuauacaccacucuuuuuugcuucuccuggaaagcucacuauggaagauacaguaaaauauucucccugcaagcacagauggaggaaugaggcugagggagguucagaauuugcccgaggugauggugacggagcaggaaguaaccagguaggaauuuagaaucuggccuuugucaccauuugcucggcccucagcagcagugaacuugucucaacaaugaccaggacuuugcccccugggcaaacccaaagccaggacaacacaugggcacagguaagagcuucccguucauuuucugcuugcagacuggcauauggaaggcaguggguggggacuacccauggagcucuuccuguugucucaccccauaccauuccuggauggguggggacacacagacaugggggccaccuuugugggcagggacccccaagcaucugagacacagaagcauaacucugggccuaagugcaggcuccaaccugacucggugggagaccguggcaggcuggaguccacucagagccucagucuccucaucugugaaaugagaauaagaucacuugcuucauggcugguugcaaggcugcuguuguuuuuaacucaucuggcuuauuaguacaggaguacugacaucaauaaaauagaauucaugacaaugaugucuugaguaaguauuagaagagagaagguggaugguuuuuuuguuuuuguuuuuuugagaaugucucacucugucaccuagacuggagugcaguggagcaaucauagcucacugcggccuugaauuccuggucucaagugauucucccaccucgcccucccaaguagcuggaacuacaggugcacgccaccacacccagcuaauuuuuaguuuuugguagagauggggucucacuaugcugcccaggcuggaaguuggcucuuuuauacugauuaaaggaacaauucagccagcugcgguggcucaugccuguaaucccagcacuuugggaggcugaggugggcagacugcuugaaccuaggaguuugagacuggcccgggaaacauagcgaaaucccaucucuacaaaaaacacaaacaucagcuaggcgugguagugcacaucuguagucccagcuacucgggaaaaugcaacaauucaccaaaaagguauaaaaauccugaacccuuauucuacucauauggcuaugcacuuaacaacauagcuucaaaaauaaagcaaaaaacugacagacucaaaaggagaacuuaacaaagccucuauuauggugaauuguaauuguauuacggugggagguaaaucagguaaaaaaaaaaaaaccacauagugacauaacaaauauagauaauauaauagcuagcuugaucaaauagauacauuucuagaaccuuauacccaacagaaaauauacauucuuuucaaacacaagaggaaaaaaaugaccagaaaauccuauaaagaucucagcaaauucucuaccacugauauuauaggaaccacauauauugaccacaacaaccaugaugaccaaauuuagaaaucaacaauaaaaagauaacuuaaaaaauucuaucugucucaaaaauuuaaaaagcauauaauuaaauaagucuuaaaaugggaaccaaaagggaaauucuaaacugggcagugaauaacauuguguaacaaguuguggaaagaaaccaaagcaguacucaaagaaaaaaugauagcauguuagccugaaguagauuuauuagagagcaugaaaaacuggaaccucuuagcuuuagacaaggacucucagaauagaagaaacuuggauuaacagcagcucauauagaagagaaacauggagauuuuagcugacaagcccaauaugcacuccaagugggauauggcugcuacacaguaugauuccagguugcaucaacagaaguauaagcucuagauccaaggagguaauagucuccuuccucuuugaccaaacaaacagucuuugcgugggacuccaaccaguugacucaugugccaaggcaggccaaacuuauaauuuccugagucagggagaauaccugaaauaacuacaguuguguagucugaauaagagaaguauccgaguuuggagggagauggucacuaccuccaagaggcagaaacagacucagaaaguggaagcuccuagaaagcuaauuugggcugggcacgguggcucacaccuguaauaccagcacuuugggaggcugaggugggcggaucacccuaggucaggaguuugagaccagucuggccagcauggugaaaccccauugcuaauaaaaauacaaaaauuagccaggcgugguggugugugccugaaaucccagcuacucgggagguugaggcaggagaaucacuugaacccgggaggcagagauugcagugagcugagauugcgccacugcacuccagccugggcagcagagugagacuccaucucaaaaaaaaaaaaagaaagaaagaaagcuaauuuggcuaaaucucaggaagauuuucucccaguuagagcugcccaccuguggaaauguggcuucuggaagaaauaugcuagaggcaagaccgucgggaggcuguggcccugccagcuuggagaccugcccagcccagagagcuggugccucuccucccuagaauucagucuucccuuuuaaaaaggcagaauacuucccuggccgcuucaggaaaacauaggccuucucugaguuuuucaaaaaugguucugggcgacuaugcucacugauuuccaacgaagaaauguaauccuuuuaaacucuccucuuugggcuggauagcucagaaccgugguuaaaugcacaggcuucugggucuguagcccuggguuugaaucuggacucugccacuuaggagccgugucacccagguaagucucuagccugagccucagguuccuccucagggaaaugagcaggacacccacucaucuccauuccugcacccagcacagagcgugauguggacuccagccuccacugccagaggccgugguuggggccauggcuucgggaugauucaagcacauuacauguauuacguacuuuauuucuauuauuauuauaugguaacauauaaugaaauaauuauacaacucaccauaaugcagaaucagugggagcccugagcuuauuuuccugcaauuagauggucccauccaagggcgaugggagacagugacagaucaucaggcauuagagucucauaagaagcacgcacccagggccgcgugcaguggcucaugccuguaaucccagcacuuugggagacugaggcagguggaucaccugaggccaggaguucgacaccagccuggccaacacagugaaacccugucucuacuaaaaauacaaaaauuagcugggugugauagcacaggccuguaaucccagccaccaggcugaggcaggagaaucacuugaacauggggagguggagauugcagugagccaagaucgcaccauugcacuccagucugggcgacaagagcgaaacuccgucuuaaaaaaaaaagaaaaaguacgcaacccagaucccucacaugugcaguucacaaaaggguuugugcuccugugagaaucaucuaaugccucagcugaccugacagguggccgagcuugggugguaaugcgagcgauggggagcagcuguaaauacagauaaaacuucgcucacucacccgccacucaccuccugcuguguggcccugcuguguggggaccccuggucugagacacugaggaaggugcucauucauaaaauaauauguaaaaugauuggacugucuguaaaauggggcuuggaggaaccaguccugcgcugcccacauucacaguauuucugggcagauggauggcagggaguacaccgacaauguaaaaaaguggaucgaucuaaauggcaggugugucuucagcacucaggcauagauuuuauuguguuuaaacaccauggugaggacugaggacucuggagcuucuagguucacagcccugcucugccaccuucaggugugugacccuggacaagucacugaaccucucugugccucuguuacuucaucuguaacauuugcaugagaguagcuccuaucugguaggguuauuacacaaguuaaaugagacaaugcagguaucuggccccagcucccucccugaccucugcuccuagaccucuuucuuguuugguuccauccaaccacaccagcuuccuugcugugggucaaacacaccaagcucauucaugccucugggccuuugcacucucuguucccacugccaggaucacucuuuccccagauauccacaugccuugguauuucaggucucaguucaaaagccacuuccucaaagucaccaagcccagaaugcuuucagcuccaugagggcccucauuucugggucacucauucccguguccccagccccuggcacuuuggcuaagcaagcguuaagcaccuagccccgggcuggcacucgagauaugugagcgcguguuacguucaacuuugcuuugcaggcgagaggcucuaagacccagaacacagccccuccccaccaggaacucaauuccaccaaacccuuggaaggccccacggcuccucuuccccucccgggacccacuuccuccaacuccagaugcaagcccagcugggcaccauccucggccgagagguuacagcacccaggcuggcuuuagcgcagaccucagauuucuuaagcaaacgagaagaggugaggaggccugugggggcaccuaaagagagaaugagucagucagagcuagacuugaaacguaagagacaucagcacuucuuggaaaggcaagaacggacgcauuuagacagaacugugcaugcagaaugagggguaagcacaggccagucaggaaguggagucuuccguccucugugagucccuccaccuggcccucucuuccucaucccucucaaaugucaccuccucagggaagcccucccugauuccacuugcacccagcuuugcuuuccuuccuagcacagucuccaccugauaggauauugcagguccauguucucuccuguaaaauccugggggccagacauaguucagaauucaggaugacucaggcuguagaaaggucaccuuguauaaaauacccaccgacaugcccaucaugcagggcgggaaagcacccaaagaucaauugcacuaauaucucugcagaaagacaucugagcaucacaccgaagaggaugaagacucuaaaaagccucaaguuuagcuucaaaaugaguuaugaaaaacuuucgguuuucagaaaucguggauuucagaauaacagauaaagcugccgaucugaacauauguauugguuguacauugccuguaugcucaacuagaaucuaaaccccaggagagcaaaggacuugguccgaugcucuggcacauauaggugcucaauaaauuccugaggaagaaaugcaggaggaagccaggugcuggauacgcagaagggacucgguccaaaaugcagagaaaaacagcaaucacugagcgccuuccaagggcaaaaugucuauacaaacuaucucaugaaugcucucccugcaaacacccaugacaaaacaaagggaggcucagagagguuaaacaacuuccuccagauuacacaguggagagcugggaaguagccagcuccgauuuaaaccugggauccccucuucaagcucaggcccuucucucugccuuaagcucagagacgcagagcaauuugcuggauaucauaaaacaguggugaugcacccggucugacaguggaucccccagccucuguagcaccucaagccucugccggggcgcuccgauccacauucaccaagggcaggucugugcaaccuccagacaagcuccuggccucucuucuagcccagccaugguaagucuagcuaaacguggcugggcaugucuccacugugccagccaggaggaaaacucagaaaugucuuucuuggucaccccagugaacugguacaagcaggaaagaauacaugggaagaaaaguaggauggagucugucccucagauguggaccugaggcaaggcuacugcauucaucuccgggucucaguucucaccugcaaaaugaguggacuaaaucccaaccaauaaagcucaaaggaggcaacaguaaagauuuauucauuuaggccaggcacguuugcucgcaucuauaaauccaacacuuuaggaggcugaggcaggaggacugcuugagaccagcaguucaagacuagccuaggcaacauagcaagauccugucucuaaaaauauaaaaacaauuagccagccgugguggcacacaccuguagucccagcuacucaggaggcugagguggaaggauuacuugaacccagguauuggaugcuacagugagcuaugauugugccacugugcuccagccugggaaauagagagagaccauggcucuaaaaaaaaaaaaaagguauucauuuaacaaauacauaguuuguacuacauaccagguacuguuuuguaugcuugacauauauuaacucauuuagucaucacuacaauggcauagucacuauaaucucauaaaugcagaaacugaggcucugggaagucaguuacacaguaagcagcaaagccagcauuugcacugggugaucuggcucaaguccauacugucacuccccagcuauacguuuugacagguaacaacagacauauacauugauuguggacccacuggguguuggacauugugugaaguagcuuauaaaacaugucaucaacccucaagaaaguucacuuuuacaaaugugaggaagaacaguacuuaggcggcuucuguccuggccucacucccagguaccagugagggcagucgagagguggggcaucuaaucccaaacgcucuccuccaucgucccagaugggguggguggaagagggcagggagaugggggagguagaaaagguucucucuucucauguauuuauguauuuguuuauuuugagacagagucucgcucugucacccaggcuacagugcaguggcacaaucauaguucacugcagccuugaccaccugggcucaagccauccucccaccucagccucccaaauagcuggggcuagaggcaccugcuaccacgccuggcuaaguuuuuaaauuuuuuuuguaggaacaggaucucacuauguugcccaggcuggucucaaacuccuggguucaagcgauccucucucagccucccaaagugcugggauuacaggugugagucacugcgcccagcuugucacuucuuugacaauucauuucagcuccuuuuugaacugggagcauuagaaaacugaacacccccacccuugcccugggcauuuugcaaccgggauuguauuguauuaaacauaucagucauugagucacuuccuagcauuuggaaacccuuagguuaucucggaccugccgguaacugcauguguuguaaauggggugagugacugcagguuuuccucccugcugccuccccagcgucucccuccagauucagauccagaggcccaggguggggcccaggaaucugcauuguugcuuuuacaacucaagccaaggugaauacacuggcccaaguuccuuggcauggcauucaaggcuuuccacaaugcagcccagcccaacuuuccauccaucucuggcuucugcuuacucccuagguucuguacacagugcccuuucacacuucccagccuccgcccacucugugccucccuuuaccucccauccucuaccugccagacuccccugcucuacucacaaggcuagcucagggucccugggugcugggaagccuggcccagugaccuuugaagagcugauccccucuggcuugugguccugcagccgcuggugcauccgcacccucccagcccucacgucugucuuccugcagagggggugcuccuugaggcaagcaccagugcccagaacaccacccagggccucgcaggagcugaaugagugcuagugagugaaugaguggcuuagcaggucaccucccauucaugggcugggcuagccgaguucuaagaaaccccugcaggacccuggaaugcccuaaugugcaggacacccuggccaaaccuacaccugagccuguuuccccauuggacuuugggauuuugauaaaggcacugaggucccagcaaaugccuugggcuccucauaggcuacugggggcagggaagugcagugggucaugccucccagagggcuggggaaggggagagacuagaacuggagcaggguuagcgcuggccugggggcauuccuugaaccccagaagcagacaaacuagugguccccuaucuugcuuaagucuaagaaauccagauuuuguuuaaaaaaaaaaucagggcucaguggcucacaccugucaucccagcauuuugggaggccgaggugggaggaucacuugaggccagccuggacaacauagugagacaccaucuuuauaaaauaaauuuuuaaaaauaaaauaaagaucagauuccuggguuuacugaaucugaaucucagggcaaggaccugggaaucugcauuuuaagcaaaucucccggagauucugguuauugugggggcuccucaaacgugauugagagauggagagcagcuggcucuggcgugggauugccugggcucuaguccugcugccccacggacucccaagugggcggcaccuuagggcaaguuacuaaagcggcuggggucuuggugaccucaucuguacaauguccaugacgcacagcaccggccacagagaaguuagugggagguuucacuuggcauccuuucaguaaaacaagucccagucaaugaucgcgauuauuggguccaucugauauucggaggcggagaccgccccgauucacugaccuacuacucaaauuuacaguucucagaacuuuccccacccuuucucucuccgaaguccucacugacuuccugagcgcagggcugggcgccacugcccggagaagaggggcugcguggccuccgacagccuaaccccaagccccccacccccgcaggccgucccggcggaggucucacugccagcaccggcuuuggggagcgcuggguguccacguaccccgggccucgcgccuccgcugccguucggcggcaaggacggaaccgggcgcugcuccgcgcgcaccgagagucgcgggcucgggccccgcucggagucggggugguccccgugguccccgccggcggccgagcccuucccgaacgcccucagccggcgugcccgggcgauaccuucgcaacccgauccgcgcgcgggccccggauccuaccugcgcgccccugcuccauucgccguccgggcgcccaagcgggaagugggggaccccuggguggcccuucccuggcccgcgccgcgcgggg

SEQ ID NO: 192893 - RNA, 4999 nt, Homo sapiens
ccaccauggacccccgucugcccgccugggcgcuggugcugcugggcccugcccugguguucgcguugggccccgcgcccaccccagagaugcgugagaaguugugcggccaccacuucguacgcgcgcuagugcgcgugugcgggggcccccgcugguccaccgaagccaggaggccugcgaccggaggcgaccgugaguggggacgggcagggacagcgcucugggaagccgagguggggcaggugcacguaggcgcagaugcacacgugcagggaggugggcagguuugcaugcaugugcccagggcucaccugccggcugcgugcacagaucguggguccgcacuggagugugugugaacgcgcgugugaaaguccccagagccguuagccaggcgugguggcucacgccugcaaucccagcacuuugggaggcugaggcggguggauccccagaggucaggaguucgagaccagccuggccaaaauggugaaaccccaucucuacuaaaaauaauuuuuaaaaaaauuagccggggauaaugaugcacaucuguaaucccagcuacuugggaggccaaggcaggagaaucgcuugaacccggaaggcagagguugcagugggccgauaucaugccauugcacuccagccugggcgacagagugaaacuccgucucaaaaaaaaaaaaaaaagaaaguccucagagcaugagucccccugaggggccagaaacagagugaggcaggagagguaggcucuugcaaguacauggugagauccugucuuaaaauuucaauauuuugaucuucaugaauuuuugccuuaauuuugcuuuguuuguuuguuuuuugagacagggucucacucugacgcccaggcuggagugcaguggugagaucucggcucacugcaggcucaaccuccugggcucaaaccauccuccugccucagccucuggaguggcugggauacaggugcugccaccacacccagcuaauuuuuuuuucuuuuucguagagagggagucucacucuguuucccaggcuggucucaaacuccugagcucaaguaauccucccaccuugaccuuccaaaguguugggauuagcgaugugagucacuguguccagcuuuaaaaguauuuaaaaguauugcuuuugaaaaguauugcuuuucacaauuauguuacuuuauuuuauuauuuuauuuuuauuuauuuauuuugagacauagccucgcucugucacccaaaccagagugcugugacgugaucucgucucacugcaaccucugccucccggguuccagcaauuuuccugccucagccuccagaguagcugggacugcgggcacgcaccaccacaccuggcuaauuuuuguauuuuguuuguuuguuugagauggagucucgcucugucacccgggcugaagugcaguggcacgaucucagcucacugcaaccuccgccuccugaguucaagcaauucuccugccucagccuuccaaguagcugggauuacaggccacuccccaggucacccacuaccaugcacagcugauuuuuuuuuuuuuuuguauuuuuaguagagacaggugaacaggugaaacaacagguuucaccauguuggccagucuggucuuguuuuguuuuguuuuguuuuguuuugacauugagucucgcucugucccccaggcuggagugcaguggugugaucucggcucacugcaagcuccgucucccggcuucacgccauucuccugccucagccuccugaguagcugggacugcaggcgccugccaccaagcccagcuaaauuuuuuguauuuuuaguagagaugggguuucaccauguuagcaaggauggucucaaucuccugaucucgugauccaccugccucggccucccaaagggcugggauuacaggcaugagccacugugcccgggccaggcuggucuugaacuccugaccucaggugaucugcccgccucagccucccaaaguguugggauuacaagcgugagccgcugugccuggccuuuuuacaaauauuuuaaauuuuauuuuaaaaguauugcauuaaaauacuuaccuugcuggaugugguggcucaugccuguaaucccugcuacucaggaggcuaggagggaagaucacuugaggccaggaguuugagaccaaccugggcaauaugagacucagccugagacagagacccuugucucaaaaaagggaaaaauauuaauauuauuauuauuauauauauauauuuugagacagggucucacucuaucacccaggcuggagugcaguggcgugaucucggcucauugcaaccucugccucccagacucaagcaaucugcccaccucagccuccugaguagcugugacuagcuacucucaggcuggugagaccagccuggccaacguggcgaaaccucgucucuacuaaaaauacaaaaauuagccgggcguuguggcgcacaccuguagucucagcuacucaggaggcugaggcaggagaaucacuugaacccgggagguggagguugcagugagccaagaucacgccacugcacuccagcuuggcaacagagcgagacuccaucucaaaaaaaaaaagcugaugcugacauuuggggauguauaugguaguggggcuguccuguauauuguaggguguuagauaacaucucugucuucugcccccuaaugccaugaauagccucacaccccauccaaguugugacaucuaaaacuguccccagacaaguauccccuggaaacaaaaucacccugguuugagaaccacuggugucaauuguaaacugcagauuggguagaggguaaacaacccucuaaauuuucauaaguccuuuuuuuuuucuuuugagacagucuugcucugucacucaggcuggagugcaguggcacgaucucgggucacugcagccuugccuucccaggcucaagcgauccucccaccucagccucccaaguagcugggacuacaggcaugcagaauuaugcccagcuaauuuuuguauuuucugcagagaugagguuuugcuguauugccaaggcuggucaugaacuccugggcucaagcaacgcacccaccuaggcuucccaaaaugcugggaugacaggugugagccacggugccuggccucaaaaaaauauccugauggcuucgugccucccugucuguacccuaguccuggcccuggugcagggauauacgacaaguuugugcagauguguuaacacguguccacaugucucugugugccacuccacuugcgguguuagggauccaggggagguggucugcaaggguguguccucguaggggugugugugugucuguggguccaccacacaugcgugggugaccaggaaguggacccacagacacauguacaccccugcaugucucuguaccacgaggagucugugggugggucucugaccugcucugggugucucacggacccuuggaccuguuggggaaacugacaccaucuguagcuccaagacccccgacacucccugggcagggcauggggcacucagguggcauauggggacccacgcagcuggggaugugaguguggacaugaguugaguggaugagaggauuaaccaggugccuggcguacaguaggugcuuaauaagugcucgcuuuuuuuuuuuuuuuuuuuuuuugagauggaguuucauucuugucaccuaggcuggagugcaauggcaugaucccagcucccugcaaccuccaccuccuggguucaagugauucucccaccccagccuccccaguagcugggauuacaggcguccaccaccacgccugacuaauuuuuguauuuuuuaguagagacagguuuuuaccauguuggccaggcugaucucaaacuccugaccucaagugauccacccaccucggccucccaaagugcugggauuacaggcgugagccacugagccgggccagugcucacuuuuuuuuuuuuuuuuuugagacagagucucacucugucacccaggcuggagugcaguggcgugaucucggcucacugcaagcucugccuccuggguucacgucauucuccugccucagccuccugaguagcugggacuacaggcgcccgccaccacacccggcuaauuuuuugguuguuuuuuuuuuuaguagagaagggguuucacuguguuagccaggauggucucaaacuccugaccucgugauccgcccaccucggccucccaaagugcugggauuacagguguaagccacugcacccggccagugcucacuuuuuaucugcaugcaugaguguuugguggguuacucagugggauguguguggauucgugcacaugcagcaugggguagcauguccucugucguuuccguuccagcugaguuucacucuguccccaggugaguugcuacaguggcuggagagacgacaucugcuccaugggcugguggccgacaguaaucucacgcugggaccuggccugcagccccugccccagaccucucaccaucaccgccaccaccgugcagcugccaccaacccugcacgcuacugcugccucaguggcuguacccaacaagaccugcugacccucugucccuacugauuccuccuugggugcagccucagaguggccugaggcccagagggucuggucuggugagcuccugaggccacacagcaccauaaagucucgcaucuacaggccuuugauuaccuccugggaugggugcucacuaucuaccccagaccaaugccaccugcagccuguggagucaacugcagaauaaaucacacccuagcccuggcuuggaggauccccgcuuucacagaugcuggacacugacagccaaauguccucacuccaggggagccccagacgcuccgcucccugcauguguaacaccccuucuugcugucucuuaguaaauaaacgacccaaagcag

SEQ ID NO: 192894 - RNA, 4999 nt, Homo sapiens
cugcuuugggucguuuauuuacuaagagacagcaagaagggguguuacacaugcagggagcggagcgucuggggcuccccuggagugaggacauuuggcugucaguguccagcaucugugaaagcggggauccuccaagccagggcuagggugugauuuauucugcaguugacuccacaggcugcagguggcauuggucugggguagauagugagcacccaucccaggagguaaucaaaggccuguagaugcgagacuuuauggugcuguguggccucaggagcucaccagaccagacccucugggccucaggccacucugaggcugcacccaaggaggaaucaguagggacagagggucagcaggucuuguuggguacagccacugaggcagcaguagcgugcaggguugguggcagcugcacggugguggcggugauggugagaggucuggggcaggggcugcaggccaggucccagcgugagauuacugucggccaccagcccauggagcagaugucgucucuccagccacuguagcaacucaccuggggacagagugaaacucagcuggaacggaaacgacagaggacaugcuaccccaugcugcaugugcacgaauccacacacaucccacugaguaacccaccaaacacucaugcaugcagauaaaaagugagcacuggccgggugcaguggcuuacaccuguaaucccagcacuuugggaggccgaggugggcggaucacgaggucaggaguuugagaccauccuggcuaacacagugaaaccccuucucuacuaaaaaaaaaaacaaccaaaaaauuagccgggugugguggcgggcgccuguagucccagcuacucaggaggcugaggcaggagaaugacgugaacccaggaggcagagcuugcagugagccgagaucacgccacugcacuccagccugggugacagagugagacucugucucaaaaaaaaaaaaaaaaaagugagcacuggcccggcucaguggcucacgccuguaaucccagcacuuugggaggccgagguggguggaucacuugaggucaggaguuugagaucagccuggccaacaugguaaaaaccugucucuacuaaaaaauacaaaaauuagucaggcguggugguggacgccuguaaucccagcuacuggggaggcuggggugggagaaucacuugaacccaggagguggagguugcagggagcugggaucaugccauugcacuccagccuaggugacaagaaugaaacuccaucucaaaaaaaaaaaaaaaaaaaaaaagcgagcacuuauuaagcaccuacuguacgccaggcaccugguuaauccucucauccacucaacucauguccacacucacauccccagcugcguggguccccauaugccaccugagugccccaugcccugcccagggagugucgggggucuuggagcuacagauggugucaguuuccccaacagguccaaggguccgugagacacccagagcaggucagagacccacccacagacuccucgugguacagagacaugcagggguguacaugugucuguggguccacuuccuggucacccacgcaugugugguggacccacagacacacacacaccccuacgaggacacacccuugcagaccaccuccccuggaucccuaacaccgcaaguggaguggcacacagagacauguggacacguguuaacacaucugcacaaacuugucguauaucccugcaccagggccaggacuaggguacagacagggaggcacgaagccaucaggauauuuuuuugaggccaggcaccguggcucacaccugucaucccagcauuuugggaagccuaggugggugcguugcuugagcccaggaguucaugaccagccuuggcaauacagcaaaaccucaucucugcagaaaauacaaaaauuagcugggcauaauucugcaugccuguagucccagcuacuugggaggcugaggugggaggaucgcuugagccugggaaggcaaggcugcagugacccgagaucgugccacugcacuccagccugagugacagagcaagacugucucaaaagaaaaaaaaaaggacuuaugaaaauuuagaggguuguuuacccucuacccaaucugcaguuuacaauugacaccagugguucucaaaccagggugauuuuguuuccaggggauacuugucuggggacaguuuuagaugucacaacuuggauggggugugaggcuauucauggcauuagggggcagaagacagagauguuaucuaacacccuacaauauacaggacagccccacuaccauauacauccccaaaugucagcaucagcuuuuuuuuuuugagauggagucucgcucuguugccaagcuggagugcaguggcgugaucuuggcucacugcaaccuccaccucccggguucaagugauucuccugccucagccuccugaguagcugagacuacaggugugcgccacaacgcccggcuaauuuuuguauuuuuaguagagacgagguuucgccacguuggccaggcuggucucaccagccugagaguagcuagucacagcuacucaggaggcugaggugggcagauugcuugagucugggaggcagagguugcaaugagccgagaucacgccacugcacuccagccugggugauagagugagacccugucucaaaauauauauauauaauaauaauaauauuaauauuuuucccuuuuuugagacaagggucucugucucaggcugagucucauauugcccagguuggucucaaacuccuggccucaagugaucuucccuccuagccuccugaguagcagggauuacaggcaugagccaccacauccagcaagguaaguauuuuaaugcaauacuuuuaaaauaaaauuuaaaauauuuguaaaaaggccaggcacagcggcucacgcuuguaaucccaacacuuugggaggcugaggcgggcagaucaccugaggucaggaguucaagaccagccuggcccgggcacaguggcucaugccuguaaucccagcccuuugggaggccgaggcagguggaucacgagaucaggagauugagaccauccuugcuaacauggugaaaccccaucucuacuaaaaauacaaaaaauuuagcugggcuugguggcaggcgccugcagucccagcuacucaggaggcugaggcaggagaauggcgugaagccgggagacggagcuugcagugagccgagaucacaccacugcacuccagccugggggacagagcgagacucaaugucaaaacaaaacaaaacaaaacaaaacaagaccagacuggccaacauggugaaaccuguuguuucaccuguucaccugucucuacuaaaaauacaaaaaaaaaaaaaaaucagcugugcaugguagugggugaccuggggaguggccuguaaucccagcuacuuggaaggcugaggcaggagaauugcuugaacucaggaggcggagguugcagugagcugagaucgugccacugcacuucagcccgggugacagagcgagacuccaucucaaacaaacaaacaaaauacaaaaauuagccaggugugguggugcgugcccgcagucccagcuacucuggaggcugaggcaggaaaauugcuggaacccgggaggcagagguugcagugagacgagaucacgucacagcacucugguuugggugacagagcgaggcuaugucucaaaauaaauaaauaaaaauaaaauaauaaaauaaaguaacauaauugugaaaagcaauacuuuucaaaagcaauacuuuuaaauacuuuuaaagcuggacacagugacucacaucgcuaaucccaacacuuuggaaggucaaggugggaggauuacuugagcucaggaguuugagaccagccugggaaacagagugagacucccucucuacgaaaaagaaaaaaaaauuagcugggugugguggcagcaccuguaucccagccacuccagaggcugaggcaggaggaugguuugagcccaggagguugagccugcagugagccgagaucucaccacugcacuccagccugggcgucagagugagacccugucucaaaaaacaaacaaacaaagcaaaauuaaggcaaaaauucaugaagaucaaaauauugaaauuuuaagacaggaucucaccauguacuugcaagagccuaccucuccugccucacucuguuucuggccccucagggggacucaugcucugaggacuuucuuuuuuuuuuuuuuuugagacggaguuucacucugucgcccaggcuggagugcaauggcaugauaucggcccacugcaaccucugccuuccggguucaagcgauucuccugccuuggccucccaaguagcugggauuacagaugugcaucauuauccccggcuaauuuuuuuaaaaauuauuuuuaguagagaugggguuucaccauuuuggccaggcuggucucgaacuccugaccucuggggauccacccgccucagccucccaaagugcugggauugcaggcgugagccaccacgccuggcuaacggcucuggggacuuucacacgcgcguucacacacacuccagugcggacccacgaucugugcacgcagccggcaggugagcccugggcacaugcaugcaaaccugcccaccucccugcacgugugcaucugcgccuacgugcaccugccccaccucggcuucccagagcgcugucccugcccguccccacucacggucgccuccggucgcaggccuccuggcuucgguggaccagcgggggcccccgcacacgcgcacuagcgcgcguacgaagugguggccgcacaacuucucacgcaucucuggggugggcgcggggcccaacgcgaacaccagggcagggcccagcagcaccagcgcccaggcgggcagacggggguccauggugg

SEQ ID NO: 192895 - RNA, 18467 nt, Homo sapiens
augugggguuaugagcugaaagcaauaaggagcuaugaaggguaucugagcagggggugggugggaugaggucagaucugccugauagaaauuccugcagcuuuugccucacacauguccuguuuuauguuuuugucuucuuauugccgcccaguggaguacaguggcgcaaucaugguucacugcagccuccaacuccugggcucaagcgauccucucgccucagccucccaaguauagcugggacuacaggcaugugagcaccaccacgccugaguaauuuuuuauuuugugcagagacaggauccagaacuccugggcucaagugauccucccacuuuggucucccaaugugcuagaauuacagcccugagccacggccccaugccccguuuuuaccaguguauauuuucuacuggaaaaugagacuuuuagggaugaauguggacuugucuguugaaacuuguaaauuugcuuaaaaaaaaaaaaagaucuccaagucuucacaaaauuuuauauuccccaaggcugccccaucacaaugccugugaagcuugacuggcagacacugaggccugaagcugggggcuacagggggucacuggcucacccgguccccccguaaucuguaaaacauacugggugagggaggcugcuggaggaccugaaucucucccuucuccaggcaguagugaggcauaugccuguuggccuugggcccauuaaagaucauuccagccccagugcuguucucugaauucuuggggaacacagggaugggggcuccuaaugaggaccccagaaacucugagcucucacaacuuucaaaggacacuugccucccuccucugcccacaccuccaccauuacagcauuugaucccacaaguaaggagggggcgguccuauuccaccaccucucugguauccccccaaccuucugaguugucugagacccaggaaaggguuaagaucaggaccccucucuccugggcugaaagauauuucucacgucagcucuauguggacacaggaguuucuggcuggccuggaacugcagacggagcuuaucugccauuaaaccacugcaggugcacugcuuagcaucccgucugugaguaggugagagcagggaaguaagacuuugacucaaacgggacggaugcauccacaguuggaacucuagcacaggcacuucugccauuagcagccacaaaaagaagauggauauuuucuggaguuccuccagccauccagggaagaugcuggaacaguaccagguggguuuugaaggauguguaggaguucgccagccagaauauucacucaucaaaccucaaaccuucccuggcacucccuuaugcucagaccacaaaggucucagcuuccugggaggaaggugucgccccuuccuauggaaacaggagcccagaggcuggggacccugaugcugacucaguagaucugugucugauugccgcaggugagguugggcugguucagcgcaucccacaugagcagcaucucauaagguaggaagcggugcaccagcagcaggucucgguagaagcaggggucaaaggaggacaggcguugcgauggagcccgcacgccagacgugcggaugccgcugugggaggcaggcuucagucccucaagcuccagacacauacccaggaagacaucaucaauggggaagauguccaagacaugggcagcacggcgcagggcagcggccgugaagcgggacagcaagaagccaccacccccacaauaggguggguaccgcucauucugagucaccaccucuggcacauaguacuugcuccaaaaagcccggauggggcccacguuuuggaucaguugccccacgaagagguggcggccagggucaugguccugcagguagaagaccauguugucugugugugcaaagacgucaucauccccguugagcacgaagcuggcguuggcgcaccuugucuccugccacuguaagaacaggaccugcaggcaggguggacagggcaugcuugcuugagggcuggagaaauuggccuugggucucuauuagccacuccagcccacuaagcccaggaaaggaaguguccacaauccagccuggguuaaggcccugcccugugggguuacuugggaaacccucucugugccuugguuucaacucuccaaacaggccuuaucaugugccucuaggaguguuggggaauccauggagaccaugcuccaugaagcaccaagaaaugcuggaaaauuguuacauuuacauguauugcuauuccuuccaacucugccuggccaagcccuguuguuaaauaaucauuuguaugaauuuuguuuguuucugagacagggucuugcucuauugcccaggcuagaguguagcgcuaugaucauaguucauugcagccucaaauucccgggcucaggugauccuuccaccucagccucccaaguagcugguacuacagacacaugccgcuacuuacuccuggcuaauaauuuuuuuuuuuuuaagagaugggaucuugcuaugcuacgcaggcuggucucagacuccagaccucaaaggauccucccaccucagccucccaaaaugcugacauuacaagcaaugagccaccacuccuggccuuugugugauuuuuauuuuauuauuauuauuauuauuuuuuuggagauggaguuuucgcuuuuguugcccaggcuggaguggaguggugcaaucucggcucacugcaaccuccgccuuucagguucaagcaauucuucugccucagccucccaaguagcugggauuacaggcaugcaccaccacaccuggcuaauuuuuuguauuuaguagagacaggguuucaccauguuggucaggcuggucuugaacuccugaccucaggugauccaccugccucagccucccaaagugcugggauuacaggugugagccaccgugccugaccugugugauuguuaacaucccccucucccaccaaacacuggacuucccuccuugggccugugucucucuuuucuguucaugccaucucccucagcacccagcauagugccagugcuucacgggugcuggguucauauuugucaagcugauguuuaucacacacuuuuaaaggguuuuuuguuuuuguuuuugagacagagucucacucugucacccaggcuggagugcaguggcacaaucuuaacucacuccaaccuccgccuccaggguucaagcgauccugcugccuuagccucccaagaagcuggucucgaacuccuggucucaagugauccgcccaccucagccucccaaagugcugggauuauaggcaugagccacugugccuagccacuuuuguguuuucagaacacagcauguuaagaggccauggccccuacccgccucagccucaguuuccccuacaguaaccuacacaggcuggguaucuguuuguugccgggcgcugugcuuggugcuuacccuaccuugaauccugaaugcacccuuaggaggcagaagugguccucuaucuuauuuacagaugagggaacagaggcucuccagagaaaacugcagugaggucacccgcagagaaacagcuaccagaggacuugaacccaggccugucuguaccuccuaugagcaggaaccugcagaguucccuguuccuccuugaaaauguugucucuacuugucuugcucuacucgaggaccuaggagggguucuuagagccccuccauuuccucaucugcagaugggcaggauuuucucaccucucauggcuucuuuuuuuaaaaaaauagagacgaggcugugcgugguggcucauaccuguaaucccagcacuuugggaggccaaggcaggaggaucacuugaggucaggaguuugagaccagccuggccaacauggugaaaccccaucucugcuaaaaguacaaaaaaauuagcugggcauaguggcaugcaccuguauucccagcuacucaggaggcugaggcaggagaaucacuugaaccugggagguggagguugcagugagccgagauugcaccacugcacuccagccugggggacagagccagacuccauccaaaaaaaaaaaauuaauuaaaaaaacauaaaaauuaauuaauuaaauuuuuuuugaaaaagaugaggucucgcuauguggcucaggcuggccucaaacucuugggcucaagcgauccucccuccucagcuucccaaagugcugggauuacaggcaugagccaccaagccuagcuaccucucauggguucuuguccaucaaaaaggucuugacugagcacaugcugugcaccugaaucuauucuaggcauuagggacacagcagugagugaaacagacaaggcccccagccucauggggagacagaaccggaacaaauaaacaaggagauguuggccgggcgcaguggcucacgccuguaaucccagcacuuugggaggccgaggcgggaagaucaccugaggucaggaguucgagauuacccuggccaacagggugaaaccccgucucuacucaaaauacaaaaauuagcugggcauggugagugccuguaaucccagcuacuugggaggcugaggcaguaggaucgccggaaaccaggaggugguugcagcaagcccagaucgcaccacugcacuccaggcugggcaacagagcaagacuccauuaaaaaaaaauaaauaaacauaaaaauaaacaaggagaugugucccccgucauugccaaguugaguuggacauccagcacuggucugggugccuuauaaacuccaucuccuguaaaccucacaguagcccuuagaggugggugggacucauucacaucccauuuuccaggugagaaaagugaggcacagagaggugaaugaacuccuccaaggucgaacaccaaguaagaggcagagcuuggauucgaauccgcaucaucaggcuugagcucugugcuaguaaccuagcuccucugcccuucccccuagccucuccuagaagaagaccauuuugggucuccacgaggcuggugaggacagcagaggggcagaaugggcugugauggacugacgaggacuucugguccccugggucccucaggagugggugguaauuuggacaagaaggacagguggccccgaucaggugaccccaguccagcgcaccugcuugagcgugagguugaagaaggagucguggaagucccacugcaggaugucuccgugagucugugccuccagcuccagcagccgguugaccuugcgggccucgugcggguuggaggcugugcccaccaggaagaggaggcgcagcugcaaaccccguaccuugcgcucgcggccccacgugcgccgcagcagcucgcggcgcacauaguugcuaggggaggacuugaucaccagcagcaggaagaccggcugcgcgcacuuagaggggggcacguccugcagcaggggaaaguggcggcagugucuguacaggaggaaguucugaacgugcugcggcugcguggcgaaguccgggugggugaccauagagguguuggcauggcacggggccggggcugggcggguggguggagugggccaggccagggccucggggaucgccgguggcugcuccuggaccuugcagguggguggugacacuagcagacugaagaggaggagggugaaagcgccgauggccagaaugaggguggcauugggccgccggugccggagauacuucauccuggccagccagggucuggggucggccugaggagccuccugggcggcuccuguggaaaacaaaacucacugaacacucgccaugagcaaagcgcuuuuccuguggcccccaacaucugguugcaccuguacaguugcucagguuggcaaaauauugaaauucaccccccacuuaacuccuccaccccuugcaagacccauuucaaagcacuccaaccccuguuggcucugacaggugcccuggcccucccugcuggggauuaauuuuuuaaauuuuuuaauuuuguuuuuuuuuuuugagacagcgucucucucucucucucucucuuguucuguugcccaggcuggagugcagugguguaauuuccgcuuacugcagccuccaccucauggguucaagcgauccuccugccucagccuccugaguagcugggauuacaggugugagccaccaugccuggcuaauuuuuuuguauuuuuaguagagacgggguuuuaccauguuggccaggcuggucuugaacuccugaccucaagugauccaccugccucggccucccaaagggcugggaugacaggcaugagucacugugcccugccuuucugugugaagucuuaguuuccuuauuaggacaugggggugcugagguuccugcuccaauacacacacacacacacacacacacacacacacacuggggccacugcucccugacugcaaaagggcuugaugcauauuagcuguguggugaccgccucagugaccaugaguccaccauccuggcuaccuugauuccccagcuauucccacuuacagcauggagcaguaucagaacccaggacuuuuuuuuuuuuuuuuuuuucuugagauggaguugcccaggcuggaauacaguggcacaaucucggcucacuucaaccuccgccuccugcauacgagcgauccuccugccucaucuuucagaguagcugggacuacaggcacgcgccaccacgcccaguuaauuuuuguauuuuuaggagagacaagguuucaccguguuggccaggauggucucgaucuccugaccucaugaucugcccaccuuagccuuccaaagugcugggauuacaggcaugagccaccguccccagccggaacccagaacuuugaugggugcaguaugcccaucucauacgucccucaacucggggucacugggagacucccuuccaacaccucagggccucccagaaucugucacaagggacugcgucauggauggcaccaaacaucccucaaagagaaccuggccaacucucggccaccuggggcacagacaggugaauauccgugaacgugcaugaguccaauccuguuaacugucacagugcucaucagcccuagaguguuaacugagcaccuacuguaugcuagaugcuggggauacagcugugaccaagccagcccugcccucaauauaacaauaaguagaacagcuugggcagcauggugaaaccccgucucuacaaaaaacacaaaaauuaggcugggcgcaguggcucacacccauaaucccaacacuuuaggaagccaaggcagguggauuacuugaggucaggaguucaacagcagccuggccaacauggggaaacccacucucuacaaaaaaaaaaaaaagaaaauacaaaaauuagccaggcauggugaugggugccuguagucccaacuacucgggaggcugaggcaggaaaaucacuugaacccaggagguggaggcugcagugagcuaugaucacaccauugcacuccagccuggaugacagagaaagacucugucucaaaacaaaacaaaacaaaaaauuagcaggcugugguagcaugugcuugaggucucaguuacuugggaggcugaggugggaggaccaccugagcccaggaguucaaggcugcagugagcuaugaucacaccacugcacuccagccugggcaacagagcaagaugcugucucaaaaaaaaaaauuguaaaugauacuaacaauuagugacagccauacuaauuguuacugaggcagguccacaggggaccugagcaaccuaggaucagggagguccugaaggaugaugggaauucacuugagcagacuguggggaagggcauuccagacagaguggagcaugugcaaaggcccugagauggauacaaauuuagggugcugguggcagagcgaggaggcugacgugguugggacagggcgagagaaaggaggugaugguggaguuaugggacccugcuaggguacaagaauagaaugggcacgccagaaagaaugucuuauguuuccugugagaagcaaugaggagccauggagggucuaugagcaggggagggaucagauugauuuaugccuuuaagaaguccccugugggcugggcaagguggcucaggccuauaaucccagcacucugggaggcugagguaggaggaucgcuugagcuuaggaguuugagaccagccugggcaacauggugaaaccccaucucuacccaaaauacaaaaguuagccggcgugaugaugcauacuuguaguccuagcuaugcgggagguugaggugggaggauugccugaccccaggaguuugaggcugcagugagcuauaaucacaccacuccagccugggcaacagagagagacugucauuaaaaaaaaaaaaaaaaaucccuguggucacuaagggauuagggacauuucagucagggcagggcaacuaagggagacccugucucugcuaaauaaaaaaaugaaacaaaauuagcugaguguggugguguacaccuguagucccagcuacucaggaggcuggguggggggagauuggguaacaucuagguggaagaguuugguggccuagacagaggcuggcugcugggguauaggagaguaugcagguuuagaaaauaaggugaagggcugggugcaguggcucacagcugucaucccagcacuuugggaggccaaagugguggaucaccugaggucaggaguucgagaccagccuggccaacauggugaaacccccgucucuacuaaauacaaaauauuagauacaaaaauuagcagggcgugguggcucauggcucaugccuguaaucccagcuacucaggaggcugaggaaggaaaaucgcuugaacccaggaggcggagguugcagugagccaagaucacaccacugcacuccagccugggcaacagagcaagacuaugucucaaaaaaaaaaaaaaaaaaaaaagcugggcacgguggcucacgccuguaaucucagcacuuugggaagccgaggcaaucacuugagcucaggaguucgagaucagccuggccaacauggcaaaaccccaucucuacuaaaaauacaaaaauuacccgggugugguggugcgugucuguaaucccagcuacucaggaggcugagacaguagaaucacuugaaucugggaggcggagguggcagugagccaagaucaagccauuguacuccagccugggcgauagaacaagacucugucucaaaaaaaaaaaaaaaaagaaaaaaaagaaagaaagaaaagaaaaaaaaaaggaaaauaagaugaagaaagucaucaauguuucgaucacagcccagauguccagauguuaggggguggaaaaagaaggaccagaaggagcagaaugaggaaccucugggcagugggaggcucagucugguauccaggugagagcuguuggcacaccauggccuauaagccaggaaggcccaacagguauugauugugugugcuguguuuuaagagacagggucucacuauguuguccaggcuggucuugaauuccuggccucaagcaauccucuugccuuggcuucccaaagcgcugggauuacagacauaagccaccuugccagcuaauuaaaaauuuuuuuuuuuuuuuuuuagugauaggaucucacuugcucuguuguccaggcuggagugcaguggcgaucauagcucacugcagccuccagcuccugggcucaagugauccuccugccuuagccucuugaguagcugcgaccacaggcaccagucaccaugccuggugccaacaggcaauugucauauguucccugcauguuacagcgccuacccugcacuccuguucaaggugggugaaaaaacuucaccccaagccagacacggugccaccaguguccagcagugacauccaggcugacucuuggggacccucgccuggccgcccgcugccagaccagucgguccugccuggagcuguuugcacuucacgugccagugcgauuuugccauccuccagaacccacuuccucaaaugcacagaaaagccauuuauuuccccugccaagacccagaagccaccgccugggguguggcugcaggauguggguccucucugcugccaucuuucccacacaaucucugcccucacucaucugcuccagcugcaccagccuccuuaaacauggccgggagcuguggcccacgucuguaaucccgguacuuugggaggucaaggagggcagaucaccugaggucaggaguuugagaccagccuggccaacauggugaaacucugucucuacuaaaaauacaaaaauuagccaggugugguggcacacgccuguaaucccagcuacucaggaggcugaggcaggagaaucacuugaauccaggagguggagguugcagugagccgagaucgugccacugcacgccagccugggcaauauagccagauucugucucaaaaaaaaaaaaaauccuuuaacacccaggcucaggcuggaugcaguagcucaugccuauaauccuugcacuuuaggaggcugaagcaagaggguugcuugagccuaggaguucaagaccagccugggcaaaaaagggagaccugucugugcuaaaaauuaaaaaaaaaaguaaaaaaauuagcugaguauggugguguaugccuuuagucccagcuacucgggaggcugaggugggaggaucacuugagcccuggaaguggaggcugcagggagcugugaucacacuuccagccugguggcaaagcgagacccugucucaaaacaaacaaaaaccacccaagcucagcccugccucagggccuuugcaccugccacugccuccaccuaggacccccuuccuuuccagcucuuuccguagucuucauauuuaggcuuccccugaaaugucaccuccgagaggcuucgaccuccaggcuaaaacaccuagccccagcacugcugaugucuguagcauucaccaccaucagacaugggaaaucucuucgcuucucuccuguccaucugcccagccagccugaagccccagggcugggcaucuuaucuccugcaacugugcucccacaggaugcuaccuaguuuguugcagaagggaaaaaguacgauagccaucaccuccuaucucacugcagccucgcccccacuccacgaggcagcagccacaguccccugccgcacacguucugccucagaagacagauuuauagcuugggagacuaguaagccuugggcacccgugauucagucaagauaagucaccuguaaucccagugcuuuaggaggcugaggcaggaggaucacuugagcuuaggugcucaagaccagccuggguaacacagcaagacccugucucuacaaugauuuuuuuuuuuuuuuggagacagaaucuugcuaggucacccaggcuggagugcaauggcaugaucucagcucacugcaacccccgcuucccagguucaagcgauuauccugccucagccuccugaauagcugggacuacaggcaugugccaccacgccuggcuacuuuugguauuuuuaguagagacgggguuucaccauguugggcaggcuagucucaaacuccugaccucaagugauccgcccaccucagccucccaaaguguugggauuacaggcgugagccaccaugcccagccaaaaaaaauuuuuuuaauuagccugguguggugguggugagugccuauagucccagcuacucaggaggcugaggugggaggaucacuugagcccaagaguucaagaccagccugggcaacauggugagacucugucucuacaaaaaguguaaaaauuagccaggugugguggcgugcaccuguagucccagcuacuugggaagcugaggcaggagaaucgcuugagcccaggaguucaaggcugcagugagcuaugauagcaccacugcacuccagccugggcaacagagcaagauccugucucaaaacaaaaaaacaaaaaacagcuggguaugguggcuuguaccuguaaucccagcuguuugagaggcugagaaggaaggaucacuugagcccaagaguuugggcaagauggcaaaaccccaucucuacaaaaaauacaaaaauuagccgggcaugguggugugcgccuguaguccuggcuacuugggaggcugaggugggaggaucgcuugagcccaggaggucaaggcugcagugagccaugaucucgccacaguacuccagccuggggaacagagcaagacccugucucaaaaacaaaacaaacaaacaaacaaaaaaagugcugcauguuagugaaguacugaacauuaacaauccauuaacuacagaggaggugccuacuauucguaauauacaaaauaguugcaaagcaauaaugaaaaguugcaaguugugcccaaauauacugaauuuuuuuuaaaguugcaagucacauacaugauacuugaauauuaucaugaggaauauauauauauacauauauauauuuuagauagagccucugucgcccaggcugaagugcagcgccacgaucucagcucacugcaaccuggagguugcacccuccuggguucaagugauucuccugccucagccuccugaguagcagggauuacaggcauguaccaccacacccggcuaauuuuuguauuuuuaguagagacagaguuucaccauguuggccaggcugguuucaaacuccuaaucucaggugauccacccaccucagccucccaaagugcugggauuacaggcaugagccaccucgcccggccuaauaguaucaugaggaauauuaacaagccacaaacagucuucagauaccaaauauucauggucacugaauauucaugcuucaaugcacaggugauacuaaguauuaaugacucauugaaaauuaaugaccacuaaauaugcagaaggguugucugcucagcagaaucguaggcauuggcagcugcacccuggccccauguccucugccacucccagggggcagucaaggcugggcccuugccccaggugcaaguggcuccaggcaccucugucgcccucaucccuguuucuuugguuuuauucuggagacagagucucgcuugcugugucccccaggcugaagugcaguggugugaucuuggcucacugcaacuuccgccuccugguuucaagcgauccuccugccucagccucccaaguagcugagauuacaagugugcgccaccacacccagcuaauuuuuguauauuuaguaaagacgggguuucagcgcguuggccaggcuggucucgaacuccugaccucaagugaucugcccgccucggccucccaaagugcugggauuacaggagugagccacugcgcccagucucaacccuguucuugucacugucugcaagagauguggggcaugugaaagucaucaaggacccugcugguaccaccuggggcuagaucugccccccucacucccaagacuauuuggagaccacaggugauggggaguggcacagggggcgggggauguccugacacugacucagaggucuccauagcauuaagguaauucucccugugaaacucccacuuuccagaugaggaaacugaggcccagauagggcuacuucuggauugcucuucagggacucccaggccuggauaccccuaaccggccuggauaccccuaaccagccuggucgcuggcucucagucucugccuugccugcagcugggaggacuggucugugagcugaugccuuugaagcagccauggggacccccgacagccguugaggaagggccuucugacccagcuacugaccuuccaugggaccugggccgaguagcuggggccacccagaccuuagcauccuccucugcaaagcugggauggucagccgggcucgguggcucacaccuguaaucccagcacuuugggaggcagaggcgggcgaaucaugaggucaggaguucgagaccagccuggccaacauggugaaaccccauuucuacuaaaaauacaaaaaauuagcuagguauaguggagggcgccuguaaucccagcuacucaggagccugaggcaggagaaucgcuugaacccaggagguggagguuacagggagccgagauugcgccacugcacuccagcccggguaaaugagacuccaucucaaaaaaaaaaaaaaaaaaaaagcuggaaugguggcagaaccaccaccugacuaucagcauugcuguggccgcuguuucuccaauucucacccauccuaaauugggauuuggauggagguguggaacauucugaggccgccaaaaggcaaggcaagagguggagggugagagaagcuucuggaagaaucccguuugacuacauacggauuugaguccugggaaaggcuagagggucaagugguagcuccaagcaguggccuuuucuccaaguggcacauaugugaagcgccaacaaugagauuuuuuuuuucuuuucuugagacaggaucuugcucugucacccaggcuggaguggugcaguggcacgaucauagcucacugcagccuccaacuccagggcucaacugauccucuugccucagccuccugaguagcugggaccacaggcaugcaucaccaccccuggcuaauuucauuuuuguagagaugggucucgcuauguugcccaggcuggucuccaacuccugggcucaagugauccucccaccucagccucccaaagugcagggauuacaguugugagccacugcacccagccacaauuagauuuuuuuuuuuuugagacagagccgcacucuguugcccaggcuggagugcaguggugcuaucuuggcucacugcaaccucugccuccaggguucaagcgauucuccugucucagccuccagagaagcugggauuacaggugugcguuaccaugcccagcuaauuuuuguauuuuuaguagagaugggguuucaccacgucaccuaggcuggucucaaacuccugaccucaggugauccacccgccucggucucccaaagugcuggaaauacagguguuagccaccacgcccagccacaaugagauuuaauagcagcugccaccacccuuaucaccugcagaguugugacugcucugagcaagugcugagcaccuagcguaugccacaucugggucuagguuccgaggacacagccaagaugauggagagaaacacucgugugcccaggacgcugauacaccacuaacaggggacagagaaguggcaaacaggacaauuuuccagaggagugcaaccucuaggggugaagaaacuccaggguggaaguuggggacgcuugcaggagagggugugagccccuggccuguggaggaacccgaggagucucacugagccuuccagaggggagccuaggguccagguggacgaucugugcagagagggugcaacucugcccaaggucacacagccgacugaggccagggcggguuggugggauuugaacccugaucugccagccccugugggugguuccucaccaguucuuaccaguuuggguuucccaguaaugauaggcuggucccuuuuuacaaggagcaggaguugcuuuugcaaacagaaggggaagaaaagaagaagaaauagcccaguaaauccuuuaaguucacaauggccggacccugcuuuagugaaaccauguguacuagugaguucucugucaauauauacucaauaucugcaccagggagugccuggguauggaaaaaggggugggguugggcacggugacacaugcacuuuagacuuuggugucccggguuucuaggucccgaggcucugucauggaugacuaauuguaugucauccaugccagcccuaccccauugcaggaacugccuggggcaccuaugugagacuggaaaggggccccugaauaacaccagcccuggcccaguggagucucaaagggcaucuuugggcucacuccauagauggggaaacaggcugggaagccaggccgugcaucgcaguucaaccucagacccuucccacaauccaggagugaugggggaacugaggucuccugggccccuccucuggggacuuccuggacccccacaccuucaggcuggucagagcucuucuccaagucuuguacuuagagcucagaaauauucaugauauuauuucugugugcaaagauacaugcuauaaaugauaacauaaugagcugcauaauuaggacuaggaucaauaugccagguccugugugcagccuggccaccaucuguccaucuaaacucuauaugugugcugagaaguagggcugcauuagcuccauuuuuauggauaggaaaauugaggcacagagaggccuagaaauccaccuaagaaagguugggugggagccuaguuccugucuuuaacucccagcugaugagauuuccuuuaguuugccacguugguagugaccucaccaucaugaggagcaaucaaggcaagccagauucccaccaggaagaggguccacaauaggcauccucccuggcucaugggguugggggagugagcaaauuccugcuugcucugggccucagaggcugguggcaggaggaaaugucacucagugagcccuuacuugcuccuccugggcugaccuggcuugucuggauuccugaacucuggccuggaacagagaagcaccaaggcccccuuuugguucucccacacccagagcaccugccaggaaaugccacacccuaggggugagagugagggaggguguccaggcuggacugagcaaacacccaacugcucaccuaggccauaugggggcccagcugccugaccugggggccacaccucuuccuccugacaccagcccugccuggugucaccuugagaacaggccagugggaggaagugauggcccccagggcuggccccagaccuagacggccagguggcuucccaugggcccugaaucccagaucuggacugcaggagucccccgcccaaguugaggggcgaccucaguuuccucuugagaaguguccauuuaaaaaaaucagagcugggcauaguggcucaugccugaaaucccagcacuuucagaugccaaggcaggaggauugcuugggcccaggaguuugagaccagccuggacaacauagugagaccccgucuccacacacaaaaaaauuuuaaaauuagcugccuguggugugcaccuguagucccagcuacucgggaggcugaggugggaggaucacuugagcccaggagguugaggcugcagugaauacagugcauggagccacuguacuccagccugggugacaaagugagucccccaccucuacaaauaaaacaaacaaacaaaaaguuuaaaucugacccagaggaaaagauggucgggauucuuggaacaggagugaaucugaacaguggcuacagacauaauuaauauaauuaugaugacagcugacugucccugggcacccacugaguggccacagcuccuauccacucaacucauccucgccaaggucccaugccaugagacccccccuuaacacacagggaaacugaggcucagagaccuaacgccagucacgcaagggcccccaguggccagcaguacaccucaucacaaaaauuuccuuugacuaaacgcuucgggcauccucaucccagcugguucauuguuccaccucacggaggggaaacugaggccgguucagcaauguguccaugccacgcagccagggccccuggaaugccgcccagccaccuggcagggccugcagcaccggaaccgcagggagagacugggggucaccugcaguucccaaacccaaccggggaccccagcgcuggcuugcccagauacucccaaccaaggggccaauaaucucaacaacacagguaacaguaacagccaagucugacuaagcggcauccgccucgggggucugaucccgcccaaucugggaggggcgccggggucccgggucgccagcugugggggaggcuuccuccccgacccagguccgagcuggccuugggaacgccggagacaauuacggaugggugagggcaaccggguucucgagacucggggcucccgaauguucccacaucugcaggguaugcgcgguggagaccggcaggggcuucuccagagccacaacuuccccacccccaaacccccaccacugggguccgccagauccuccgggggcugccgacacucacccccagacgacagucccgccucugccccucuaccugcuccucucagcucgcgagccgaagaaagaguuuuuaccugagccagagcucccgccccucu

SEQ ID NO: 192896 - RNA, 7971 nt, Homo sapiens
ugcagagauggaaggugccuuuauucaccaugagcccucaggguacaugcggugcaacccgucuccugcccuccuuuucccuccaaggaccuggaucugagccaggaccggugaagccccuguuuucaccaccgcacacucccuaccaccgccugcuggagaaauaaggucacuugcugcuucugggggccccaggcuggaagggacaggagaggacgagaaccacaugaaccagggcuaagucacagccaagcuacggccccccgcgguaagggcgggcuccuggcucccccagaguggggcaaagggcuggcgccaaagcuggggacucagacagcugggaacucaggagggcugcccuaggggcaggacuaggagugacagauauggugggugggguggacuucuggggucccacccggggcuugggagagacggcuggcuucugggggguugaggagaccugugacuguggggccagguaggaggcuugggguaagccugggauggggccaaggcuggccuggaugccacauaccugaucauggggcugaggcagaggcugggggucuuugcuaggggcugggguggggucucugggggaugggccugggggcugagguugggcuggggcaggggccucaagcuggauucuagggucaaggccaggggucugugggcagauuccauuuccagggcucagccagauucuugaacuggugugaguucuggaacuggauuggguuccagaaacaggcuggguuccagaacuaaggugggcuccagggcugggcugaauucuugagccggucuggguuucagagcugagcccggucucagagcuggacuggguucuggaacuaaguugggcuccagagucgggcugaauucuugagccggucuggguuucagagccaaacugaaucccagaacugaacuggguuccagagcuggacugagccucagagcugagccuggucucaggacuggacuggguucuggagcuaagaugagcuccagggcugagcugaauucuugcaguggucugggucccggagcugagcugguuuccagaacuagucugaguucuggagcuggguugggcuccggaaaucagcuggguucccgaacuaagcugacuuccagagcuggcuugaauucuugagcuuaucugggucccagagcugggcugaguuccaaagcuaagcugacuuucagaacugcucugcuucccaaaguccaguugaauaccagagcugucuggggcuguggucuggagcugguaucuagaaccuggcaggguuuuagaggcgaauugagucccagaggcuggucgagcuccugggcagcgcuggguccuggagcuggaccugcugucggaacuagacagggcuguggagcuuaauucuauugcugcgauggccugggucccaggacuagauuggacuccagagcuuagcuggauucuggaacuuggcugggucucagcugcugucuguguuuuggagcuggcugggauuucagaaccagccugugcuccagaacugagcugaguuccagagcugggugcggugcuugggcuggauugagcucuggagcuuggccaggccuugaaauuggucuggguccuggaaguaaacugcauucuagagcugagcugcauugugcaaggagaguggggcuuggcaccaagcugugugcuggagcugggucuugcuuccaagauggaugggguuccagagcuggucugaauccuggaguugggccugguuguagcacuaggcgagguucuagagcugggcucagucucagagcuggaaucaucacuggagcuggacugggcugcaggauggggaugggcacuuggaugcaacugggguugggaucuggacugggcagccguguggaccuggguuucugagcuggucugaguucuugaauaggauuugauuugggagcugucucugaauccugagcugacugggguuccagagcugggcugcuucaugaaucucacauggguuccaaaauuaacugggguuccggagcuagaccgaguguccagguguggcugcaucguggagcuguccagaguuccagagucagcuugaguuuuccagcagggcuuggucuccgagcuagccuggauucuggaacugggauuggucuccaagcuggucugggucuuaaaaugugucuggguuccagaguuuggcuuguugucagggcucagcuggauucuagagaugugcuucgucucagagcuggccugggcuucagagcagggcuuggucucagaucuuaucuggguucuagagcuggguuuggccucagagguggccugaguucuagaacagggcuuggucucaaugcugggauugguuucagagcuuaucuggguucuagagcugggcuuggucucagggcugaccugaguucuagagcugggcuuggcuucagauguggccugaauucuagaacacggcuuggucucuaugcugggcuugguuucagagcuuaucuggguucuagagcugggcuuggucucggagcuggccuggacucuagaacagggcuuggucucaauacugggcucugucucagagcucaucugaguucuagagcugggcauggucucagagcucaucuggguucuagagcugggcuuggucucggagcccaucugaguucuagagcugggcauggucucagagcccaucugaguucuagagcugggcucggucucagagcccaucugaguucuagagcugggcucggucucagagcccaucugaguucuagagcugggcauggucucagagcccaucugaguuuuagagcugggcucggucucagagcccaucugaguucuagagcugggcucggucucagagcccaucugaguucuagagcugggcauggucucagagcccaucugaguucuagagcugggcauggucucagagcucaucuggguucuagagcugggcuuggccucagagcaggccugaguucuagaacagggcuuggucucagugcugggcauggucucaaagcucaucugaguucuagagcugggcuuggucucagggcuggccugaguuuuagaacagagcuuauucucaaugcugggcuuggucucagagcuggccugggcucuagcacauagcuuggccucagaucugggcuggauucuagagaaggguuggguucuggaguugggcuggggcuccaaauuggauuggguucuagagaggaacuuguccuccgaucugggcuggguucuggagcagggccggggcagggggcugggcuccgggcuggggcugugcugggcccccccagggcaaacuagccacaggccucucuggccucgccgauggcggcccacacuuccaccacaaacucgucggggaaggcgaacucgcccaagacggagucuaaacagcgugcaaacuccugggcgcucgcugucuucuuggacgucuccaccaugguggacgcugcgggccgugccagaggggaugucagugagggcacuccccgcgcccaacuucccgcugggaccccugccuccucccguaggcuucccuccccccagggcccccuggcuuacccuggccccuuacccagcucggggucccgaaugcccauguagcuuuccagcaggucaucaaccuuccgagaugccuccuccucaaacucacugggcugggggcacacgggagggaagucaggggugaaaagcuuuggagcccuccagcccagcccccucccgacccccaccccuaagggaagaguagacuggacccucacacgagucaguagugcugguaccaacaucauugccccacuuuucaaugaggacccauuuugcaggcagagaaacugaggcuccgaggagaaguucuuacccaagaccgcacugacucaguggaggagcugaaggugcagaagccuggggagagccccuccccuucacucaccgcuuccuccacuguggcagcccccccagaacgaagccgcagggucucccucccgcuggucacuuucgccucuacuggacauuugcuggaccgacuucucuggccaaucauaucuggagggaacagagugagggauggccauggguucuggguggagccacaucuuuguaaacccugggaggccaacagccgagccuuucuagaaucuuccuccccuucaaaguccuccuuacaucuguacggcaagucuccagagaccuauucgagauuccacacuucgcauccccagcaaacuaaaucacaaguccagaaugagguguuguaauggagcagguuuagaacuaacaucccaguuccaugcccucacucucccucuucuagcgacuuucucuagaagggacugcuugggacccuccuugugguaggauccucaaucuagauauguucuugucuggguuccagaacccggcuuagugucaggacugaggugcuagaaacacacuuagucucagagcuggccugggcuuaagagcagggcuuggucugagagcuggccugggcucuagagcuggguuuagucucagacuaagcuugauuuuuuuuuuuuuuuuugagauguugucuugcucugucacccaggcuagagugcaauggcacgaucucggcuuacugcagccuccaccucccagguucaagcgauucuccugccucagccucucgaguagcugggauuacaggcaccugccaccaugcccagcuaauuuuuuguauuuuuaguagagacaggguuucaccauauuggccaggcuggucucgaacuccugaccucgugaugcacccgccuuggccuuccaaaguacugggauuacaggcuugagccacugcacccagccagguuuuuuuuuuuuuuuuuuugauacgauggaucaccugaccucaggugauccaccugccuuggccucucaaagugcugggauuacaggugugagccaccacgcccggccuaaacucuauuuuuaggcauggcuuuuggaguucacagccacggcagggcagauucuagaaccccauacagcucacucucccugggacgucucuccaugugugcuggggcacuucuagaaucucugucucuguucuauagaacaacgcuauccaaagggccaacccauggcuacaugaggagaaugugcuaguguguaaaucaauacacuguuuucuucauugagaaagucuaguuaugaaaaaaaaugggcagggugcaguggcucaugccuguaauuccagcacuuucggaggccgaggcgggcagaucaccugaggucgggaguucgagaccagccugccaacauggagaaaccccaucucuacuaaaaauacaaaauuagccaggcaugguggcacaugccuguaaucccagcuaguugggaggcugaggcaggagaaucacuugaaccugggaggcagagguuguggugagccgagaucacaccauugcacuccagccugggcaacaagagcaaaacuccgucucaaaaaaagaaaaaaauuaaaaauuagcuggcacggccaggcgcgguggcucacaccuguaaucgcagcacuuugggaggccgaggugggcggaucacgaggucaggagaucgagaccguccuggcuaacacgguaaaaccucaucucuacuaaaauacaaaaaauuagccgggugugguggcgggcgccuguagucccagcuacucgggaggcugaggcaggagaauggugugaacccgggaggcggagcuugcagugagcugaaaucuagccacugcacugcagucugggcgacagagcuagacuccgucucaaaaaaaaaaaaagaaaagaaaagaaaaaagaaaggaaaaaaaaaagaaaagaaagaaaacuuuuuucucauauucucauucucuacaauccaccaugaccucaaagcacugcuuuaaaaguucccaggcugcgcgcgguggcucacgccuauaauccuagcauuuugggagacugaggcggguggagcacuugaggucagaaguucgagaccagacuggucaagauggugaaaccccgucucuacuaaaaauacaaaaauuagccaggcgcaauggugggugccuguagucccagcuacucgggaggcugaggcaggagaaucgcuugaacccgggagguggagauugcagugagcugagaucgcgccauugcacuccagcccaggcaacagagugagacuccgucucaaaaacaaacaaacaaacaaacaaacaaaaacaagucucccagccuggcuccaaagugguucuggacgcguccuccuccaacuccacuuuacccagucucucccccaccccucccccacaggcugacuccauaacaaucuauuaauagaaacuaccuacgaguuucugauacccugccaggagcuccuuggcacgcagcgggugcaccuagaaccuuccagcccgucccauccccgacccuccuccaccccaggcauccguagaacgcacuucgggaagagcucccgccagcccacccgccucaccgaaggcccucuugggcugcaccaggcgcagggugaagggcugggacuugggcagcucccggagcaucuuggccaccucguaguggcggcagcccacaauggaguggucguugauggcuucgaugcugucacccacgcacacugccucgauccgguugaugauacugccuuccuugauucucugcagggauccagcgucgcuggcagggcaaccccagccacccgccuccaauccgcagaacccacgucgacccagaguggggggggcaguugcuggaccccaggaagccacccgcccacccccucccgggcaccuugaugaaggcguagccagccccguuguccgugauggucagccccagagcauccucugucuuagugaccuccaccuccuuggucucgccucgcacgugggcaaagaugaaguccuccaggccuaucugaccccccaggagcuucugcauguccacuuuguggcuguugagggugcagaauaaaaucuucccgggggagaaggagccuagaguuagccagggcaugcauccccccacgcagccacccugucugcgcaggccccugcccccagcgaccaggaucccagcccaugggaaagggcagggcgugggacccccagaacagagagaggagggagaaggagacuuccagcagguggagaccccucuccauaccccgggaccuccagcccccagaccuccagguuuaaucugcuggcgcccccugggggcugcaaaccaaacgaacccggauuggaaaaacgcccaggaaccccccaaccccacggcggccucaaacuucccaucccuaagggggccaucuggaaccccagaccccagcuacgcccaggaagcacagaggcgcuuccccgagggcugggguccgcuccaagcuaggucugcgcagaggauuuucuggaauaucuagggguccgcuaguccuaagaccugcccaucuuuugcgcagagcgugcaaagggggccccugggaguguggcaccccgggaucugagggcugggucucugagauccggcgauuaggcggccaccccgacgucugggauccggggaucuggggucucccguccaggguccaagcucccuaccccucaccccaucaggcggguggucuugggcgccgguguccgggcuccuuaccucggugggcgcgaucccgaaggcuucggcgaucuuggcguacagcucgcggacguuggugaagcccucgaucuugcccguggggcucccgugcgccagcugcgugcggaagacgaggcgcgggcgggcgcggggcgcggccgggggcuccgagggcgcgggcgggggcgcagacgcgcgcggggucucggucccccgggccucccgggccgcugcucccuccauggcgggagaaguucggccacccacccg

SEQ ID NO: 192897 - RNA, 23613 nt, Homo sapiens
gcucgcacccccguccuccggccgcgacccccgcccgggaacccuagccccuggccgcggucgcuucccggaccucgccccgcgccucccccugcagcccgccccggccgcacccccuagcguccccgcccccggccgcgcccccucaugggggcccccucggcgguccgggaggcggcgggcgcgccaugggcagcggcagcagccggagcagccggacucugaggcggcggcgcagccccgagagccuccccgcggggcccggagcggcagcccuggagggcgggacccgccggcgggugccgguggcggcggccgaggucccgggggcagccgcggaggaggcgcccggccgcgaccccagccccguggcgccccccgacggcagggacgagacgcugcgccugcuggacgagcugcuggccgagucggcggccuggggccccccggagcccgccccgcgccgcccagcccggcuccgacccaccgcggucgcggggagcgcggugagugugggagccgcagggccucgggggacggcggggaccccacucaccggccgcgcguccccgccccagcccugggcgccggucgcgcugcgcccccuuccagccuccgacuugcgugcuccccgcugccccggccuccccgccccugggcccccagguuuccucccucucugccccgucuccgggucuguguccaggcgugggggcgaucgcgcugggagcggccgaggaaggacaccccuaggcggagcgcgccgggcucccggcuccccucgggcccgcggccccgccuggccuucccgggccgcccuggagcggggcgccggcggugguggcacggcagccagacgguggcucagaagcgcccugccgcgcccaccgguccagauccuugccuugcugggcaggcaauucucauguuacugauauuuuuaggaugcugcggaaucucuuuugcgcuuccuauucucucucccugaauacucguaauaacaguccugcuguucuaaaaaaacaauaaaacaagcacucugguuuggcaaccgucuucgcuccagcagagcugaaugaacaagaucuuuaacauccgcucccgggcucggggaggaugccaagggccucguccuccucccugaggcccgggaggcuuugcuuagcagccgcugggagccgaggaagaugccuuccuggguggcuaccgcaccaaggaauccugaaaaggccccagggagggugggggagagggacagccccaggcgacagugcacagagcucucucccucuggcccugguucccugcuccucucccuuacggucuuuaaagaggaaaagcgagcugcagugaguagggcugaauuauauaacaagauuccuuuaauaccacaucagccugcaguuauauaacacugccuggacaaauagcugagaaauuugggaggaauucacacauagcaaggaggcaguuaauuuuaguguucauuuucaagugcuuuggaaacucggaggugaaaaugagaggcaaauagcaagagugaauguugugcccucugauuugcugauauuauucaucauggugacugcucgcucuuuaagucauuuuccagcuauccuuugagcaccggucccgcugugggugcuagggaugaggccacacagcauagcccuugccuuaaagaagucugcagcucgaugggggaaaguagaaagcagggcgaugagagauccguaucaaaaggccacaggagaaagcggcuaaucccaagggaggcagguaggcauucccgaagggaugaauuuggaaguuguccugaaucuggaagggucuguggacgugauccaggcagcaaguucugugcagagagaaccucaugccuaaugucacugguggcuggggcagcuggugcccagggcaugggucagagaggucuuaggagaguaugccaggcugcagugcgccaugccaaggguauuccauguuagcgaguuuggguuacuaugaaaguucuggguaucugaaagguaaggauugugacaguuuguguuuuaggaacgucacaccgacaacuguagggaggaugaacuggacagagucagacuagggauaacaugaccaccugugugagugggugggggagucugcaaugauccagguggccgaguccugaaccaaggcaguggcggugagaggcuugcagaggagaugguuucaggaauuguugaggaggucagccagcugcaguugcccuucugggugugaacuguguguaucuuuuuucuuucuuucuuuuuuuuuuuuuugaaacggaguuucacucuguugcccaggcuagaguccaguggugugaucccggcucacugcaaccugugccucccagguucaagcgauucucuugccucagccuucugaguaucugggauuacaggugccugccaccacgcccaauuuuuguauuuuuagaagagacgggguuuugccaugauggccaggcugguuucaaacuccugaccucaggugacccgcccaccuuggucuccgaaagugcugggauuauaggcaugagccaccucacccagccgacuguauguauuuucugcaccauaaauauuucuugaauaaaugaauccuagaaucacagauuauucgaggcggaagggagcccuuggguccaauucauuauuuucagauaacgccugcauacuacagaugugcgccaccacggccagcuaauuuuuguauuuuuagcagaaacaggguuucaccauguuggccaggcuggucuugaacuccugaccucaggugauucacccgccuugacuucccaaagugcugggauuacaggugugagccacugcacccggccaauaacacuacuuuuaguuucuuuaggaagaaaggaggaaaagaaaccuuuaauagcuucauaacugucuagcauuuuggaggagagacauauucuucauaaaagaacaucaaacucaagugaaaguuauucuuuuaagcacucacauuuaaaaauuuugaccacuguugacugggaaugucuuagagauggucuguuuaucccugaaucaucauucugaauauuauguuuuguuuuuguuuuuguuuuuugagacagagucucgcuggagugaagaaagggggagugagguggcaggcacagaagcugggguugugcugggggaggggagcuucugcagucauccaagugagauguggggucauuuggaccagguuggcgggcgguggugaggggcgguuggcuuauggacucacuaguggggugacugggaugugugagaaagaaaggaaucaaaggugaaccaggaguucuuggccagagcagcuggagggauguagcugccgugaacagacacagaaaauguggaaggggcagguuuggggugucauuaaccaggaaguugguuuucaguauguuaaauuugagaugccugucagacauccaaacagaaaugucaagugaguagaucuuuguaagaguuuggcauucaggggagaggucagguuuggaguucguuuagaagccauuagaacaugggaggauuuaaacccaugagauuagaugggaucaccagugacgaugcugccagcgugugcuuaggaagcauggaugggcaccgggcucuguccugggagcuucguguaugugaacuaacgugggacgaggccagggguugagcacgcuguucaaagguugaggagauagaggcauccuaaagaacagccaguaaaggggagaaaaccaagagaacauccggaagccaagggaggaaggugcuuaggacggagggcgugcucagcugcuggaagugcugcuuggugggauauaugcgggaagccugagagcuggugguugaauugagccacucgggaggucucaagguccuuggugagagaugggucagagaguggugggaggcgccuugggcuggaguucauggagaauaggacacaaggagggcggugcagucagcucuuguaggaaggcucuuuuuacagcgcagcaguaguggauggcgguagggauggugcugcuggaccuggaauucaccagaaaaucuuagucccagaaugggcuggauaagaggagguuuugagcauuagaugcccucgugaaauuugaaggaacccuuggagaagaaauuuugguuuaaucaaguagacauagauucaguauuuuaauuuuaauuuuuauuuuauuuuugagauggaaucuuggucugucgcccaggcuggagugcaucggcucacugcaaccucugccuccaggauucaagcaauucuccugucucagcaucccgaguagcugggacuauaggagcaugccaccacgccuggcuaauuuuuuuguauuuuuaguagagaugggguuucacuauauuagucaggcuguucuugaacuccugaccucagguggucccccugccuuggccucccaaagugcugggauuacagguguaagucacugugccuagccagauucaguauuuuuauuagcaggugguaauucagauuguuuuccucccucugccuauaaaccugggucacucaaggucaagggaaguacguuaucugagaauuuuucuguuuugcaagagagucucgggcaauaguguccucuccuuaggcugagggacucugucauccaccauuuuuggaaagguuccauuugcuguagccauggagcauccggauaauucuuucuugccuguuaccccagccaggacuuuacaguaaucuuggcaugcagcugcuauggaacucacgguguaaagagagcagucacagugagugccuggcgggacagcaccuccacagaaggacgucaaggugauggguaacuuaauggacuugcagcaaaacaaagucacuguccugaagacggugacuaucugccugcguucaagucuguagcaaagaacacaaauuuaaauggcaaugagugauauuucaauugauccaggggacaagaagaaaggauggugcggacccccaaaaagcucauaaccguguugggaaggggugcguaaaugcacguuugcaaguucccguggaagcauguuguaaaggcaugcuccagugcgucugcacacguggaggcgugggaaucccacccgaggcagaagucuuccaguggaucuggugucugaguugguucuaaaggaucacuaauguguuccagcgguugacaaaggguggagcuuuccauaaagaggaaacaauguguagaaaacuccagagguccagaagcgauuuuuuuuuuuuuuugagauggagucucacucuaucuugcccaggcuggagugcaguggcgcauucucggcucacugcagccuccgccucccggguuccagcaauucuccugucucagccuccugaguagcugggacuacaggcaugugccaccaugcccagguaauuuuuguauuuuuaguagagacgggguuucgccauguuggccaggcuggucucaaacuucugaccucaagugauccauccgccucagccucccaaagugcugggauuauaggcaugagcgaccgcaccuggcccagaagugcuuuugaacagccuggaguuuaugugccauucagccaggugaugucggagagcagaaaccaaugagacggguuugggucacauuuucacaggauuccaagcuaagagguugaacuguccuguaggcaguggggagcuaggcgaaguuuucuguguuucauuauuuuuaaauguuuauuuuaaaaauuagaagagguaauacacaggcacaugaggggacauugaaaacaugcauugcaaagaaaauuucccuuccucccaacucuuuccccagcuccccucuccagagacaagcagcuucucaguuucuugugugucuucccagccuguguaauagaaggauccacaguggcgggggagguuguacugggggagacugcaugggggcaggagcccagguaagggaggaauccaggugagagguggaggaggaggugaggugagccacugaguuugacaagcaagggaaagugaguuucuagaaagacuccaagauucccugcuuguguaguugagaagauucagaaugcuauuaacaggaugggccuaguuuuguacaaguugaguuuugaguccuagguggauaauuuccgugggcuguccgaaauuccugucaacugcgaaaagugguuggagcuggagcugucauuucguggacaucagcauuuggauaguggcugaugccauaccagaguacaguugcugagggagagcguguggauggguggggaaggaugccaagccuggaacaugaacaucaaaaacugaaggaagaauuguccucucuggaguucuauaaaaagaguaggauuaaaagauguuagaagcccagugccucgacccgggggaggagcgggcagccucagaggcucucucccuucauggucccuggcugcuggcugcuguaggugauuagaagccugguugcaucacggucagggguacagccucacauuuccugcccugcugagaggcugugguggcugcugcugaguacugggcacggcaggguguagaaaugccguggaaaggaggaugucggcucaugcacucuucgagagaugcugaccaagagcucuuaaccuuggagcuuugagucccauagggcuggggcagacccuaacuagacucugggaaggagggucagagcagugguuugugcacaacacaggcccuucugccccuaaaugccgugagcccauuacccagcagggaaagcagcccccugcccaaggccacccauuccgauucccaccaagcucuguuucuugauaguauauggccagacagcugucauuucuuucuauugcugaaauccgagaugacuugagcuuaagggaccucacagaugguucagucccaccuucuuauuuacaucggaggacuuuggggcccagcaaggagugggagggugccuguuugcaggucaggccaaccgcaauccacacccuguuagcacggacaagucucucagacccugaguccagugacagccucucugggucucccuugccuuuuucccuguggcuuuggaaacaccuccuucaaggcaaggccuucccaguggagacgggcccuggacuggcagcccacagccggggggggggggggggcgguucccagagccccuugucacguccuugucauguuagccaugcaagacaggucucaucgcagagcccaccugcaccgcugccccccagagcccaucugcaccacucccacacagccagccugcaccgcccccccaugcagagcccaccugcacugcucccacacaucugcucugcucccacacaucugcucugcucccacacaucugcacugcucccacacaucugcucugcucccacacaucugcacugcucccccgcgcagaccccaccugcgccaucccccccuacgcagagcccacccgcaccacucuccgacucacagccugccugcaccgcucccccaccgcuccuccaccugcacugcucagcuucugcugccugcaaagcccuacaguggagcuuccccagggcacugggaucuuggccucuguguggggagaacagugcccucugguggugagcaacagaacgagacuagcaaaauugugaaagcugggucagguccaggagagccguuguaggaguuucucuacuguacauguucaaguuuccuuaagaaaaccgaaaagccaaacaaaccaaaccugggcuucaaagaaggauaauucugaaagaggaagggggaaguguauccauacuauggaauaaaaggaauggaauuguucugccaauuacacauauaacugguguauguacauacauacauauuaagcugcuaaaaauuaagaguuaauggaagaacucuuucaggagaagaaauccacuguauauuuuauuuuggguaaauaugcaguggauuuucuaaaaaguaaccuuugggccgggcacgggcacgguggcucacgccuauaaucccagcacuuugggaggccgaggcaggcggaucaccugaggucaggaguucgagaccaaccuggccaacauggugaaaccccagcucuacuaaaaauacaaaaauuagccaggugugguggcggaugccuguaaucccagcuacucaggaggcugaggcaggggaaucacuugaacccaggagcagagguugcagugagcugagaucccaccauugcacuccagccugggcgacaagagcgaaacucugucucaaaaaaaaaaaaaguaaccuuugaaacuuuaauuuucacgaaaacuuuaguuuuaagagucaaaaacuuuaagagaugaucuuauucgcuucauucucauauguuuucugcuucuuguuuagcugugguuuggucuuuccaaagccccccuagaaucucaagggaugacacacaccccucgcacgcacacaaacauacacauacaaacagggcgcacacacacacugguccugaacucagcucaguucccagggccccagcccaggugcugccgguuccccacguccguccaggugucucagugaucugcagguggaggcagcccccuggaggagccccugucugcaggaggcuggagccaccaucuggggcugcugugucuuugcuuuucauaccagcuccuccuggcugcuucagcaagcuuguguguucugggagucucaugcuuuuuccaucugagaaaguaaguucaaggcuuaaacaaauuggccagauaaagggccacgcaauaaaaucucaggcacagagaaaaacacaggugaaaacaacagaaacagcaaggcugagccauuggggaaauugcuuccuccugcguccgcucuggggggccguucacgcacuggauggcauuccauccuuaaggcugcccugaagcugcagugucuucauguuagugagcagugcaaagucaggucccuacgccaggcauuccaagcccccugccgcaagggucccgcugcccuuucagaagggcagcagcaggcagcucaguguccacccugacaggcccugggcuuggcuggauguccugccuuagcuuuaagagguucucagagccgggcacgguggcucacgccuguaauccccgcacuuugggaggccgaggccgguggacggccugaggucaaaaguucgagacuagcguggccaacauagugaaaccccguaucuacuaaaaauacaaaaaauuaguugggcgugguggcgggcaccuguaaucccagcuacucgggaggcugaggcaggagaaucgcuugaaccugggaggcagagguugcagugagccgaaucacgccacugcacuccagccuggaugacagagcgagacuccgucucaaaacaaaacaaacaaacaaacaaaaaggguucucaggcugggcgugguggcucaccaugccuguaaucccagcacuuuuuaggaggccgagguggggggaucgcuugagcucaggaguacaagaccagccugggcaacauagggagacuucgucucuacaaaaaguacaagaauuagccuugugugguggcaugugccuguaguuucaguuacucaggaggcugagaugggaccguugcuugagcccaggaguugaggcugcagcgagcuaugaucaggccaccgcacuccagccugggcaacagaacaagacccugucucgaauaaauaaauaaauaugccaggcgcaguggcucacaccuguaaucccagcacuuugggaggcugaagcgaguggaucacuugaggucaggaguucaagaccagccuggccaacauggcaaaaccccaccucuacuaaaaauacaaaaauuagccaggugugguggcauacaucuguaaucccagcuacucuggaggcugagacaggagaaucacuugaacccuggaggcagagguugcagugagccgagaucacgccacugcacuccagccuggaugacagagcaagacuccaucucaaaaaaagugaaaaauaaaaauaaaacagguucuccaucucagcacggggaccgcagcgauagaggucaaggcaaagccacacccaucagaggguacugggccaggcugggagaacccuggggagcuccuuggcauugaaccaaguacaccaaggcccggaaggugaggagacgggagcaugaagacgcuguugucgcgaucccuucuuacccuugcccucccccuccucaccugcugagcguucacagugacccuagaaauagaagugcgugacuucaggguguguguuuggccuugauuuugaauucuaagaagggggcaugagcuguuggaucacccagccucugucuggcuucagugacaggcaucucacugccuccuggggcagccuuucccucacaggcagcucugacuuaguccucuguguugaacacaacccaccucccuuuaguggggacacacugagccccugggacaggcagaagaaguguggccuguuuccacaugagcucuucagauauuuggagcagcuacucugaucgcucaauuuaugucaugggaacuuuggacacugacagguugcuuucuggccuuauuacacauuauccaaaguuuccucugccuugcauuccauuaggcucaugaaaccucuaucuucuaugauuaaaaaaaaaauuuuuuuuaaauauuuuuuucggccaggcgcaguggcucacaccuguuaucccagcaucuugggaggcugaggcagguggaucaugaggucaagagaucgagaccauccuggccaacauggugaaacccugucucugcuaaaaauacaaaaauuggcugggcgugguggcacgcaccuguggucccagcuacucgggagucugaggcaggagaaucgcuugaacucaggaggcugagguugcagucagccaagauugugccacugcacuccagccuggugacagagcaagauuccgucgcaaaaaacaacaacaacaacaaaauaaaaauaauuaauuuuuuuuccuccagaaaggguaauaggagauaaacucuaagucuuuguaugucugaaaauaucuucauuuucuuaauaccugauuaauaguuuauuuggaauuaaaauucugaguucaaaauagcuuucccuuauaccuuugcagccauuauaacaguggauuccagugucacugaugagcaggugaggccaccugacucuuggcuuuuuguagguggccugucuccgccugcucaucccuuccuggagacuuuuauuuauuuuuuaaaauuuaauuuuuuuuuuuucugagacagagccucgcucugucacccaggcuggagugcaguggugcagucucagcucacugcaaccucugcuuccuggguucaagcaauucuccugccucagccuccccaguagcugggauuagaggugcccgccaccacacccugcuaguuuuuguguuuuuaguagagaugggguuucaccacauuggccaggcuggucuggaacuccugaccucaggcgauccacccgccucggccucccaaaguguugguagccaccacgccuagcugguucaucuugauuauucuuucaugugcccucccccuuuaaauguuugugagucguuuuaugaccauuuauauuuaugaaccaaaaacugguugacuagcacaugcaguuggaguggguuucuuuguaaucguguacaccuauuuacccaaaaguuuuuuccuuugaacagaaagaucuugcaagcucuaggaaguuguaagcucaacccaggcaccucuuauguuugcagccuaaauucucaucaccuggugguccaaaauacuugaaaguauagauuuaauuugaagugguuucagaccagggaugccugcuaugugccugacaaaagcaaaugcauccccucucuggaggaaggccucuuaggccucaaagaauacccagagggaauuuuucaaugaugacaagcugccaaugacaaaaaauaaucaacuccccaaagaaccaagugaagacuuagaagaaacaagaaacaaaaauauaccaaugaagaucuuaguuacuaggaucaccagacacagacuauaaucagcuacguuuauuauguuuaaagaaaacaccugcaaaggacaaggacuauagaaagugaccuagaagaugugaaaaagaaccaaauaggacaucuggaaauggaaaauauaauaagcaaaaugaaagauaucaaugguauaaguuuaacagauuagacagagaugaagagaggaucagugagauggagagagggagauagaaaugacccagaacacagcauagagagacaaggaccugauacaagauagcuggagaagaaacuacagcaaauaucauauucagucaugaugugauggaaacuuuuucuuucaauaaaggauuaagauagagaugacugucaucaucacuuccuuuuacuguacuacuggaggucccagccagugcagaaagguuaggggaaaaauguauaaggaccagaaagggaaaaaucaaauggccauuauucccagaucaugugaaugggaaauaagaaaauccaaaggaagccauaaauuacuggaauuaauaagagaauucaguaagacugcuaagcacaagauaaauucauauaucucugaccaggcccaguggcucacaccuguaaucccuacacuuugggaagcugagaugggaggauuguuugaguccaggaguuuaagaccagccagggcaacacagugagaccccaucucuacaaaaaaugaaaaauuagcucuucaugguggcacgagccuguagucccagcuacacgagaggcugacaugggaggguugcuugagccugggagguggaggcugcagugaacuaugaucaggccacugcacuccagucugggcaacacagcaagacccugucucaaaaaaaaaaaaaaaaaaagaaaagaauuuuuuuaaaauguauauaucucagucauuucugaagcaucaagcaaguagaaaauuuuauuuuaaaaagauaacauugcuggcugggcacaguggcucacgccuguaaucccagcacuuugggaggcugaggugggcagaucaccugagaggugaggaguucgagaccagccuggccaacaugggaaaacuccaucucuacuaaaaauacaaaaauuagcugcgugugguggcgggcaccuguaaucccagcuacucaggaggcugaggcaggagaaucacuugaauccgggaggcagagguugcagugagcugagaucgcaccauugcacuccagccugggcaacaagagcaaaacucugucucaaaaauaaauaaauaaaauaaaaagagauauccaugguaucucuauagggaaaaugauaacuucuuagaagacacuaaaggaguccuaaaugaauagauauucccuauuuauaaauuugaagacucauuauuguaaagcuauaagucccccuaaaaugaucuauaguuuaauacaacccuagaaaaauccccaagguuuuuuucccccaaauaugacaagcugauuauaauacauguauagauggucccugauuuugaugauucaacauaggauuuuuccacuuugcaauguuuucuucgggccguaaccccauuguaagcugagcagcaccuguacguggaagugccaauagccaagaaucaccaagacucucuuggaaaaagaaagaagcugggaagacaugcuuuagcggacagccaggcuugccugaugccaggaaugagacagggugguucuggcacugcacggguagacaaguggacugucggaccauagaauccacggcagccacaugcuguguagacacguccuggccuuaugaagagaaagcacuucagugggggagggagaggguucugggcaauguuuagaguggggucggggucgcgugguuccuggaggugacauacgggguguccucgugcuagguggcagugggucccaagaucccuggaggugacacacggggugcccucgugcuagguggcggugggucccaagaucccuggaggugacacacggggugcccucgugcuagguggcagugggucacaugaccccugggggugagagacaacccucacauggguggccgucugggaggcagcaagucuggcccuggcucugccacuugcucugugugugagcuuuccaagucgcuuucuuuuugcagccuccguuuucuugccugugcaaugaguggauggaacuugacagcucgagagccuuuccgcuccgaggcuuauggauccuggguugaaagugguggccaucgucuguccacacaaagccaaagccuuaggcaggcugcacuguugacaaucuuugaaugucucuucauuucaucuuucucaaggugugcgcagagcagagcacagagggccacccggggagcggcaaugucucugaguaaguaccagggaggcacaucucucccagaagccacggguucuuuuuguugacuccagccagccucagagcccuccugucccccacuuuccuccagguccucacgagguuuccagaggcagcucccucuaaaugcaaagcccuagcccucaagggaagguccugccaaggagauugcagaaggcuaaccaucucaccgcagcuuugcucuuccuccuaaaaaaggucgugaccuggaucagaccagggcaugcccaacccauuuccuauuugugcuguaacucauucaaaaauauucaggugccaugcugugcgcuguggccagaucuaggaacaagacacagcccuuaaggaacucgcagcccagggccagcagcgggcccaccugcagcuccacagcacguuaccagggaaccacgcugaacacccuugaagguagcaggcgaggagccugggcucauuuccuccuuuaaaaucccccaaccccagagcccaggccuugucugucugcuccagggaugucuuuccaccccaggccggucacccccuuggcuugcugaccuccagcuaauguggcaaggggucacugggagugggugauugucagguaagauugugggagugaaaaaguuuggaaauguuagccauuguccuuaauuacaaaugauuucaggacaggaacccugcugaacucgcuuauuuaacagacacugggagguccuacccugagccccacagcggugcugagggcugcagugcaggggccgggucugaggcccagcccgggaggggcauggucucgggaaaugcaagcagcgagcuccaggggaggucagaacugguguuuaagauggcuugaaggggccggacccaguggcucacgccuauaaucccagcaauuugggaggccuaggcaggcggaucacuugaggucaggaguucaagagcagccuggccaacauggugaaacccugucucuacuaaaaaaauaccaaaaaaaaaaaaaacaaaaacaaaaauuagccgggcacaguggugcgcaccuguaaucccagcuacuccgggggcuaaggcaggagaaucacuugaacccgggagguggagguugcagugagccaagaucgcgccacuucacuccagccugggugacagagggagacucugucucagaaaaaaauaaauaaauaaauaaaaauauaaaaauaauauggcuugaaggacguacaggaguucgccgaggagagaggaaggaaagaggcuccugggacacuguguggacaggugggggugguaggagggaauuggggagggaggauuaaaguguugggagggccuugaaugcugaguggaaacugcuggccauugcuucccaguagaaugcuguggccggcucugggcaauguuagaagcugcugcagagggggagguagugaggagugaggaugaugcccacgcagcucugccccugcacugucagcagggacuuuagaguuuccaucagcccaaggaauuuaggauuaaauccuaccaugaacuaauuagcuauuacuucuucugacuucuacacgugcacauuccaggacaccccugacauauccguuacuaccacucaccagugguacuucacucauucaguauacuuauuuauuuauuuauuuuuauuuuauuuuuuauuuuuuugagguagaguuuugcucuugucauccaggcuggagugcacugguacgaucucggcucaccgcagucuccaccacccggguucaagcaauucuccugccucagccucccaaguagcugggauuacaggcacgagccacccuguccggcuaauuuuuguauuuuuuguagagacaggguuucgccaaguuggccaggcuggucucaaacuccuggccucaggugauccgcccaccuuggccucccaaagugcugggauuaugggcgugagccacugcacccagccuuuucauucaguauacuuuaaugggagccucccugagugcugcccuaggcguaggagugcccagggcucugucagccccuccagcaccgugcuuccaccaggaaggaagccccaggucccagcaguccugccccagggucagggcuggcagcaucugcccuguacccacugugcuucucgcugcccacggcacacaccugacucccguggcagccguggacccugcaggccagucucagccccccagcgugcagcucuuggguaccagugccucacccuguggcugcaacagugucccgcccuucaaucuccucccuccagugucacccucacccucccaggcaggguccuuccaaugguguuucaggguggaggugcuaaugucugcagcugacucugggaugcaucagaaaaucagaugaagaaguaaauaaguacgugauaaaguaaauauagcaaaguugaacuuaauuguugaaucuacaaauuuuaacuuuucaguauguuugaaauuuuucauaauaaaauaucgaagaagaaacccuucaaagcacaguuuaaacaucucccccucauacucuauccccuuccuggucaaacuagugucccuccucccgcauggugcaacuucccagccccucccacauguggccucuccuguaguagguccacgugaugugguccugcccuguccccucucuucucuccaggccucaucacagaaggaaucagauucgccucugggcccucauagcuccaggcacaugguagcauuucauagacgcuuauugacaggauuguuuaaugucagccuggggcgugugggccuugaccccaguccugaccauccugacaacgccagguccuucccccgggagggcccugcggaagcagcagagggaagcagccaugcgggaggaagucgcugcuucccugagcuuuuggcugggccauccugaccugaagucuguaaggaagggcuaguggaagcccaggggcucauggaggggaacauagggguucuagaaacuucugucugcagcugcugcugaaauucacuuacuguucauucugcaaaugcuuguugaguacccacuguaagccaggccuugggccagacacauuacgguauuggugagagagguuacuccuccccauuuuccuagugaguaaacugagauccaaggcaguauuuccccagguuggagaggcggcagauucuagaaaauucuagacccagccaggcgcaguggcucauaccuauaaucccagcacuuugggaggcugaggugggcagaucaccugaggucaagaguucaagagcagccuggccaacauggugaaaccccaucucuacuaaaaauacauaaaaauuagucgggagugguggcacgugccuguauucccagguacuugggaggcugagacaggagaaucccuugcacccaugauggggagguugcaaugagccgagaucgcagagugcgccacugcacuccagccugggugacagagcaaaacuccaucucaaaaaaaaaagaaaaaaagagaaaauucuagacccaguagaauaacacaaauguucuugccucauuuaacauguggguuucugaggcccaauuacaauggauuuguucucucuggagaagcguauugguuucuuuucuuggagugauuuuccuuggaaaggucuuuuucuuuuaagaaauuugugacuuucagccuggguaacauagggagaccucgucuccacaaaaguaccaaaauuagccaggcgugguggcacaugccuggggucccagcugcucaggagacugaggugggaggauggcuugagccugagaaguggaggauauggugagccgugauccugccacugcauuucagccugggugacaaagcaagauccugucuaaaaaaaaaaaaagcaugacuuuaggagucccugcugauggaaaaccugacaguaaaugagaauuuaaacaaaaauucauuucuugacucccucaagaguggugagacuucccaagaaucccuuuaggaucaauuuuucccuuuuaucugugugcccccacccaagcaggggaaagaaagagcuuauggccccaccuggcucucuaagccccacaaauugccccacgguguugguggaguguugccaggcagacagggcagggguggcuguggagcccaguggagccugaccucucacagacccaggacugccuaccguccuacucacccuagccccagggcugcccgucagcuucccuugcgccagucccugcucuccuuucuccccaagauuccaccuacagggcaugucgggugcugagugagacaggacgagugaggagaauggcugugugaaucuggacagccaccucccccagggcucagcuucacauccacaggcaagcagggggcugccuggugagcccagaggggcuuuuauuccuguggggguccccagguccagaagugcugcuugggauuccuguuggccaggagauccuguugcccuugagggugucugggcgucccgugcccauuucucuucuucccaacaauccucaggggaggugagcccaggaggauggugggaaacaggaagggcaguggccgggucucuccucuguacugggugcuuugcuggucccuuacucugccuuuuuguuuguuuguuugguugguugguuuuucuuuuuugagauagggucuuguucugucguccaggcuggagugcaguggugcaauuucagcucauugcaaacuccacuucccaggcucaagugauucuccagccucagccuccugaguagcugggacuacaggcgcaugccaccauguccggcuaauuuuuguacucuuuguagagaugggguuucaccauguuggccaggcuggucucgaacuccugagcucaaagcaauccaccugccucggccucccaaagugcuggggauuauaggcaugagccacugcgccgggccaggcaugagccacugcgaaacuaacagcaucgcagcgacuucuguugagugcuuccuuagugcccagcucugugguagacacaccgcagauggcgccugguccagcccucaggcuggacucguggaguagcugcuggguuuuauccacaggggcgugaggccugguacaugccuugcccacagccacacagcgacugcguggcagagccaggugagaucugccuggcuccagaacgucugcauuuccacugugucucagggcugcaaggaacacauauugccuucagugcuuucacagacaggcagugugccaagagcccugcaggcgucaacagugaccacgcagcuguuucugcgcacuggccgcgggcagugcuaauaaguauagucccuggagccagcuggucaauaggggcaugacgucuccgggacaggggaggaguguguccccuggacgccuggaggcccucugcuagaugccgauccuuccugggggaugaagucaaguggcugugccaggagcccagcucuugcccugaguucccagagagccagacggggacccggaggcugugcucugagcaucagugggaguagucagagggacauuuaaguccauccagcccagccccccaagcucgcagagggggaaccaggccgggaaauggggggcggcuagcccuaaugucuggcaaguggcaaagcaguuggcgguguucccauugcccagagucccuggcuggccacugggagggcagcauccaacaccuggcugugggcagcuggccugccucuccuggacccugucagcugcagaccugcacacccccuuccgaggcagcaucuccaggaggcagcacccagccugaccgaggcuucaugcccugcccugggcucccgggacugccuccugcaaaggucugcacauuucgacacaaccguggcagguccgggggcagucagcaccacccagguguccacacaaaguccagaaggucugggagagcaggacaagccagcaggguccaggcuggcgcagccgcuuucuggaacccaggcagcaggagcaggagcucuggucucggucccucucagcugggcugccaggugggcugagggacuggcgggauccugaacgugugguuccccacaaugagcagcuccugugagaccccagaggguacaagcacggaccgaugucggcaagcagccaacaugacaguaauucccuuuuauuuuuuauuuauuuuuuuugagacagagucuuacuuugucacucaggcuggagugcagaggcucauucuuggcucacugcaaccuccacuuccuggguucaagccauucugccucagccuccugaguagcugggauuauaggcacccgucaccccacccggauaauuuuuguauuuuuaguagagaugagauuucaccacguuggccaggcuggucucgaauuccugaccucaagugaucugcccaccugggccucccaaagugcuaggauugcaggcaugagccacugcgccuggccgugauucccauugauuaaggcuguggugugcucgauuccacaucacaugcugcccaugcauuaucuuaugcuucagaacgacucaugaauaaaguuacgugcuugagaaaaaacaccgaggcucggagacacacuggccuugccugaggcgcgcgggugagccgcagagcugggauucaagcucggucuucccaccccagagcccguccucccucaaccagggcaggugcuggcuuccacucugcgagggcucagcguugugggagaugaagcggacgcaguagaagccugcugguggauaugugcugggcgagagcgccacagggugucccagggcaaagacuucgguuuggguuucaggaugggcccacuaggagccauugugguggccaggggaaaugagugugaacgcaccauccugccuccugacagcccugucccauuucugacccacagagccccaggcagcggucgcaagaagcccgagaggccggcagccaucuccuacgaccacucggaagaggggcugauggcgagcaucgagcgggaguacugccgcugaggacagcaugcuccacccccgccaggccucggaggcaccugcuggcuggggcacccucugcuugcacagagcucuagcaggagcugaaccaccuccaaaacgcagucacucccggauauucaaagcugcccuuucaaauccacuuucagaccgcgcugaccugggccagccacuggcggucaugguugcuggugggggcgauuagcuguguagacccacaggugcgugggccugggccgccggcgccuccuccccaacgcggggagccugcccaguucuucuggagccugaaaugcgugccccucuugguugcccgcucuccacaguggggagggcucacgaggacuaggugacacaagcgagccccuccuggcauccgcgccacaacacuuccggaagguucugcuguggaaggugcacccgcgcugcucccucagucucgggcccaucucuccagggguggccgggucagcuuagugcuucucaacuuuaacucccuaaugagcagccugggggugcuguugacuugcagggccugagguucuguacgucuaaccagcucccagcccaggcccgagcuccgaagccccaacugcacuuugaggagcgagaaccccagcucugaucugccuugcagugggagguagagcucgucacugccucucugggccucaguuucccucucuggaaaaucagcucuggcagcucuuggaggcccuccccagcucugacaaucuggaacugcugccacugcugguccccugccccaggcacagcagugccuucccugcggggagccagcgcccagguccaaccgggagagggucugccugauacuggcuuuccaguucucccucucacaggcagccuggccagugccugcggggcuuuuaaauucucuuccugccuggguggaaggugggaaaccacagcagugaggcaggaagagccuuggaauguuccugguugacagaugggaaaacugaccugcccaggacgcccugggaacagggggcggagcuccggcuagaggggacuccugugugggcgggcaggucuggagccugggcccagguguggccugcugggggacagcuccgggggagagcuguggggagaacagcggucuagggaggcaggaggcaggcggcaggcuccuccccagcagccugcagggcaucaggacagagggggaaggaggagacagaagggaaagaaggagauagagggggaaggaggaaacagcgcggcuucugcugaagccaguacaagccugguuaucuggcuugacccgcccacacggaggccuccccagcguuuucuuuuucccgagaagagcuccagcucgcagguccuuagaacacagcagagcaggagcaucucaggaaccaacggccagcuccuuggcgcuguccccagccccacaggccugcugcggccauccgcaaacgggcauuuccuugaacuuuugagagugccuuugaccagcuguucgcagcugggaaacuccaacuuuugaagucagagcuuggagcggcccccgcaagggcguggcucaaacccuccccagagcugggagccauugcuuaugcaagcccguuucuuuugauguaaagauggaagucguuacuauauuuuaauaaugcaaauacaucuuuuaaaauaaguuaacauuucuuaccaccagauggaucaggcuuugaauuuaaacauguaaauguuuguaauuuuaugucauuuuguuaaaaugggacgcuuucaauugguuuccaagaaagaugauaccucugcauuuucugguggaaaagguguaauacccuuaaugagaucaaaguguuaggggaaaaaaauuccaaaaguaguuacaagcuauaucaaugucaaaguaaaugcacuucaucaaagcuaagaagucacaggaauuguucucagguuuuuaaaaaaauuuuuccugaauucaggaagugucuucugaauagcagcuagccaaauaaagcgguguguguguacugcagcuguaggugaacuuaaaaauaauaauaaaaagaacaaau

SEQ ID NO: 192898 - RNA, 437 nt, Homo sapiens
uaaguggcucugaaaagagccuuuggguuagaaaugacguuuacuuagcaggcuuacuuggagcugguguacuuagugacagccuuggugcccucagacacagcauguuuagccagcucucccggcaguagcaagcgcacugcugucugaaucucucuggaagaaaugguggagcgcuugcuguagugagccaaacgugaugccucgcucgcuauacgcucaaagauaucagugacgaaggaauucauaaugcucauagcuuucgaagagaugccaguguccggauggaccugcuuuagcacuuuguagauguaaauagaauaacucuccuuacggguccucuugcgcuuuuugccuuccuuuuucugggucuuaacgacagcuuucuuaaagcccuucuuggaaaugguagcaccuuuagaugacaccuccggcau

SEQ ID NO: 192899 - RNA, 437 nt, Homo sapiens
augccggaggugucaucuaaaggugcuaccauuuccaagaagggcuuuaagaaagcugucguuaagacccagaaaaaggaaggcaaaaagcgcaagaggacccguaaggagaguuauucuauuuacaucuacaaagugcuaaagcagguccauccggacacuggcaucucuucgaaagcuaugagcauuaugaauuccuucgucacugauaucuuugagcguauagcgagcgaggcaucacguuuggcucacuacagcaagcgcuccaccauuucuuccagagagauucagacagcagugcgcuugcuacugccgggagagcuggcuaaacaugcugugucugagggcaccaaggcugucacuaaguacaccagcuccaaguaagccugcuaaguaaacgucauuucuaacccaaaggcucuuuucagagccacuua

SEQ ID NO: 192900 - RNA, 500 nt, Homo sapiens
gugguucucguguugcugcaauuugaugcgaggagaugucuggacgagggaagcagggaggaaaagcacgcgccaagucuaagucucgcucuucuagagcggguuugcaguuucccguaggccggauccaucgucugcuucguaagggaaacuaugcagagcggauaggggcaggcgcaccaguguauuuggcggcaguguuagaguaucucacagcagaaauccuugagcuggcaggcaaugcgucucgcgauaacaaaaaaacucgcauuauuccccgccaccugcagcuagcgauccgcaaugaugaggaacucaauaagcuuuugggcggcgugaccauugcccagggcggaguccugccuaacauucaggcagugcugcugcccaagaagacugagagucaccaccauaaagcccaaagcaaguaacuuaagguugucauugguaaaaagacuucugugucagaaaaaacaaaaggcucuuuucagagccaccua

SEQ ID NO: 192901 - RNA, 500 nt, Homo sapiens
uagguggcucugaaaagagccuuuuguuuuuucugacacagaagucuuuuuaccaaugacaaccuuaaguuacuugcuuugggcuuuaugguggugacucucagucuucuugggcagcagcacugccugaauguuaggcaggacuccgcccugggcaauggucacgccgcccaaaagcuuauugaguuccucaucauugcggaucgcuagcugcagguggcggggaauaaugcgaguuuuuuuguuaucgcgagacgcauugccugccagcucaaggauuucugcugugagauacucuaacacugccgccaaauacacuggugcgccugccccuauccgcucugcauaguuucccuuacgaagcagacgauggauccggccuacgggaaacugcaaacccgcucuagaagagcgagacuuagacuuggcgcgugcuuuuccucccugcuucccucguccagacaucuccucgcaucaaauugcagcaacacgagaaccac

SEQ ID NO: 192902 - RNA, 64042 nt, Homo sapiens
ggagcgggcaugguggggugucgggggccgcaggcguagcgcucucgcccuggccauggagcggccggcgcccggcgagguggucaugagccaagccauccagccggcgcacgccacugcgcgcggcgagcugagcgcggggcagcugcucaaguggaucgacaccaccgccugccuggcggguaggcgggcgccggggcugcggggaggcgcgggaccggggcugcgggagcggcggcggcugggggcugggggggguaggaaggcgaggaagguacuugcggagagcugaacccugcgcagccagggauagggguguugcaacagugcgcccgcgcugggcauggccgagaccggugguucccaaauguguggcucucgggacuccuucauuccauuaaacaagugaggagcccagagagcuucugcgggguuuuuuguuuguuuguuuguuguuguuguuguugagcucucucccgggcuggagagcgguggcgccaucagaggucgcugcagccucgaccuccugagcuaaagcgauccucccaccucagccuccagaguaacuaggaccacagacgcacgccaccaggcccagcugacuuugggaguuuuguuuuguuuugcuuuuguagagauggggucucacuauguugcccaggcuggucucaaacgccuggacucaagugauccugaaguguugggaggccccagccucccaaaguguugggauuacaggcaugagccaccgcacccaggcagcuuuuguuuauguaggcuauuuauaucacauuuaccguaauggaaauuuaaaauuuuuaauuauuuuuaaaaaagaaauggacuacauuguuagcauaacauuuuuaauuaagaaauaacuauuuuccacaagaacaaaaguguagcgagaggaguggugauaaagguuacauccuggcgagucucucuaaggucuggcuaguggaggauugcugacuacucauaccugcuucugcauucacccugcugcuaccacacccuuauguagucucuggaaaacuccacuguguucuugugacagaaugacaguaaaaauggcaaaaacauuuauuaaggacugaauuauaucccccacaccacccaccgaaauuuauacacugaaguccuaaccccuggugugacucuauuuggagugaagaauuaaggcuaaugaggucauaagaguggaauccuggucccauacaauuaauguccuuauaagaagagacacuggagagcuucucucugccaugugaggccacagcaggaagacagccauccacaggccaggaagagagcccucacuaggaccuacaaugggcaagcaccucgauuuggaacuucccugccuccacaauugugagaaaucaaugauucguuuaagccuuuuuuuuuuuuaacaggauuugagauugguuauauuaacaauggaaacaugaauacaaaauuaauccacacauaggaaaaaagaauaauacauaaaccacugagguugcuaauaauaaugaugccuguuuccaaggcaacugaauacauuaugagaccacugaagugacuuuuaguuaccuugcuuagugccucugucuugugauggagaaacaauggcccaccugcaauugucaucauuucuaugaccugacaucuuuggaaaccauggaaagauccaauugacaaucaauuacucuauaccuuaauaguuacauuacuauuaguaguauaauauuaauaacugauaauguuacuaauauuaagaaaaccuguaugauaaaguugguuugggcaacaugaauaacgccuguguuaaacacuuuauggugaccugaggcaccacauaagcaggggacauuauuuagccaagguguaacugaaucuguguaguaauauaaaacugauuucucugggauuuucucagaguuuuuuauaggccagcauuaucucuuuagccacauuacugcaaucccagucauggcccccaaggcauuucuaugaccccuaggcacugcuggauuccaaaaugucuucucaauauuuaaagaaagaugaaauauucucacuauccuuacuucugucaguggccccauuauuuuuccagucccuuaagucuaaagucuugaagcuaucugaguaauccucuaucucacacguccauguauuauuuuggaacaucucacacacacgguuuuuuauuugugaaucuuuuccaggguuuacuaucucuggaguggcacccaacucaucuaguugagcaagucaaaagucuaggagucauccuugauauuucucucuccaccuuacuucucacuucacauacucuaugcauggagcaaguccuaucaguguuacccccuaaaggagucucugaaauccaagcacuuugcugcacccccauugcgaccaucuacuccaagcuaucaucauguuucaugcagacuucagcagugauuuccaaacucaucuccauucguucuggucuccucuccacacugcuucuaaaguaaucuuugaagaugcuaaucugauugaucaugucauauguuuuguucauuuuucccuuucuuuucuucaccaagggcuuuaaggauuuuucuaagauguucaagugcuuccuacuaaaaaaucucccacagauaauaauuauaaacucugggcaaaacacuaaauaaaagagacuuaaggcaggugaaaagugaacaaaaguaggcuuauaacacuugaaaguuaacacaugaaagaacaaagugguguuggcuuuuucuguguuuguuuuauaaaugacuugaagccugaaagaaaaugccagucugcucccagcuauaguucugauggaaaacccacaggcuugcugguuugaagagcccaaagacaggguuugggaaaagcacagcuacugaaugaaauacaaaagggaaaguuccagaaaggaaagagccagagagacagagcccuaaaaucuaucuauaaucuuuucccagauaucuggcaaaucuugaaucauguauacauaggacagacuccaaaccuccugguugaggccaaaagaacugaaaauaguugugcccaucucuagguagacagauuauaguuuugguuuggucagguuaacugcuugcuuuaaaaaacaaaaccaaaaacaaaaccaacacuuuucagagaaacacaguuucuacaauggaucacucacaauggcuaggauauuauccaaaauuacuugaaauacagagggaaacaugauuuauucuuaagagaaaagaugaucaauggagauucaucccuagacaacccugaugcuggaauuaagcuucaaggauuuuaaagcagcuaguauaacugugcucaauaauauaauuaaaaauaugauaauaaagauugcuguaaucccagcacuuugggaggcugaggcagguggaucacuugaggucaggaguucaagaccagccuggucaacaugaugaaacccugucuacuaaaaauacaaaaauuagccggguguuguggcaggugcuuuuaaucccagcuacacaggaggcugaggcaggagaaucacuugaaucugggagguggagauugcagugagccgagauuguaccacugcacuccagccagugcuggagucucauuugagaaugagacuccaucucaaaagaaaaagaaaaagaagaaaaagauugaaaagacaguacauuucugcagaguaauagaaacuauuuuuuaaaagccaaaugguaauuccagaacugaaaaauacagugucuaaaauaacaaacucaauggcuaggcuuaacagcagaauggacauggcugagaaaagaguuaguaaaugcaaaaauacaucaauauaaauuauccaaucuaagaacagaaaaaaaugaauuuuaaaaauaaaguguggccagguacaauggcucaugccuauaauccuagcacuuugggaggcucagguaggaggaugguuugagcccaggaacuugagaccagccugggcaacauagagagauccugucucuaccaaaaaaagaaaauguuaaaauuagccaggcaugguagcauguaccuguagucccagcuacucaggaggcugaggugugaggaugacuugagccugggaggucgaggcugcagugagccaugauugcaccacuguacuccagccuggguaacagagcaagacccugucucaaaaaaaaaaaaaaaaauacauaaauaaaauaaagugucagagauuuguggaaaaauaaaacauaaacauaauuagaguuccaaauauggugaaagacauacaauuacagauucaaggucauagaacaucaagaaaaacuaauacaggcugggccugguggcucacaccuguaaucccaguacuuugggaggcugaggcaggcaaaucaccugaggucagaaguucaagaccagccuggccaacauggugaaaucccaucuuuacuaaaaauacaaaaauuagcugggcaugguggcgcacgccuguauucccagcuacucaggaggcugagcaggagaaucucuugaacccaggaggcggagguugcagugagccaagauugugccaccacacuccagccuggaugacagagugagacucugucuccaauuuaaaaaaagaaagaaagaaaaacuaauacaaagaauacauccaggcauaucauagucaaacuaugaugaagagaaaaucuugaaugcagccagacugaaacaccguauauaggagaacaacaauuagaauuaccacugaccucaucagaaacaguggagaccagaaggcagugcaacaauaucuugaagaauaauaauuacaaaaacuuugaaccaagagcuucaaggcccugugcauagccuguccucagccuucacuccagccucaucucacccacucucccuccuacucucugcauugcagucaccaggaccuuuguagucacuguucccucugcucagcaggccuuccccuccucugcccuccagccuuccuggauaccccaccuaguguauuaucucaguuacugacugucauaaaaucccuguuuucuucagagcacuuaguccauuuugucauuauguaucuguauuaguccauuuucaugcugcugauaaagacauaucugagacuggguaauuuauaaagaaaaagagauuuaacggacucacaguuccauguggguggggaagccucacaaucaugguggaagguggaaggcacuucuuauauggcgguggcaggagagaaaaugagaaccaagcacaagggguuuccccuuauaaaaccaucacaucucgugaggcuuauucacuauuaugagaauagcacaggaaagaccugcccccaugauucaauuaucucccaccgguuccuucccacaacaugugggaauuaugggagcuacaacucaagaugagguuuggguggggacacagccaaaccauaucaauauccauuuaauuaaccucuagcucauccacuagacuccaugagagcagggguccuggcuguuucccauugccagcaccuuacgcagaggcugccuuauauaaaauaaaacaaguguucaaucaauaucugcugaaggaaggaagaaaugaaggaagguuaccacuauuuuuaucagucaucauuucguaccuacuuacaaucacuuagcuucucuuuguucucccaggaaaucagaaacagcuuuaggguuuuccacuucugcugguaugaagggcaaucaaaaucaagaaccagaacaagccaguccugugaguucaugucaucuaauugacacucguuuaaaaacacagcacgcauguaaugacaugugaagccaggacccuauggugguccccauauuuuuuuuccuuuuaguuuaaugacccuugaaaaucaaugguauaaaucaugauuauugagcuccugaaacccauauuuagccacguccuucucugggaguguucucugguuugucuaaccuacucuuuccugaaaguuccuauugcuucuauagucaaaaucacuauuuagaacaaugcauuuaaucuuucuaagccuaaauuuucuuauuuauaaaagggagcuaauaauaguaccaacuucauguaaucgacaugcuuaaaugacuaguccagugccugaucaauaauaaaugcuuaauaaaaaguaacugucaugauuuuauuacuuuuugaucccuuaagaaaucuaguauagugcuacauauacagaauagauacccaauauaaacaauaaaaguuuaauuuuuuuacugguuacugcauuuuaguuaucauuuaagucauucaaaauugauaacucagccgggcaugguggcucacaccuguaauuccagugcuuugaggggccaaggcaggaggaucacuugaguccaggaguuugggaccagcuugggcaaaaucaugagacccugucuccacaaaaaauauuuuaaacaauuuuuuaaaaguuagcuagcugugguggcacaugccuauagucccagcuacuugggaggcugaggcaagaucacuugagcccaggaguucgacgcuggagugagcuaugcucgugccacugcacuccagccuaggugauacagaccucgucucuuaaaaaaaaaaaaaaaaaaaagauacucaagauacucauguugguauacauuauaacacuuuauuacuaagaauuaauaaccucaacaucccauucccucaugucaaguaacuggaaugaauguuuauuaaguauucuuuaaucaaugauuuaagcauauauuugcaagguuucagcaguucccuggaaaacuuaagcucuaaaaggguacugacuauggcuggaucucuaagugccacagaguggacugcuuaaaagauagagcucaugccuguaaucccagcacuuugggaggcugaggcaggcagaucacgaggucaggagaucgagaccauccuggcuaacauggugaaaccccaucucuacuaaaaauacaaaaaauuagcugggcaugguggugcacaccuguagucccagcuacucaggaggcugaggcaggagaauugcuugaacccaggagguggagguugaaaugagccaagaucacaccauugcacuccagccugggugacagugagacucuaucugaaaaaagaaaaaaaaaaaaaaaaaaaaaaauggaacucauccaacucagugucuggaaaucagcaagaacuuaacaaauguuuggugcauugaauuaaguugaguccaccuugagcauuccuagaguccgauucuuccauuuucccuuccuugaacauuugaauguccaauuuucugcagaauuagauccuagacaggaauguguuaaauacgugcgcagugggguaucucucaugucuucuuaccuaggacuaucaauuaauacauauguaguuauaaugauccaguacgcacaaggaagacaaauucaguguaauucacucuuuucuucaucauguggcaccaggacugaagucuccaaaacuaaaaugaggucaaaaguucuuauaaagccaauauaaucuguuuggcuuucaauuguguuucucaaaaucaaaucuggcagaagcacaugucaaaaucuuccccacagaguauaaauucugguguuuuuuauguaaagcaaaaccaacaauaaaaaaaaaaucugagcaaauuacgugcagacauagaacauggaaauaacuaagcuucuuccugaacucucccacccuacucaauacuccuccuucaagguaauuaauguauacugaauuuggcauaaauuugguaauaauaaaauaaauauugacuaaauaucuacugugugcccaucucucuuucucugauacccagagaagauccucuuugauuugggaugacucgggguuucccauaccgcucaagugcuuacggugguuaaaucauuuaaacagauucugcuacugguuaugugggcaaguggcuacaccugugaugcuuugauuuuaaaacaagaaggauaguaccugauaaaauauuuaaagucagcaccaacuuacuaaaauugcuauuucaauagcuagauuugcaggaucuugguauuaaauuucaaauacaagaccauguaaguuaaaaauuaggauaaaaagugcaguaauuaccauacauuagaaauauaacucacagagcaaagaagcuuguaaugagccaguugauccagaaaguguaggcacaguggugcuauaaugaaugagggaugggugacuaaaaucaaugcacuuacauuucauuccuuucccuuauacugaaauauucucauaucaccacuaaagcagcacauuuuuauguauuuuuugaagcugagaaacaugcuggaguuuccugcguuacagccucaguggaugacauacaguuugaggagacagcuagguaagugacauugcuccauggcuccuuucuccuggguuuguggguucaucugggacauguauugguggcaccugagcuuauucaggcagagguagugaucuuguuucuuaauaaaauaaauaacaugugacccaauuuagguaaguaaaaaaauaaucauagggccuacuuauaagaaacacucuuaaguguaacuucacagucucaauuuuguggagaaauagcucucagccuuagaugcauuguggcauaaggcauaacagccaaacagacuuucuauaagcuccuuuuuuuaauugucucacucugcugcccagacuggagugcaguagugugaucuuggcucacugcaaccuauuccuccugggcucaagugauccuccugccucagccucccaaguagcugggacuacaggcacaugccaccaugcccaccuggcuaauuuuuuuuguauuuauuuauuuauuuauuuuuagagaugggguuucaucaucuuguccaggcugaucucgaacuccugggcucaagcgauccacccacuggcuucccaaggugcugggauuacaggagugagccaccaugcccggcuacuauaagcuaauuauuaacauccccuuccuguacuagaagaauaauuaaugauaauaaguaucuuuauaauggugaauuucaucagguuguuagguaaacacuaauucaucugaguagagagaguaaauuaugaaaaacauuuuaugugugaaaguucuuaaccaucuuuuacuguagaaaauuucaagauacacaaacauuucaaacauacauauuuagguugguaauugagaaaacugcgauuacuuuuccaccagccuauaaaacaagagaggauaguacaguguaucgcaaggacccuucaccccuagcuauagcaauuaucaacucacagacacucuugcuuuaucaauaccucuccacacucccccauaugccuggauuguuuugaggaaaaccccaagcaucaucuguaaauguuucagucuauacagucaugcaucacuuaaugacgggauauguucugagaaaugcaucacuaacgacuucauccuuguaggaacaucauagaguguacuuacacaaaccucaacaguacagccucuuacacaccuaggcuaugugguauagccuauugcuccuaggcuacaaacuugugcagccuguuacuguacugaaaacuguaggcaauuauaauaacauggugacuauuuguguaucuaaacauaguuaaacauuaaaaagauacaguaaaauacaguauaaaagaugaaaaaaugguacaccuggccaggcgugguggcucacaccuguaaucccagcacuuugggaggccuagggggguggaucaccugaggucagcaguucaaaaccagccuggccaacaugaaaccccgucuauuuuguacuaauuuuguacuaaaaguacaaaaauuagccaguugugaugacgggcgcuuguaaucccaguuacucaggaggcuaaggcaggagaauagcuugaaccugggaggcagagguugcagugagccaagaucacgccaauacacuccagcagccugggcgacaagagcaagacucuaucuacaaaaaaaaaaaaaaaaaaaaguacaccuauguagggcacuuaaccaugaauggagcuuggaaggcuggaaguugcucugcaggagugcaggagucagugagugcugagcaaauaugaaggccccagacauuacuguacacuaccuuagaauuuauaaauaccacacacuuaggcuacaccaaauuuauaaaaauauuuuucuuucuuuaauuaugaauuaaccuuagauuauuguaacuuuuuuacucuauaaacuuaaaaaaaucuuuuugauucuuuuguaauaauacugagcuuaaaacacaagccuuuuauagagcuguuuaaaaauauuuuucuuuauguccuuaccuuauucuauaagcuauuuucuguuuuuaaaauuuguuauuuuuuuuuuuuaccuuuuaaacuuuuuuauuaaacacaaugacacaaacacauacauuaccuuaggccuacacagggucaggaucaccaguaucacuguucugcuuccacauccugucuuacuagaaggucuuaugggauuuauuaaaccaggauucaguauaggugauaggucucuuaagugucuuuuaacauaaaauguucccuuccuucuuuuaucuugcaauuuauuuuuuaaagaaaccuggucauuuguuuuauagaauuuacauccacuguagccuugauuaauguguucuccuguccuuuguauuucuuguaaucugacaguuacaucuaaaaauugacaugaugaagguuugauuuuguuuuuucuuugagauggagucuuguucugucacccaggcuggagugcaguggugcgaucuugacucacugcaacccagguucaagcgauuguccugccucagccucccgaguagcugggacuacagggcagcugccaccaugcccugauaauguuuguauuuuuauuagagacaggguuuugccauguuggccaggcuggucucaaacuccugaccucaggugauccacagugcugggauuacaugcgccugccaccacgcccggcuggugaggguuugauauucgguaaaaauuucucaugucaaggccauaugauaucuaaugaucauagacuacaaccauucugucauuagauauuggaaacaugguaauaugcuaauucuaucauuucuucuucauuuauuuucuaaaauacuucucuagagggaaacucucacuaaugaccugaguauccugaggaaaaguuuguucaggaaagucuugacucuuucccuuuauucauuaagagccuauggauuuucauguacuugauguguuacaauucauccauguuauucuucuucuuuuuuuuuuuuugagacagaguuuuacuguugucacccaggcuggagugcgauggcgcaaucucagcucacugcaaccuccgccucccagguucaagcgauucuccugccucagccucccgaaguagcugggauuacaggggccugccacaacacccagcuaauuuuuuuuguauuuuuuaguagagaugggguuucaucauguuggccaggcuggucucaaacuccugaucucaggugauccacccaccucggccucccaaagugcugggauuacaggcaugagccacugcgccugggcaauguuauuauucuuacagaaguucagacugccccaucuuugagcagugggagcuucuucaguuuaaucccuaagucccuugaacaaaagcccaaaguuaaaggugcuuaauaacuccuuggccuucugguauaaaauguuucagucucaucuuuuacauuuucccccacaaacuuagaauccauuauuucuccaaggaguccugauuccuugcaguagaaaugagaaguagagaccacaaccugggcaggaaaggugcacaucacaucaaaaugggcauucguucucggccuuuucagcggacagaauuagaaauuauguauuuuuaaagcauuuaaauuaauaaacugcaauaauuuaggguuauaugguuuuacuuaauuucuuugauuuuaugucuauaucucugaguuuuaauuuuauuuuaugcugaauaucaugauauuuaaagacauaaacuuauuugauugaaauuaauauguauauacacauuaauuagauucagaauaacaguaccaauauuaucacuaacaaaugaauagagaaaguagcuuaagauuauuuaugcaguuucuuucucaaacuguaucucaucugguacagccaagucacuguauuuugaagucauuugaaauaaucauuuuccaugugguuaagcuacugacuucauacauucuuaaguucauuuguuuaauuugcuuuuuauuuuguaggaaugacuuuuauuuucauuuaauuuuguuuuauaguuuaaaauaucuacagguaccagagucaaaucuggaaaacagacccauuucacccuggggaaacuggcuccucccuaccuucugucuaggccccucccucucuuucuauguaagcuuuauuuauuuugugcuguauccuucuuuuuuuuaauguaaagaaauauuuauauguauccauguuauuuuaaaaauaaauuucaacacacuguguguacucuucuccaccucacuucuuucacuuaaaaaugagguggagaaaaguauauauaguauauaaaauauacacuguaaaauauguaguauuuccaucuagaaaaucacuccauaccaauaugcaguuaugugcugcauagcagcauuuuggucagugacaguggucccauaagauuuuaauacuggccgggugcaggggcucacgccuguaaucccugcacuuuggaaggcugagguggguggaucaucugaggucaggaauuuugagaccagccuggccaacaugaugaaaccccaucucuacuaaaaauagaaaaaauuagcugggugugguggcacgcgccuguaaucccagcuauucgggaagcugaggcaggagaaucacuugaaccugagaggcggagguugcagugagccaagauugcaccacugcacuccagccugggcaacgagagcaaaaccccaucucuaaaaaaaaaaaaaagguuuuaauacugcauuuuuacugcaucuuuucuacauuuagcuauguuuggauacacaaauacuuaccauuguguuacgguuaccuacaguauucagcacaauaacauccucuacagguuuguagccuaggagcaauaggcuauaccguauagccuagguguguaggaggcuauaccaucuagauuaguguggguacacucuaugauguuuccacaacaacaaaaucaccuaaugaagcauuucucagaacacaccccugucauuaaacuaggcauaacuguaaguagauauucaucauuccuuuuaguaucuacauaguacuccauuguggagacgcacuacauuuuucaacuggcccuccacugaugaacauuuauauuguuuccagucuuuugcuauuacaaauaauauuucaauuuguagucuugugcagauguauguuuguuuguauuuuuuccaguauauuugugggauagauuucuuuucuuuuuuuuuuuuuuuuucuaagacagucucacucugucacccaggcugaagugcaauggcacgaucucggcucacugcaaccucugccucccagguucaagcgauucuccugccucagccucccgaguagcugagauuacaggcacgugccaccacacacagcuaauuuuugaauuuuuaguagagacagggcuuugccauguuggccaggcuggucucaaacuccugaccucaggugauccaccugccucacccucccaaagugcugggauuacaggugugagccaccaugccuggccuuugugggauagauuucuagaaauaggauugcugagucaaaggguaaaugcauaugucauuuuauuaaacauugccaaauuccucuccagagcaguuguuauguagguuuuaucaguuuucaaacuuauaaaauuaaggguuaauaaaacugugccagaaauuuaaauuuguucagauuucuaauauaggaauuaauugcuuaaauaaauauacauauguauguauuauuaaacucuuuaccuccaguuuuucugccaaaaaaugcuacagauuaugacagguauguagaguaacaauaugugugcaaaggcuuuaaccagaugcagucacucuucuagguaaacccaacugguucaucuuguagacugucuuuaauauaucugggccagaugcacuggcucaugcuguaucccagcacuuugggaguccaacgcaggaagaucgcuugaccccaggaauuuaaggcuccagugagccaugauugaaccacugcacucuagccugggugacagagugagauauguauaucugaacaagccucucuacuaugauuaaaauaguaugaauugcaauuauuuaccagaaaccugaguaggguaaugucgucaaagcuuuggagccagauaagaccaggguuugaacucugauccugccagucacuaugucaccuucuaaggccguuuccugaugggaaugaaaugggaaugauaaugcccaccucaugggguuacugcucagugaaugacguguuguuagauuaugauacaaagcguuuagcauggugcuuuuuuuuuuauuauuauuguacuuuaaguucugggguacaugugcagaacgugcagguuuguuacauagguauacacgugccauggugguuugcugcacccaucaacccauuaucaacauuagguauuucuccuaauacuaucccuccccuagccccccacccccugacagacccccgugugugauguuccccucccuuuguccauguguucucauuguucaacucccacuuacaagugagaacaugcgguguuugguuuucuguucuuguguuaguuugcugagaaugacgguuuccagcuucaucaaugucccugcaaaggacaugaacucauccuuuuuuauggcugcauaguauuacaugguguauaugugccacauuuucuuuauccagucuaucauugaugggcauuuggguugguuccaagucuuugcuauugugaacagugccacaauaaauauacguguucaugugucuuuauaguagaaugauuuauaauccuuuggguauauaaccaguaaugggauugcugggucaaaugguauuucuaguucuagauccuugaggaaucgccacguugucuuccacaaugguugaacuaauuuacacucccaccaacaauguaaaagcguuauuuccccauguacuguccagcaucuguuguuuccugacuuuuuaaugauugucauuguaacuggcgugagauggaaucucauugugguuuugauuugcauuucucuaauaaccagugaugaugagcuuuuuuucuuauguuuguuggcagcauaaauaucuucuuuugagaaguaucuguucauauccuccgcccacuuuuugaugggguuguuuuuuucuuguaaauuuguuuaaguucuuuguagauucucgauauuagcccuuugucagauggauagauuguagaaauuuucucccauucuguagguugccuguucagucugaugauaguuucuuuugcuuggcagaaacucuuuaguuuaauuagaucccauuugucuauuuuggcuuuuguugccauugcuuuugguguuuuagucaugaagucuuugcccacgccuauguccugaaugguauugccuagguuuuuuucuaggauuuuuaugguuuuaggucuuaccuuuaagucuuuaauccaucuugaguuaauuuuuguauaagguguaaggaagggauccaauuucaguuuucugcauauggcuagccaguuuuccuaacgccauuuauuaaauagagaauccuuucuccauugcuuguuuuugucagguuugucaaaggucagaugguuguagaugugugguguuauuucugaagccucuguucuguuccauuggucuauauaucuguuuugguaccaguaccaugcuguuuuggugacuguagccuuguaguauaguuugaagucagguagcaugaugccuccagcuuuauucuuuuugcuuaggauugucuuggcuauucaggcucuuuuuugguuccauauaaaauuuaaaguaguuuauccaauucugugaagaaagucaaugguagcuucauggggauagcauugaaucuauaaauuacuuugggcaguauggccauuuucaugauacugauucuuccuauccaugagcagggaauauuuucccauuuguuuguguccugucuuauuuccuugagcagugguuuguuguucuccuugaagagguccuucacaucccuuguaaguuggauuccuagguauuuuauucucuuugaagcaauggugaaugggaguucacucaugauuuggcuguuugucuguuauugguguauaagaaugcuugugauuuuugcacauugauuuuguaucuugagacuuugcugaaguugcuuaucagcuuaaggagauuuugagcugagaagaugggguuuucuaaauauacaaucauguaauuugcaaacagagacaauuugacuuccucuuuuccuauuugaauacccuuucuuucuuucucuugccggauuguccuggccagaacuuccaacacuauguugaauaggaguggugagagagcgcauccuugucuuaugccaguuuucaaagggaaugcuuccagcuuuuccccauucaguauuauauuggcuguggguuucucauaaauagcucuuauuauuuugagauacguuccaucaauaucaguuuauugagaauuuuuagcaugaauggauuguugaauuuuguugaaggccuuuucugcauguauugagacaauuaugugguuuuugucaucgguucuguuuaugugaugaauuauguuuauugauuuguguauguugaaccagccuugcaucccagggaugaagcugacuugauugugguggauaagcuuuuugaugugcugcuggauucgguuugccaguauuuuauugaggauuuucgcaucgauguucaucagggauauugcccugaaauuuucuuuuuuuauugugucucugccaggucuugguaucaggaugaugcuggccucacagaaugaguuagagaggagucccucuuuuucuguuguuugaaauuguuucagaaggaaugguaccagcuccucuuuguaccucugguauaauucggcugugaauccaucugggccuggacuuuuuuugguugguaggcuauuaauuacugccucaauuucagaacuugucauuggucuauucagagauucgacuucuuccuaguuuagucuugggaggguuuauguguccaggaauuuauccauuucuucuagauuuucuaguuuauuugcguagagguguuuguaguauucucugauauuaguuuguauuucugugagaucagugaugauauccucuuuaucauuuuuuauugugucuauuugguucuucucucuuuucuucuuuauuaguccggauaggggucuaucuauuugcugacguuuucagaaaaacagcuucuggauucauugacuuuuuugaaggguuuucaugucucuaucuccuucaguucugcucugaucuuaguuauuuauugucuucugcuugcuuuugaauuuuuuugcucuugcuucucuuguucuuuuaauugugauguuaggguguugauuuuggaucuuuccugcuuucucuucugggcauucagugcuauaaauuucucucuacacacugcuuuaaauaugucccagauauucugguacauugugucuuuguucucauugguuucaaauaacuuauuuauuucugccuucauuucauuauuuacccaguagucauucaggagcagguuguucaguuuccauguaguugugugguuuugagugaguuucuuaauccugaguucuaauuugauugcacuguggucugagagacuguuuguuaugauuuccguucuuuugcauuugcugaggaguguuuuaccuccaauuauguggucgauuuuagaauaagcacuuuguggugcugagaagaauguauauucuguucauuugggguggagaguuuuguaggugucuauuaagucuguuugguccagagcugaguucaaguucugaauauccuuguuaauuuucugucucauugaucugucuaauauugacaguggaguguuaaagucucccacuauuauugugugggagucuaagucucuuuguaggucucuaagaacuuucucuaugaaucugggugcuccuguauugggugcauauauauuuaggauaguuacucuucuuguugaauugaucccuuuaccaguauguaauguccuucuuugucucuuuugaucuuuguugguuuaaagucuguuuuaucagaaacuaggaugcaaccccugcuuuuuuuuuuuucuuuccauuugcuugguaaauauuccuccaucccuuuauuuugagccuauguaugucuuugcacgggagaugggucuccugaauacagcacacugauaagucuugacucuauccaauuugccagucugucuuuuaauuggggcauuuagccuguuuacauuuaagguuaauauuguuaugugugaauuugauccugucauuaugauacuagcugauucuuuugccuguuaguugaugcaguuuccucauagugucaauggucuuuacaauuugauauguuuuuggaguggcugguaccgguuguuccuuuccauguuuggugcuuccuucaggagcucucguaaggcagcccugggggugacagugucucucagcauuugccugccuguaaaggauuuuauuucugcuucgcuuaugaagcuuaguuugccuggauaugaaauuccggguugaaaauucuuuucuuuaagaauguugaauauuggccgccacucucuucuggcuugcaggguuucugcagagagauccgcuguuagucugaugggcuucccuuuguggguaaccugaccuuucucucuggcugcccuuaacauuuuuuccuucauuucaaccuuggugaaucugacaauuaugugucuuaggguugcucuucucaagaaguaccuuugugguauucucuguguuuccugaauuugaguguuggccugucuugcuagguuggggaaguucuccuggauaauauccugaagaguguuuuccgacuugguuccauucuccccaucacuuucaaguauaccaaaccaacguagauuuagucuuuucacauaguacuauauuucuuggaggcuuuguuuguuuauuuucauucuuuucucucuuaucuuguuucucacuuuauuucauuaaguugaucuucaaucucugauauccuuucuucugccugauugauucagcuauugauacuuguuuaugcuucaugaaguucucgugcuguguuuuucagcuccaucaggucauuuauguuccucucuaaacugguuauucuaguuagcaauuccucuaaccuuuuuucaagguucuuagcuuccuuucauuggguuagaacaugcuccuuuagcuuggaggaguuuguuauuaccuaccuucugaagccuucuucugucaauucaucaaacucauucuccauccaguuuuuuucccuuccuggcacggaguugugauccuuugaaggagaagaggcauucugguuuuuggaauuuucagccuuuuugcgcuguuuucuccccaucuucauggguuuaucuaccuuuggucuuugaugcuggugaccuucagaugaggucucugaguggauguccuuuuuguugauguugaugcuauuccuuucuguuuguuagucuuccuucuaacagucaggcccaucugcugcaggucugcuggaguuugcuggaggcccacuccagacccuguuugccuagguauucccagcagaggcugcagaacagcaaagauucccuccuguuccuuccucuggaagcuuugucccauaggggcaccugccagaugccagccagagcuauccuguaugaggugucugucggccccuacugggaggugucucccagucaggauacacgggggucugggacccacuucaggaggcaguguagucccuuaucagagcucggacgcugugcugggagaucugcugcugucuucagagccaucaggcagggacauuuaagucugcugaagcugcgcccauagccaccccuucccccaugugcucugucccagggagaugcugccuuuuuuucagagaugcccugcccagagaggaggaaucuagagaggcagucuggccagagcagccuugcugagcuguggugggcuuugcucacuuugaacuuccugguggcuuuguuuacacuguaaggguaaaacugccuacucaagccucagcaaugguggacgccccuccccucaccaagcucgagcauccuaguuugaucucagacugcugugcuggcagcgagaauuucaagccaguggaucuuggcuugcugggcuccgugagcgugggacccgccaagccagaccacucggcucccuggcuucagcccccuuuccaggggaaugaaugguuuugucuugcugguguuccagguaccacugggguaugaaaaaaacacuccugcagcuagcucggugucuccccaaauggccgcccaguuuugugcuugaaacccaggguccugauggccuaggcaccggagggaaucuccuggucugcggguugcaaagaccaugggaaaagcucaguaucugggccagagugcaccauuccucacagcacaguccuucauggcuucccuuggcuaggggagggaaauccccugaccccuugcacuucccugguagggugaugacccaccuugcuucggcucacccuccaugggcugcacccacuguccaaccagucucaaugagaugaacuggguaccucauuuggaaaugcagaaaaaucaccccccuucugcaucgaucucgcugauagcugcagacuggagcugcuccuguucggccaucuugccagcaaaucccauggugccugauuuacacacaacauucaguagagaguagucauuguuauuaguauggccacacugagaaacauuaaauuucauuuaauuaaugacagggauuuuuuauuguuaaugaauuaucaauaauuccuugguaaucuuuugggcuuuaucuauuuacaucccagcaucccaaggaaagauuggucuccuugaagucaguaguuuugucuuauucaucacuguaucuuuagaccuggcuuaaugccaggacuacucaguaaaaugccaauuaacucaguaaacauuagugaaauguauaagucagaaaaauaaacgauguuuuuaggaaguuugaauugaagaaaagaaaagcaacuugagauagaauagguuugagagaaaaauuuuagaaaggagaagcuuugagcauugucauagacugauggagauucagggaagaggcagagauugaaggcagaaaagagaacagagcugaugaggcagagccaacaagggaggggacagggccacuggaggaugggaccaauggcacagguaaagaaagagauuaggucucaagagaucccucuuucccugaaacagaagagcaaagagaaaggugcaaaugcaguuuaacauugaaguuaaggaagaaaaauccagggggcuucuauuggguuaccucuuaccuucugcuaaggggaaggaauuagagcugacugaagggccugaauacaaaaguuuuggaacaacuucagguuacaugaucgaaguuucaauaauaguaggaagugaguagaccaccuagcaucauugagggcccauacaaaccuacugaagcugaucaguuugcuugcuugccuuuuuguauauuuguccauuuauguauuaacuaacauucaaaaauaaauaccagcuguauagauuugcugguguauuuuccuuaacuucucuuggggaaacagcugcuguauagucaguauguguugccgauuuggagucaugucgcacacuaucucugcaaagucucuuuucuguuuaaauauuggugguccgcuaacaccauaagugugguuuacaguuaucggccuuuguuuuuaaguguugucuuuuuccauuaucauuaaccugaauuucgcaugcaugaaaauuaucagcaugauaagguggaacugcuuuauggcaugcauuuaaguaaucuuuaagucuuaucugaaaugaaaugugcuaaaacuacugagguuuuuuuguuuguuuuucccuagaguuggacaaguuauaaccaucaaagcaaaaguuacuagagcauucagcacaagcauggagguaagaggcaccuuuucaaacaucugccuguuggugcucacuucuucauuguuuacaaaggguagagcaggaggccuagacuaauauuuggaguuagugagauucucuauuucagaaggcucuggaauguguagucaggucacagguaaauaauaagcagcagauguuuccacuguuucccagcuaaaauucaacauggccaggcaugguagcucacaccuauaaucccagcacuuugagaggcugagacaggaagaucacuugagaccaggaguuccacaccagccugggcaagauagcaagacccaaucuuuaagaagaaaaaaaaaaauuagccagcacagugguaagugccuguagcccuggguacucaggagacggaggugggcggauugcuugagcccaggaguuugaggcuacaaugagcuuugauuguaccacaacauuccagccugggugacauagcaagacuuugucucuuaagaaacaacaacaacaaaaaaaaccaacacauuuaaacaugauacaguacacuauuucuacauagaaggauauacagaaaguaaaccugcaagagaaaaggacagucuuaauucuuuauaaagcaugguuuuuauuucuuaauuaugcugacucuacuauuauucuaauucuguuuguucuccauccccucaaccucugacagaaacuagucccaugauuaacuaguuuuuuaaaagcaggauaacuggacuuuaguaagaagguaaauuuagaagauuuuuauucugcauccacuugauuuuauuuucucuaccauugugaauacuggauucucaggggcucuugagaucuccauucagguuaaauuagcaggaaaggaguugcuggaucucauauuguaccucccagguugcucaggaucagucccuucaaucucugggcaugaagacauggaagaguuuguauucauuuguuagggcugccguaacaaagcaccacagacuggguggccuaaacacagaaaaguagugucccacgguucugggagcuagaaguccuacaucaaaauaugggcaaggaugguuucucugagggcuggagggauaaucuguucaugcugcucuccuacccucccauggcucucuguagucuuugguauuucuuggcuuccacugcaucacccgaucucugccuucaucuucacguguucuccuugugugggugucugcuuccaaauuuccccuuuuuauaaagauaucggucauauuggauuaggggccugccccaccgcagucuggccucaucuuaacuaauuacaucugcaacagugcuauuuccacauuuacauucuaagguacuggggguuaggacauaagaauuuggaagggggaacacaguucaguuauaacaacuguuuugacaguaaccaugccauuggugguggcuuuacccugauguggucacuuucuuuuuuuuuguuuuugcuuuuguuuuugagacagagccucacucuguugccaggcuggagugcaauggcaagaucucggcucacggcaaccuccgccuccuggguucaagugauucuccugccucagccucccgaguagcugggauuacaggugcaugccaccacuaauuuuuguauuuuuaguagagaugggguuucaccauguuggccaggaugaucucaaucuucugaccucaugaucugcccaccuuggccucccaaagugcuaggaucgaucacaggcgugagcuacugugccuggcugauguguucacuuucuagcaguauccaaauaagcagaauacaaagcacuugaagaaagcagaaaggaaaugucgugaagaaaacaagcucugucagcaaaugguguuucuggagcguuuauucaacuguggggcucuuagccuuugcacacaggagccucugggcuuggccugucuccugagggccacacauucuccugauagacaguccaaauauagauaaaaccuccuuuacauuucuccuuuuccuccucuucccuaagacaggcuagaauuucuaaaggaggcuuaucuaaaagcuaagaaaacaaaaguaaaacccagugaguuugaaaccacagauuucugaugcuggggaaaguaaacccuagccuccacugacuuuccaggccugauccgccgugcagaauuuuguucucuuucaucuucugcaaaucaugaccaggcagccucuaaauuuugucauacuuucuaccaccugguagaaauuucuuggauuuuuuuccuuaaauauagaugccaacuaaacauuuuuauuuuuacuuuuucaaacuggacauguccuuuagcgucuuccuguucaauuucaguuuccugccacaacugaggccagcccucugcuaauuugcugagcagaaauaaaugacugacuucucccugaauccaaagcaagcaggaacucugcucugugccaaaccuacuuccaggggauucucagacucuacugaucagucucuucccucuucccaccucuggaaggugugugaugcauuacuauuaauagaugauauugucucauuugcacuaagagcacauuauaugagugugaguuuuuuuuuuuuuguccuuagaauaugucuuuaagaaucaguuuuauugagauauaauuuacaacauuaaaauucucccauuuuaaguauacauuuugcugagcuuugacaaaguuauacaguuggaucaccaccacuguaauauacaacguucccaucacuacacgaagccccuuuaugccccuuugcaaucagcucucucagaccccagcuugugacaaccacucauuuacuucaggucaguacccuuuuuuuuuucuuuuuugcccuuuacuguauuuuguauaaauggaaugauauaguauauauaauuuuugugucuaauuuauuuuacuuagcauaauauauuugauuucugcuguugguuauuauauuauucucauucuauuuauuuuggguuuaauuugccuuucuuuuucuagugucuuaagguagaaucuugggaaauugauuaaacuuuucuuuuuuucaaauauaagcauuuaagaucguaaaauuuucuucaauauauugcuuuaccugcaucaaaauauguccuuuuuuucuuguaaauucuucccugaccucuagucugucuagauguguguuguuuaauuuccaaaucucugaugauuuuuccagauacaucuuuauguuuuugauuuauaauuuaauuccuuugcagagagagaacauaauuuguauaauuucaauuauuuuaaauuuauuuagacuuuuuuaaugacccaaaauauggacuauuuuggugaauguucuauaugugcuugaaaagaauguguugcuuauagucaaugaaguauucugcagaugucaguuagccuaacuugguucacaguguuguucaagucuucuguauuauuauuauuauuauuuuuugagauggagucuugaacugucucccaggcuguagugcgguggugcgaucuuggcucccugcaagcuccgccucccggguucaagugauucucuugccucagccucucaaauagcugggauuacacaugugcaccaccacgcccagcuaauuuuuguauuuuuaguagagaaaggauuucaccauguuggccaggcuggucuugaacuccugaccucaggugaucuguucaccuuggccucccaaagugcugggauuacaggcaugagccaccgugcccugccaggauucuuaacucuuccugauguugugacccuuuuaucauuaugaaguuugccuuuuuaucucugguuuuuguuuuaaaaucuacuuugucugacauuaauuuagccagacaagcuuucuuugguuuaguguuuuuuuccccaucauuuuucucuuaaccugucuuuuuguacauguaaguggguuucuuauaaacagaauauauuuggaugcuauuuuuuuauuuauucuaacaaucucugccuucuaccuggaguauuuaaacuauuuacauuugauuaucuauaugguagaguugaaaucuaucaucuggcuguuugucuucuauuucuuccaucuguucuuuguuucuuccuguccccaucuuuuccugcauuuuuuagagcagaguaauuuuuaguaauccauuuuaucuccacuguugguguuuuaacuauacauauuuguuuugguuuuaauguuuuucucggguuugcaauaugacuacuuaacuuaucugagacuaccuucgaauaauauaauaucccuuugaguauaguguaauaaccuuauaacaguacacacacuucccuucccaugucccagccuuugugccguuauugucaugccuuuuacaugcacauauguaggagguaaacccuacaauacauaguuauuauuuauguuuuaaacagucaaucaucuuuuaaaaagaauagaaaugaaaagaaguauuuuauauauauacccacauauuugccauuucugguguucuuuauucuuuugcguauuguguaucuccagaugucucccuagugucauuuuccuucugucugaagauauuccuuuagcauuucuuuuucagcuuuuguucguguaaaaauguguuuguuucaucuucauauuuaaaagaugcucauauucaguagguauagaauucuagccuggcagcagacuuauguaaauuaugauauggcuuggguuucuagagcuacuggaucuauggauuuauaguuucuaagaaauguggauuuuuucagcuauuauaucuucaaacuuuuuuccugucuuuugugcucucucuccuuuuggacuuuauagaguuuuagacuucuuguuaguguuccacgggucacugauacuguucguuuuucuucuuucagucuuccuuucucuucaugcuacauucuguguagcuucuuuugucaucuucagcuucacugacuuuuuccccugcauuaacuaaacugcuguuaaucuuaucugguuuguuuuuuauuucagauguuguauuuuuuuaccuuagaaaguccacuuugauuuuuuuauauuuuccguucuuuccucauuauuuucaucuuuuucucuauauuaggagucagcaaacuauggccuauagaccuguuuuuaugaauaaaaauuuuuuguaguacacccauuaauuuauguuuugucuguguuugcuaucacaguacauugacagaguugaguaguggcaauagaguccaugugaccacaaaacuuaaaauauuuacuaucuggccuuauccuuuaagaagauauugcugacuccuuuuccaaaucucugaguucauggugcuuauauuuaauuguuguuuuaguauccuuuguuguuauuccaucauuucuguuaucuguuguuuuauuuauauuaccuuucaccuaauaauuuucuugcaucuaauauuuuuuacucgaugcugaacauugugaauuuuauauuguuuagugcuggcuuuuguuauauuucuuuaaaaagagugucagacuuuuccuggcaggaagauguuguuacuugcagauugguuugagccuuuaaagauacguuuuaaacucuucuauggaagauuuagaauacucuacuuuagggcuacuuuagccccucuucuaaguugggaucuucuguuaugucuaugaagguguuauauauucagugaaaucuggcuggagagaacucaaaagauccccagcugugugugaguucuuggaauuguccauguuacaguuucccaggaauugcuuguuccucagaagcuguucuugucugggguuucacccuguauaugguccaguuaguaucaacccaaagacucacaggcauauuucuggaauucuuucucuuuuuuuuuaguuuccuucucugguacucuaacccacaaauuuuagcuccauucaauucagcagaguuagguuuuucuucucuaaccuaaccguaaauuaccuucagccugagaaccugggaacgcagugcucucguuguuuuucccgccuuggggaucacaguccuguguugccuauuuucguaggugugaaaguagaugcuuccuauauuuuguccaguuuucuaguuguuuucacaggauguaauuccaaucuuaccuaaucucuuauaacacaaugaaauucucccuggcauauguuuuugaaacauuugguaaucacauauaacuaaguuaacucuucuaguagaagacaguguuuagaacuuauuuuaacacuccagaauuguugcuuuguuuuuacuguuagguauuuuauuuuauuuuucauuuguccauuucucuaaaagcagaaagcugugugggauugaggguugagaguugggaauagauaguuuaauuuuggcuaaucaucaucuaguuaauuuaggauuuaccauguaaauacuaauuugcauuuaugaauugagugacuuaaaaugagucauagauuauugauuauucuuuuuacaugguguacacaguaaagauacagauacggauauucuuuaucguugauaacauagugcugagcugugccugagauagcucauuauuuucagaagauaguauuacucaucugaaauauguagggaaaagguuuauuagccagaaucuaaagacaaguaccugaguuuaccaacacuucugcgaagugcaauccugaggaccaagcuucagcgcucuucacacagggggaaaucuagcccauuuuaguaucaacauaaagugucucagcuaccuucuuauuacuccugaaaaauuaaucacagaaacaaagcuguaaauacaugaugcaauucuguccguguuagcuugguuaugaaacucugagacuaugcugccuagagacauuuaaaaaaaggaaaaaaaacucugagaguaaaggcuaaaaaaaguuaugguacaucucucuggugguuuuauaaggcagacaccaauaucuuguuuucaaaagcauauuuaguaaucaugaaauuuaaaagagcuuucauauaaugccaaauuuuuaaaaauuggaacaggccaggugcaguggcucaccccuguaaucccagcacuuugggaggccgaaguggguggaucaugaggucaugagaucgagaccauccuggccaacauggugaaaucuugucuguacuaaaaauacaaaaaauuagcuggguguagugcugcgugccuguagucccagcuacuccggaggcugaggcaagagaauggcuugaacccgggagguggagguugcagugagccaagaucgugccacugcacuccagccuggcaacagagcaagacuccgucucaaaacaaaaaaaaaaaauuagaacauaaaacuguaaauacauuacaauaauuuuauauacacaugcauauauacacacacguauuucaugucauauguauguaauauaaaauguguguauauauuauguaauaugauauuauauauguguauguauuaugugauauguauguguauauauuauauaucauauaugacaucauauauaucauauacacuuauauaucauauaugauauauagaaaaagcuagaagaaaauucaccuaaaauuuaauaauuauuaucucugggugaugggauuacugauaauauauacucuggauagucagauuccauaaauuugacaugguaaauaaauaauuuuuauaaucagaaaaaagcuaauuguccaguguuauagaacaucauugaaauaauucuauugcuuaaaaauaaauuaaaauucugguuucauuuuuaaaaugaaagaagguaauggugcauacauaugacuaaauuuugaaugcugaaaucugaacuggccaagaguguauuuauuuaucuuuuuuucauuuuagaucaguaucaaggucaugguacaggauaugcucacuggcauugagaagcuuguuaguguggcuuucuccacauuuguagccaaaccaguuggaaaagaaaagguaaauuuuguaugugaagauguaucuagcauguaauucagggacauaguaacaauugcaucagaauguuauagaaaaaaaugacacuucuucuuuccaugagauauacuuccccaagauuuguuauucaccaauauuuauugcaaaaguuaucacucugugguaacaucagaggaauaggaacuuuacagaaaaguaccuuagagaaaagacgauauagaaaguuuguaaaauacaaaaaaaaauccacauuguuuuaaaugaucugaaggucauauugguuucuuuaaaauacugccuacugguuuagugcuuuucauuuguggucauauaacucaaaauugacuuaaaauaaaaucuuuuuuuaaaaaagcaagagcaauuuagcaagcaguugcauguuauagauuaaccacuguuaauaccugaaggaaaacugucaacauugcugaguuauugaaguuuaaaaauaagcuucugggcauguggggugaaaacacccuccgaagugauacuuuggccugaugagcuugccuagccggcugccuggacacgauccagauccacucaucuggaggcugcuggagauuugcuccuuacaauuucuuggcuuuuuuuuuucagugucagggugccuggaggagggucccauuuagucuaaacacugugauaauucaaucuggaauaugagucuuucacuccaaggaucaucccagagcuagacacaguggcuucuccuagcucuacucugaagcaaggaggagucauguuggucagguuggucucaagcuccugaccacaggugaucugccugccuugaucucccaaaguucugaggugugagcuauggagccuggccugcacucucagucuaacauuaaacauguugcaaggcaaauucauauugcccaaggguguuauuuuucaaauggaaguucauaucagcuaauucuauuuuuuaaaaugcaguuuucugggccauaucauggaccuacuaaauuagaaucacuaguguggaaucuuggaaucuguacuuugccaaagcaucccacggagccuguguucacuaaaaucugagacacugagauagucuucccaaccauucuguuuuuccuggcauccccacaaaucuccagacucuuggaagugagagaauaggggaugggugcaggugcccguaucugagcgcaagugacaaaggaauacaccuugcaaucccauuccuuugcgaggggcagcagaggaagaccgucauauucccccuccagccucagacuucucccuccaacuucauggacguguggaauaagaauauaauagucggccgagcaugguggcucaugccuguaaucccagcaauuugggaggcugaggcggguggaucaccugaggucaggaguucaagaccagccuggccaacauggagaaacccccucucuacuaaaaauacaaaaauuaacugggcgugguggugcaugccuauaaucccagcuacuugggaagcugagacaggagacucacuugaaccugggaggcagaaguugcggugagccaagauugugccauugcacuccagccugggcaacaagagcaaaacuccgucucaaaaaaaaaaaaaaaaaaagaauauaauagucacacuucaguccaaucucucuugagacuggagaacuggguucugaaaguggaaaaucagauccauuauggugcuaacauaauugguugguucagauaaccuuaauuguaaagcaccuuuccagacuaacuuauuuccuaguugcuaauaugcugguucagcagcucaucacaaagagacccaugaaaaaucagugguuugguuugaacccauaggacuacuugaauuucuguucacagugaguuuauuuuaggaugaaguugguucaaagcauaauguacccugauuaaaaaacaaaaaagaaauuggcaaugauuaaccagacuuaguucaacaauugcacaggccagaucauugaagggacuugcaagacuccacaggguacacucaugcaaagccuuacuaagcuaaagcagauggugcggagggagaaagcaagcacaggccagccucagagaggguggaggucuccaggcacagccaugcugcuggggccuuaguaacacaagauguacuucugcagaacagaaaucaccaaaacauaugcgagguaucuugguuucaggagaaccaacacacaaguuuaccaagcagucuuguauacccugcuagucacacaacuaaaacaacacuacaaaaauuguuaaaucaggcugggugcaguggcucacacuuauaaucugagugcuuugggaggcugagaaggaaggauugcuugaggccagaaguuugagaccagccugggcaacauagugagcccucaucucuacaaaaaauaaauauaaaaaaauuagccaggcauagugacguuugccugcaauccuacugagaggaucccuugagcccaagaguuugagguuacaggaagcuaugauuacaccacugugcuccagccugggcaacagagugagacccuguuucaaaaaaaaaaaaggaguuaaaccagugcaugccaucaaucuacacauuccuaaccaaauuccacaagguaguccagggcaguuuuggacuuuaagcagcauauuauaaaucaccagcuuauuucuuauuucuuuuuuuuuuuuuuuuuuuuuugagauggagucucacucugucucccaggcuggagugcaguggcaugaucuuggcucacugcaaccuccuucuccuggguucaagcgauucuugugccucagccuccuaaguagcugggauuacaggugugcuccaccauacccgguuacuuuuuguauuuuuaguacagacaguguuucaacguguuggccaggugcaguggcucacaccuauaaucuugaacaccugaccucaagugauucacccaccucagccccacaaagugcugggauuauaggugugagccaccacacccagggaucacuagcuuauuucauccuuaucuuggccaaggguccguaccagacuuugaguaucuuggaaacaagcauggagcuaccccaguccagcuucaaggugacccuuccuucuacacacagggucagcaaagggcauuuauguaagaauuugagcucuugguucuguugccucauauuuccagguuucuggaaguuggugaaagcuuuauuccuacauauugauucuuuuguuuugcuuauuagauaauguuuucaccauguaaugaaauuuccaaauugguaucaugguauaagauaacuuucucuagaacaucuuuauucccucucuuugcuuucuuaauuuugcaaaauuuauucccucucuuugcuuucuuaauuuugcaaagauaggaaauguuuagauuucaguggagucaaaguccaucuccucauucaucaauaugaauaauuucuuauuuuguaguucuguugaaaaauuuuaaaaucagggaaaauaauagagagaauuuuuaaagcacauaucuuauugcaugaagaaauaauuacgccuauguugauuuuuuuaguuuaaaaauaauuuaagaaaaaauuuagucauaacauguuuagugaaaacacucauaaaagcucuauuuacuugaguuagaaaaccauguagcauaucauuuguuuugcaaaauucaugcugugcuuuuauaauuuaacaaggcaauaaaagauaaaugcuuuucuuucucuagauucauuuaaaaccagucacacuucuaacugaacaagaucauguggaacauaaucuggcugcugagagaaggaaaguucgauuacaacaugaagauaccuuuaacaauuuaaugaaggaaaguagcaaauuugauggucaguaaauccacuuauaagaauuuuaauucuauaacugugacaggcaaaggagucuuuucuuagagcacacuuauuuucaccuuauuauuaccauucaguccuggugacacuagguauccuuuccaacaaacccgguggcuggagaagaaaccuggccauugagaauguaacugcugacaccuaaggccucuuuaaauuggaagaucuccaggaaaggagauggggaaaaagggugacagggaccaggcagucauuaguaagcauguauucacuaaugauggcugaaugaaggguugaugacaaugccauacauugacacggugcuucguggcuuacuaagcaguuucucguccacgguuucauaggagcugcauguaaucucaacagagcagaaagcugcaacucugaguaggaaagaaauuugcuaaagaucauaugggguaugagcagagacuuaagauccugcuccuguugccuggugcuuuccacaaucacccugcguuuuaugagccacacuuccuuaguucucuggcagugauuuccugggcucuuugaugccuccuggagccagacugguagggaaaggcagagccccgcccuugccccuccucugcccuuucuuuuugucugacccuaucuucugaagccccaaggggugccgguggagagcacaaugagggaggggaggaagugaagugagcccgcccaggccccacaagcucaccacugccaagagggcagaagguucagcaacccuuggcuccaaaggaaggcaccggaagaagaggaaggaaaggagaggacaagaacaugucagaacaaggaugucaaaagagaaggagaaagagugcauggaaaggccagaggaaagggagagguagcagccaguauggcagaagugcaaagccuuuauucugccccaggggauauccugggaccaccccacagaagacuuacggguugaaaaagagauuuuucaaagguuucuacucauugcugaccuuucaaagggcaauacccauuaccaacuugauuuuuuuuuuuuucuuugagacagaguuucgcucuuguugcccaggcuggagugcaauggugcaaacucggcucacugcaaccuaugccucccagguucaagcaauucuccugccucagccuccgaaguagcugggauuauaggcgcgugccaccacgcccagcuaauuuuguauuuuuaguagagaugggguuucaccauguuggccaggcuggucucgaacucccaaccucaggugauccgccugccucggccucccaaagugcugggauuacaggcaugagccacugugcccagcccagaccaaguuauuuuuaaggaaaugaagacuucaucauuaaaugacgguguuaagaagagcaagucuccguuuauaaagcuggucucagcaccaaaauacauuucaaaugcauguugcucaaguaaugaaauagcugaaccaagagaaccaagagaagcugcugaggcacccugaggcaggugagacaaccauuaauaaaaaacaaaacccugcugucuccucaucccuuaaaucccaaggaagaaaugaaaugacagauaaaauacuuacuaaugagcaaacccguucuaugcaugacaaguaaaucucuuaggacaucuuaggaaacucaagcauuuaacacaguuuuuaauaggcauaugcauuuccccuaguuucauuggucuuccuuucugcaguuaugucuuuuaaaaaagcuuucuguccucaaugaaauuacacuaccugaguucauaaggagaaaguagaaauaagccacuaaacaaccagaauucugauugacaaugucaaaauacaguuguuuuucuucuucuucuuuuuuuuuuuuuuuuuuuuuuugugagauggggucucacucugucacccaggcuggagugcaguggcgcaaucucagcucacugcaaccucugccucccagguucaagcaauucuccugccucagccuccagaguagcugggacuacaggcaugcgccaccacgcccagcuaauuuuuguguuuuuaggggagacgagguuucaccacauuggccaggcuggucuugaacuccugaccucaggugauccgcccaccuuggccucccaaagugcugggguuacaggugugagucaccgcgcccagcaaggaacaguucuuuugaaaucugugcauguuuauccagagauucuuacaagaacugcuuucauccucuccaagucaucccucgucugaaucacaucucaaggucauucuccacccuuuugcccggaacucucuagaucaagcugcugcccaccaggaagagggugacccugugaugcgugaggugcuggccaguuugccccggugcaugcuagauggagugugugugugugauuguggauaaaaucauugauagucauauagguggaaggacuccuucccucucagcagcaaggaaagacuuccacacugacugguaguuccuuccaacaguucuguaugaaacgccugucaugugccaggaaccugcuugccacuagagguauaaagaugaauaaugcagggucuuugcucuuaagaaacuuguaguuuagugcuggagacagacauauuaauaguuucuaaauaauauaguaagugaauagagagcuguagacucuaaguaaugugggagcccagaggaagggcccuucaggguucacgagagacucgcugcaggaggggcuaugagaagaaaguugggaaggcgaggaauugcguagcagugagggugaaggcacggaggcaugaaccagcacacugugugcugggaagccaccaacacaagaguauugcuagagagaaaaugcaagguagagggaggcgggagaggaagaagguaggauugugucauggaggcucccugggccaugucgagaggcuuggccuuucuucuguucuugaugggagccauugaaggauuuugagcaggguuggggcaugacuggguuugcacuuaauauggucacucuggcuagagggagagagaccaggcgaaaggcgaggggugccuaaaccaggcagugauaguggggagagacaggagggaaagaguuuaaaaauacacacgagaucacaccaacaaaauagggucaccgauuggcuguggggagaagggcgaggaagaaggagcauaggcugacuccugggugucugcuuggagcagcugguuagcaguugugccaugaacugagaucauggaucugaggggcagggaacggcaauuuuugggagguagaugaugaguucaguuuuaggcauauggagucugaagugccuguggacauccaaaaggaagagaccacagcuggggagauuucaucugagagacaacugcuuagagaaguaguucaaaugaagacaaccugcagcccacagggugcugggccaagaacagaaccugcaaagcacaggcaucuaagagaggauccagaaagacaaaccuacuaaggagaccuggagggacuaaucagaggggugcagggagagcuggagagagcagugucacacgccaaggcagcagaguuacaagaagaaauaguaaguggucaacugcgucccaggaagugaggaauaaaaccugucuacuggacugggaaucaggaaggcauuggugacaucggcaagugugggguuagaagaagugugggagacacuuggaugaccuuaauuacuuagaggaauaaugggaugagggacaguuuaccauaaccuuuaugucauauacacaggccaaaguaaacacuccuaucaccaggcuuguuugaagcacauguacaaggaugcgggggguggggagggaaguagagcugcgagccucauggccccaacagcccgagugucaucuguugcaggacauguggacggugagggacacaguggccauugcagcucuuagagcagcuuggcuaguucagagccuuugcuuuuguggaaaacuaaggcauuguuucccacagcagcacuagcauuuagcaggaacucacuucucucaagguauuuuccuucacuccagccauccaagguggaacuugcuccucucuggccucuggacccagccccacaggaagcaggaggcauccaucggcccacucaacccaaaccauccacccuggagagagcuaccuccucccaccggacuuacuccuaaaggcgaauugcuaggagcuggcccuaugcauuggcucaucuuuuucucauagucagugguugccccagcacaaagcugcucuuuuuauuuucuuauccaacgcuuuuuuuauccaggucuguaaccaaguccucugacuuggcagaaccauccuucugcucucuaucuuugugaguucaauuguuuugauuuuuagauuccacaaauaggugagaacaugugauauuugucuuucugugcccuacuucuuuugcuugacauaaugaccucaguuccauccauguuguugcaaaugacaggauguccuucuguguuaugcugaauaguacuguaacaggucuauaaccaaaaccucugacuuugcuuuucucagcuugccgaagcaagguaaauaauaaacaaaacgagaacuguaaaaugggaauaauaaagguacuuacauaauggguuuaugggagcauuaaaugaguuaauauagaaagugucaggcaugcagaaagugcugucauuucuauuauuguuugagagguccccuccacaggaggaauuagagccaagaguuaaagacagaugcuucucaggaacuaugcuguaaaggaugaaagaaauagccuggagcuacaggcgacccucaaagucaaggggcauuguuuuucaggcuaggagaaauuuggucaugguuccaggcugaucaagaugauugaugaggccuggcgguggcuuaugccuauaaucucagcacuuugggaggcugaggcaggcggaucacuugagaucaggaguucgagaccauggugaaacccugucucuacuaaaaauacaaaaauuagccaggcgugguggugcacuacuguaaucccagcuacucaggaggcugaggcaagagaauugcuugaacccaagaggcggaguuuacagugaaccaagauugcaccacugcaguccagccuaggccacagagccagauucugacucaaaaauaaaaaaaaaaagacauaauugauaaaaauaauuauugaggaagaaguuaauuauaaaagaaagagauaauucgugucaaaucuguacuuuagacacugggaaauuguugucauguuuuuaucuuggaggaauggggaucucugcuacccugagcucccuugcgaggguucgucuauugggaaggguugcuaggauggugacugaagcugucuucacaccccccucaagguaacaagagccagguaaacauggguggcugcaccggcuucuucugguguugugcaaguugcacuaauaagugaaaucagcagcagacaauuugucugcacaacacuaacaguacuuugaauacuggagauagucuaaauuagugacaggcacacaugacagucauucaaauauagagauaaaacgauugcaauugacuugaguuucaguguguuacaaaguuggccagauuagaucuacaucuacaugucuaguucaaaguucaauuucaaauuauagauuuuucucaaagucuucuuuuaucaucugcuuuguuuaaucugcccuaacuuauucuacauccuuucacauaaaacaacuuuuaaccuaauuccacugaucugauuuuguuuuuggaaauuuuacuaacuuccaugccagcaaaggugccagagaacuuaaaagcaauucaucuuaaagaaugcaagagccagacucugacauuuaaagccgcuguguaguaugugauuucuccaccugcugcuccuuagaucagauggaguugguuuuugauaggacauuguguguucuaaaagaagagaaccaacccaucucuguucuuguaccauguuuuuagaaaaccagggguuuguguugguuauaaauaucaaacauaaaagauuggaauauuuuucaagauguuguaugauggaaaugcauauuauuagaacagugagaacauugaauccagaucauauccuuucggaagaaaagaaaagagaugagauuaguuuuguaaaagcaggauauuucuggaauguguauaagcacgcacaucucagaaauacuacuggaucauuauuugcaagcuugacauauaggggaaaaacuuaaaauuugaaagcauuuuaauuuaauuuuugaguaagaaaaucagaucuuaagagcauuaucaugguuaauuuucuggauaugcagaaagaaaacuagggcuagcaugaccucaauucaggucaaaguuccugaucuacaaauguagagugaauguaaaguugucaaagcagguugaugacacaguacuuuaagaacauccaaaguacacguauugaacuugaucacucaaagccagcagaaagggugaguucuguuuacuuaacccaaaccagaacugcgagccugaauugcucucugaaccugggaaaacccuauuuuuuucguugguuguaaauuaacuccaaauaagcaaacuucugcaccaaagucaucuaacucaauauauuucugcauacguaucauagcugaugcuggugcacguauaaucucaccuagcaccucccucuacagguuccaguauauacuguauaugucuucauaggaaguaugugguuucucuuuaaaguuaucccucagaaaagaaggagcugcuuuauauuugagucuuuacaaugucucucauaaggccuucucuuaauuuuuuauuuauaauuaucuaaaaacuauuuuuaaagagauaguacaugcacaggguaaaaaaugcaaaacgcauaaaaaggcauauaguuaaaaaguaagucugccuaccgucucacuucccaccuucagagaccgucacuaucacacacacuucaauuucuguggguacacaguagguguauauauuuaugggauacaugaaauacugugauacaagcauacaaaugugcaauaaucacaucauguaaaaugggguauccacuccuucaagugugacaaacaauccaaugauacucguuauuuuuaaauauauaauuaaauuauuauugacuguagucacccuguugugcugucaaacacuaggucuuauucauucuuucuaacuauauuuuuguacccauuaaccauccccacccucccacuacccuucccagccucucauaagcaugcuucugcuaucuccaugaguucaauuguuuugauuuuuagcucccacaaauaagugaaaacaugcaauguuugucguuugucuuucugugccuuauuucacuuauaaugaucuccaguuccauccauguuguugcggaugacaggaucucauucuuuuuuauggcugaauaguauucuguuguguauauguaucauauuuucuuuauucauucaucuguugauagacacuuagguugcuuccaaauuuuagcuauugugaacagggcugcaacaaacaugggaaugcauauaucucuucaguauccugauuuccuuucuuuuggguguauacccagcaaugggauugcuggaucugaugauaguucuguuuuuagucuuuugaggaaccuccaaacuguucuucauagggguuguacuaauuuacauucccaccaacaguguaugaagguucccuuuucuccacauccuuaccagcacugguuauugccugucuuugggauaaaaggcauuuuaacugaggugagaugauaccucauuguaguuuugauuugcauuucucugaugaucagugaugucgauaccuuuuuauaugccuguuugccauuugcaugucuucuuuugagaaaugucuauucaaaucuuuggcccauuuuuuaaucagauuauuagauuuuuuuccuauagugcuguuuaagcuccuuauauauucugguuauuaaucgcuuaucagauggauagcuuucaaauauuuucucccauucuguggguugucucuucacuuuguugauuguuuucuuugcugugcagaugcuuuuuaacuugaugugauuccguuuguugauuuuugcuuugguuaccugugcuugugggguacugcucaauaaauuuuuguccagaccaauguccuggagaguuucccugauguuuuccuauaaugguuuuauaguuugaggucuuagauuuaagccuuucauccauuuugauuugauuuuuguguaugguaagagauaguggucuaguuucauucuucugcauaugaguauccaguuuucccagcaccauuuauugaagagauuguccuuuccccaauguauguucuuggcaccuuugucaaauaugaguucacugugggugugugaaucuguuucuggguucccaguucuguuccauuggucuaugugucuguuuuuaugccagugccuggcuguuuugcuuacuacaacucuguagcauaauuugaagucagauaauuguauuaauuuauuuuaaacaaaaaaugugccauuugaguaaguaacauuagccugaaaacaaccucaauaaauacuaguuugggauauguauaaaacaucuucaaauaaaaucaauuuuagaaagagagagaaauugaaagggauuaagauuguguauuucuuucaaagaucacuuuagaaagugauuccauuuugauucuagcaauauaguggauucauuguuggguaaaaccaaaaauuucuggaaaaauauuuacaaacaucuuugcaaacacaucucagcaggcagaaaaauaagagaaaacuuugaaguccagaaauggugagaaaacacaaaugccgcagugcaaggaagcaugggggcuggcauuuguccuggaggacccagcaggugggccugcuugggcucaggagacaaaaccaggcguccaugugagggagaagguuggaucagggaaccuuccuuggugcuggaaccuccaaaaggugauucccucagugagucaaccagaaaaauuccacccuccagagagccuuagccuuagguggaaugggaaaaaaaauucucucccuuucagaauucaaucacaagugcauccucaugaagauuuggauccucagaagucacaugaccugucugggcuaaaacagaacaaguaaacuuuaguguaaaguggugcuguguuguaggaccccaggggaucugcagcugcaaaugcagcuccuuugugaagaaaugacuuuaaagccagcucccaagaauuuccacagaaaaagauccaagcaauaugagauccuagugaaaaaucauaaaagauagaaauaaagcaaggcuucaagaucuggaagugacaccaggccccacaaagucugaacgaggcccacaaagacagcagauaaugaauuuaucaaguaagaugaagaggcuuaauauguuuuaagaaauaaaagaguaucaagaguauaaugcaagaacaacaacaacaaaaaagauaaccuagaagguuuaacaaagaaacaaagacgauuucuauaaaaaagaauauauaauaauuaaaauuugaaacucagugaaugaaugaaacagcagauaagacaaggaacuggaagauagaucugaaagaguuaacuagaaugcagccagauagacaaagagauggggaacauguaagggagguuaggaaacaugaagaauggagagaaaugucuaacaugcaaaaaaauucuccggaaaugagacaagcaauauuugaagcaaaugauauaaagagacauuucaugaagaggugacaagaauacuuaauauacauguaaaaagauguuggaacucauuaguaaucaggaaaaugcaaauuauaaccaacgugagauacucuuccacacccaccaaacuggaaauaguugagugucugauacuucuaagcaaaaauggggaccaguggggacucucaucaacagcagacagaagugucaguacaacuauuuuauuaccuaaaaauauucuguugagaguaaggacuaugaauguuaaggaaaucagcuaaguuaaguuuauucauucauuucauuuaauaaauauuuauugagcaccuauguucaggaauuauaugagaauuuuaaaaauccauagucccugcaccaaaaagcuuaggaucuagugggucacauaauaaaagggcacacaaauaacauaaaacuauagccaugaaagaaagauccuucaagagacccugaagguggggcugagcuguggaggucagagaaggcuccacugaggaaguaaugaccaagggggggccacagaguaugagugaaauugaagacacaggugaugguggccagggggauugccguagacagcagggaugugacaaaugcccuguuguugaagguaauacuuccucagaggaagugaaaaaagaccagcguggcuggagcaaagggagagggagagugaggccagaccaggaaugcagggcuugcaggccaugggaaggauuugggguuuuauacgagaacaauggguagcuacugacuuguuuuaagcuggggacugaaacgaucacuggaaauaagaaaaaauaaaagagaucaucaauuaauuauaaaucuaaaaauuacauuaggaaguggaauuaaggguuucugugacuacccuucuggaucaccagaugugacuaugccgagagcagcaacaguugcugggcauaucuucccucucacacugcaagcucagcucugccucugacaguacagccacgauggugucccaguuuguaaauccuuucccccuccuucccaacaauagcaugugagauggaaaccuagccggugguucacuucgugaugcaaaaagcauaauugaauacauuuuacugcuuugcagccagaguaaaugauuuuuccauuguuaagaguaaaaaccaauuuguuaguaaacggagcagauaugauucaaaagaagcagaaagcuaggcgcgguggcucacgccuguauucccagcacuuugggaggccgaggcgggcagaucaccugaggucaggaguucaagaccagccuggccaacauggugaaaaccaucucuacugaaaauacaaaaauuagccaggcgugguggcacgcaccuguaagcccagcuacucgggaggccgaggcaggagaauugcuugaaccugggaggcugagguugcagugagcugagaucgcaccacugcacuccagccuggaugacagagugagacugucuaaaaaaaaagagagagcagaaggacaugaagaaguauaacagauugugucuuuccugcuugugacugcaaucauuacaaacaguuuccgcaggaggccacauuuccauucugaagguaguguuucaagcuuccuggugucucugguccuuuguagcucagauuccuuuaucuuuaacaacuuuauugugguguaauugacaaacaaugaauggcccauauuuaaagcauauaauuugauaaguuuugaaguaaguuuacaccugugaaaacaucaccacaaucaagauaaugacauauccaucacccccaacauuucugccccuuccuguccugaucugucccuaccccaccacaaacaacucaaguuucaguguaaccauucuuuuagucaaaauuccaauagacuuauuuuauaggcuagaauacaaucucuaaaaggcccuuucugauuaucuuaacccaauucauugcaaauauucaccauuaagauaagagucacucuguagaaccugucaauuuucucagucuuaaggcuuugagaacacuuuaauuuuucuauaaauccgaguugaauguacugccgggaaggaaaagcuggagccccagggccuaugguucacuccaccaucauuaauguuuacauccaccuuucagaucucauuuuugaugaagaggaaggagcgguuuccacaaggggcaccuccguucagagcauugaacugguccucccaccccaugcaaaccaucacggaaauacauuugguggccagauuauggcguggauggagacaguggcuacuauuucugcaagguucuugguuuugaccuucggccuaugauuuugggaccagugaggagaaaguagaaagggacugagauccaguucuugggauagucaagaagucaaggaaaggacugaggaaaauguugccuuuuauaaugauuucuaaaucauuuacuuucuuacuuuaggauuaaucuguccuuuuguuugaaggugaauguuuaaauauuuugguucaaaaauaaaaaugagaugacaguuuuaauacuuuauucugaauuaugaauauugaucuuaugaaacugcaacucauugucuugauagcuuaugacaaaguaaaugcagaacagaaauagaagacaggcuucacacuuaaaaauaaucagucuagguugggcaggguggcucacaccuauaaucccagcacucugggaggccgagacaggaagauugcuugaugccaggaguucaagaccagcuugggaaacauagcaagacccugacucuacaaaaaaaauuugcugguguaguggugugcaccuauaguccuggcuaguugggaggcggaggugggacgaucacuugagcccagggauucaaagcuacagugagcuaugaucacaccacugcacuccagccucucuauaaauaaguaaguaaauaaauaaagucaguuaguuacaaaccuuuuuaaagacaauuuacaguuaggucugaccuuuaaaggugcugguuaaaaauaauuauggccaaagaaauaauugaaaaauaggaaaagaaagaagagaauauuuagaauacuuuuaaagacuccucaauuucaaaaagguuauuuuauucuuaauggaaagauguagguaauugagcaguuuuagggaacacucuguacccuguaaaugcauuugaauaggaucugcccuucugacaauuuucauaaccauugaaaauuuuuaagguuguauuucccucaaauuaaaauaauuuuauuauuaauaugucuauaguuaugacuauaguuacaaaccaguaguuauccuuucuaaaaauuaugcacaaauaagagagcuuguuuuuaaaaugagauugucauucuuagugacaguaaagcaauugaacauguucuauuguaaaggcuuauggcagcaucuguucgcuugguguuggcacagaguaauugaaugaugacugggaaucuaaaauguagaaaauuauggaaguaacuuucugaaauuaaauauuauauauaauuauuucaaagugucauacacacaaaaauuauaaaauguguaucuccuagccuuucaggcuuuauguagcaauccagguaauuuuucugugaggggaaaaaacuuaucuuuugaucugugggugaauuugauuaacuguaaagcugaggaauuguguaaggacaccugccuucacuuggaccccacuccaaccuggaucagaacuucuugggacuacagucaugagcuaucaggaugacuguaauucagauuagaacaaaaagcauugguuuguuguuccaagggacuuccacaggaaacgagacaagaguaggacuguuaccaaaggaguagaagcaucaacaucuggguaaagaccccacugcucggggacaugguauuucccaaaauauuggcagguagcgugcagaccuacccucaacccacauaauccaguuauuuauuucagucaaauuuaaagaaaugcuuauuugaagacuugucugugcauuuguucgaugaaugaaugugugaucgcuuucuucucucucccucccuuugucuccccagccgccuguguugggcucaucccuuucugaaguccguagauauguuuaaguuccggggaccaucuacaguuggagaucgucuugucuucacugccauugucaacaauacauuucagaccugguaaagugagcccuuaggcugcuaugaagaaauuuaaacuugcacaaauguaauuuuuaauuucagccuggaggugaguaugggaacuacuuuagugaaauuccauuuuuuucaugcaauuuucaaaauccaugaacauauuuuuaacccuuuguucugcuuggggccuuuucacaauuaguaaauugugaaggacugguuuuugucuuauaaggguagccguaugucccaauuggcccaaguaggaccugguuuguaccugucaucccugcauaauuauuaacuuuuccuuucagucccagugacuagauggucaaucaacucauaauggaccugguauuaccaccaugaaauccaaaccacuucccaguuauuuuuauuauucuugauacacaaugaaaagauuugauuuaguauuauuuucuuuuuaaauguaaaaaugaauaucuguguuuccugucuaauuucaguguuuauuuuuuaauuacagaauuauuguuuuuagggaagaaaacuuaacuuuggcauaauuuaagcccucccccacauugccaaaauauguucuugaauguauauaaagcccuuccuggccuuuuucccacuugaaaguggggaaguaaaauggaaaugcucuuaggggcuuguaaaaagcagcccauugaccugaaaauggauuuuaauaguugcacagguuugcugauaacaaacaagaaaacccaggcccuuauccuccuguugcuuagaggagguggcagcggugggcgaggagguggcagcggugugcaaggagggccugaugggucaagauccucuuugcccaccgcccugcaucacccuucacaguguugaaguuggaguucgcguggaggccuuugacugucaggaaugggccgagggccgagggcgucacaucaacagugcuuuucucauuuacaaugcugcugaugauaaggaaaaucucaucacguuucccagaauccaacccauuucaaaggucaguuauuaucacacgagguucaauagccggaccugugaauagagagcucuaccuagaaucuccucccaccggcaacaaccucuuuggcucuuucccuuugguuuucccucuuuucagcaucacaaagugaagugggcuuuuuucuuuuccuuuuccccccgaucacucugaucauuuguucaaaugauggaagcccugaagaccucaccucuaccgggcuacacacugcuguggguaggaugucaccuucuauguccuguuucugggucucuucucucacuuccuuaacucuagcucuugaugcugugccacgugccagguucauggaaaccauaucuuucccucaucccuaaauuaccugauugccaauguuaauuuuuucuaaaaacucuguagugagaauuaaguauaauucugguaacaggaauguuaauaaucuccacuuuugagaaaaggaagaaaauagcugcaaagauugcaccuuugucagugcaacugcccuuuguggauucagcacagagacucugacuugaugaagucaguucauggagagacaccacaucucaguuagcccuuuugacugauuuaggagaaggauacuuaaggauuauagcacuaagauaguagauauuuuauuuuauuuuauugauuuuacuuuguuuuugauuaaaggaugauuucagacgcuaucggggagcuauugcacgcaagcgaauucgccuaggcagguaaggaacauaagguguaaugauuuuauggagucuucguuaaucugacaaauuauauaagagccccccucugggucucuauucccacguaacggaaaaagagaaggucugauguuuccuggccgcaaaggcugacuacugacuuauggaaauaguucuuccacguuguuccacugauauccauggcugauagaaguucaagaaaguauuaugguuauuguugugugcuaaaugcagagaaaaaaacugucauuuaacacuuuaauuuuuuuuuccagaaaauauguuauuucccacaaagaagagguuccacuuugcauacacugggauaucagcaagcaggugauguuuugugauuuggagcucuucauauaaaagucucaucauuacaaaaauggaaauccgcuugccuaacuggccuaggcugugccuacgcaggcuaugugaaaagguggauuauaucagccagucaugucaagaugaaacaaaaccaggcuaucaguuacugcuuaccaaucggcaguuuagccuuguuugacuucuuacaguucccaaacugcagacucaggaugcucugccaucagauauguuccagaagcauggcacagugccaccugguaucucaccgugacuugugcccaccagcuugcauuuuuauaaaaacaauaacaaaguaguagucauuugaauauuuuuaaccauuaaauguaaagagaaauccaaguuuacuuauuacacauugauuaucagucauacugaaagguagucugucuuugcucaggacaccaacuaaaaugauacuaaaaugauacgcaguuguuaaguauacaguuacuuugucugaauucugaauuaaggguucaagauaaaaaguauauguuaccuguagcuuaguucuuuuuacuuuuguuuguuuuuuuuucguuuuugcuuuuguuuuuguuuuuguuggguuuuuuuuugguauuuuuuugagacagagucucacucugucgcccaggcuggagugcaguggcgcaaucuuggcucacugcaaccuccgccucccgguggcggguucaagcgauucuucugccucagccuccaaguagcugggauuacaaguuugcacuacaacacccggcuaauuuuuguauuuuucguagaaaugggguuucaccauguuggccaggcuggucucaagcuccuauccucaagugaucugccugccuuggccucccaaagugcugggacuacaggcaugagccacuucaccuggccuguaguuuaguucuaaacucaacauuaucacuaggacucaacacauaccuccuccaacagugcccauuuuuuaagcagaaaauauaugaucacacauccauguauugaacacauagcuuuaaaaauauaauauuucuauucuaggcaucccugagugacagcaauguggaggcccucaaaaaacuggcagccaaaagggguugggagguuaccagcacuguggaaaagguaggacacuuccagguauuugcauaauccaucgcccaucacaaacgaaagcuguggugguggugguucuacugcuucuacugaggcuuuuaagaagguaacaaaaucuuuugaggaaacuguuucuaagacgcaaccaucuuuucagcccugucucuacaagcugguugauuuggaguccuucaaauauacccaacaugcuccuaccucugagcuuagguucucacaucccgucucucccuccuucucuucuccaucuacccaaaucccaccugaucuagaucaggacagaugcuucuccauaaagccucaacugccacacuugacuuaaggacuucuuuuucuaguaacugucaugacuucuuuaaaauuaauuuuuuuggucgagugugcuggcucacgucuguaauccuaguacuuugggaggccaaggcaggaggaucccuugaggccaggaguuugauaccagcccaggcaaaacaaugagaccccaucucuacaaaaaauuuaaaaauuagccggcugugguagcagacacuuguagucuuagcuacccaggagguugaggugggaggaucacuugagcccaggcauuucagccuccagugagcuaugauugcaucauugcauuccagucugggcaauagagcaagacucugucucuaaaaaaaauaaauaaauaaauaauuggucaauuaauuauacacuaucuugugacauuucuuccacagcuaccucaaauuaauauuuaagccuuacauggaaauuuaacuuuuuacacauggucuucuuucccuaaguacauuauaaaccucuuaagaaagaggccuugucuggacuucuuuguaucucucuuaggaccuauuacaguguuuugcaugccaucagguuuaaagagacauacaucauuuggaucauaauuuuaucuauuuucagagguuuuuuaggagacccucggaagcucaugcccacaauaacuagacuguaagcucccugagggccgaucugcucaccacuacacccagaccauaggagcgccuggcacuucagagaugcucacuaaugccagcacuuuggcuacauucauauuucaguaugcacugauuuucaucaucagugaagcagcagccuaugaaauaggaugaccauauguccugauuuuccugggacagcucuggcuuacaccuguugucccaucauaauuauuaacagucucuugguguuccaguuuggaugauaaauuauauuguuacuuuaccuuuaaaucuaaguaaauucagaugcuacuucauugauucguuucaacucugacuuugacuucuucugaauguuuuguuuuugguuguuuccuuuuaugaguucucuguccucauuauuaaauccuuuagaagucuuccuuaucccauuuggauccaguuaaauuucugucuuugccugguucagugaugcagaaacacagguuuaacuaaugcauuuguuuaucuuucauaaaagaugcuucacuacuuuguuuucuuuuacuauuauaaaacuuacuucuuucaucauugcuggcaucugagcauucaugagcagcaguggaaagaacaaauucaugucuggaaugaacugaaagaacauauuuagugaagucguagaauauauuaaaacugcaguucuuugggaggguguggcccaaagcauacccaaauaaauuugcuaguguugugggagagcuaucaaugauuaauucuucauucuuauacagauaguuacuagaggauauuguauaaaguaauauucuuguguuauuuccauugaauuugaauuucuccuuuaaagauuauacuuaugauaaaaaucugauuuuaaaaaucugauaaaagauguuuuugaagaguuuuccuccucuucucucccacguuuuacagcuuauauguuuuuaauuucaaaauaugacucuaauuuuuuucugccaccuuuuaguggaauaauucuuacaacacaguugucuguuaagaaucauacuuuugggccaggcucaguggcugacgccuguaaucccaacacuuugggaggccgaggcagguggaucacaaggucagggguucaagaccagccuggccaagauggugaaacacugucucuacuaaaacuacaaaaauuagacaggggcaguggcaggcgccuguaaucccagcuauuugggaggcugagacaggagaauugcuugaaccugggcggcagagguugcagugggccgagaucguguuacugcacucaagccugggcaacagagugagacuccaucucaaaaaaacaaaacaaaacaaaacaacaaacaaucauacuuucugggcaggcgcaguggcucacaccuguaaucccagcaguuugggaggccaaaguggguggaucacuugaggucaggaguucaagaccagccugaccaacauggugaaaccccaucucuacuaaaaauaaaaaauuagcugggugucauggcgggcaccuguaaucucagcugcuugggaggcuuaggcaugagaaucacuugaaccugggaggcagagguugcagugagccgagauugugcagcugcacuccagccugggcaacagagugagacccuauaucaaaaaaaaaaaaagaaucauacuuuccucaaagccgggucugacagcauccaccuguagucccagcuacucgggaaucugagguagaaggauuguuugagccuaggaguuugaggccagccugggcaacauaaaaugacuucaucucuauaaaaaaaaaucauguuuuuuccagguuuucaauauaaauuagaugguaaaaauuuaagauuguaguauaugugaugaaauuggauagggcuuaugguuuuaauucguuucauguuucauguauaaugauagaauuaauuguaguaguaauacaaggagcaaaauguauauuuuggaaacaucacacagguaugugaaacagcugaagaauaauuauaaggucguuuauuaacaagugagagauuacagugcuuaaaccauaaaagucagcucuuauaggcaauuccaagagaagacaguuauauagggagaacuuuagagaggaggccauucuuaccuccuugaagacagugucaggaguggauugcugagggagaaauagggcuuucuaggcaguggguaguuuaagccaaguucuccugguggaaauuagcauugaguaggagacuggccugacaggaguaacuuuuuauuuaaggaagaccuggggauguacugggaaaauuaugaugaaagccagaaugacaugaaccacuugaaaaccuuuacauaggacagaccccuaguauaggaaacagaccagaggggagcuauucucauggagccgggggaggggcugggcccagagcuccgcccuuccgacccccacccgcuuggcccccguggucaucuccagauaccuccagggaaaaugaaggcuccccuaggcuucuguaaaaaccacuuuugcccucuuuaccacaguguagucuccauaacauauuugucaauagaugguacaaaaauucucaaauuuuuaguuguuuccucuuguacuguuuguuuuuugagauagagucucacucuuugcccagguuggagugcaguggugugaucucgguucacuacaacucccccuccuggguuccagggauucucgugccucagccucccaaguagcugggacuacaggcaugugccaccaccccuggauaauuuuuguguuuucaguagagacaggguuucaccauguuuccagguuggucucaaacuccugaccucaggugaucugcccaccucggccucccaaaguguugggauugcaagcccucuuauacuauuuguauaagacauuaaauucaaauucaaaaagaaucuuauuagaaugaaaacaaugauaucacuaauaaaauguuagcaagauccagcagauuuugagccugcuugcuuuaagcuucauuucguagaaugaaauucuccaaccaucaaaugauaaagaaaacguuugaguuggcguauuaguucauccucacauugcuauaaagaacuaccugagacuggguaauuuauaaagaaaagagguuuaauugguucaggguuccauaggcugcacaggaagcauggcuggggaggccucaggaaacuuacaaucguggcagaaggugaagaggaagcaggcacguccuacauggcuagagcaggaggaagagagagggggaggugccacacacuuucaaacaaccagaucucaugagaacucacucacuaucacaagaacagcaagggggaaguccacucccaugauccagucacuucccaccaggucccugcuccagcacuggggauuacaauucgacaugagauuugguugaaaucacaaauccaauccauaucaguugguuacaaauaaauaaauaaauugaaucucuauauucccaaaugugaaagguaauucauuuucuuggagaauuguuccuggaaaauuuuuucacuaagcaaaagcuggccuuuauuagcaggguuuaaagagaaccaaaacuaacuacugcauuuccuugucugcuuuguuugcaucaauaucauugauuuauacagcagggcaacggggacuuucugcuacccucaccuucuaggggaaagaucaaaaucgaauuugcucauccaguacuguaccugacauuggauaagucaagugagcucuguaagggcagaauucaguggugguuacaacuuagcuugauguuugguuuggcuccaggauaggaagcagaagcaugugacugcaaccuggggagcagcacccccagaaaagugcuguauuaguuuccuagggcugcuauaacagaggaccacaaacuggguaguggacacauuagaaaucuauugucucacaauucuggaagcugguagucugagaccaagaugucagcaggguugcuucuuucugagccugugagggacaaucuguuccaugcuugucuccuagcuucuggugauuuucugucagucuuuggcauuccuuggcuuauagaaacaucaccagaucuccacccuugucaucacauguguucucccuauaagcaugucuauguccaaugucccuuuuuaauaaggaugccagucauauuggauuaggggcccauccuaccacagcacaaccucaucuugacuaauuacaucugcaagagccccauuuccauauaaggucagauucugagguacaggagguuggggcuacagcauaugaauuuggggguggaaggguagagaaauaauucaacucuuaauaagugcucagcacaauauugcaucccacuccaucuuguuccaccagaauggagcauggcugccccaagggcagauuaggacuggcacuauggaguucacccuggccaccugcccucagcuccucugagauugcagagccccagcaggccauccuagagccacuuaccuaccaaccaccgauuggaugacugaugaaucugauaaucucucuggauauacaccaaugaaacuccuucaacucccccugugcugggggcaaaguuaggcaugcccaugcuaaguagggugugucucaccagccaccuggagccccaucccuaguuuucuugguguuugauaagugcucacagccucagucaugucuuccuuugcaggcuggauuuaaagggaggcuuggaaccaaguucaauuggagagguuaaaugguguaagcaaauaaucacuuguuuccuuucugagcagcuuguaguuaauuucucauuuucucauucucuuauugaugauauuuauguuuaaauaaagccuucuccuuuacagccugauuuuucccaucugcuugauuccugcagugaaguccuaaccccauauuuguuuguuuucucacagcuuguugccaugggaaugguuauaagguagcaaauuucaacacuaacuucaaaguauccugaaagagauaaagaaaacgggaaggauagaaauguguucuuagcugaacacacaucucugauuauugucaaaaacacaguagaagaaaagcucagaguagcaagggaugcauucaugcuuaaguauaugucaaauggcuccccaggacaagccuccucuuaccuaaggaauaaugugcauuaggaaaccaggaacuggccuuucagaaggaugauccagccacugugauucggaaaugaaagggugcuucgugcugaggaaauauggugcuccaggggcccugcuaagaggcugagaugguucuagaagugguugauucaguuccuggauccccuuggcccacuuaaagacacgccugacauccugggaaaguguccuaagcuauagccuugacucugcucuuuugagggagaugaggugcugaccugccuagcagucuggugauauuuucuuuuuuuccucaguagaggcagggaaacaucacaaagagacaaggagagaaaggccuagguuuuuacauuuuucaugagaaaaaaaaaaacuguugugcaauaauuaaauagcccacccucaagucacauauuguuuagaggacacgagacuacagcauccuggacagaccucuagacaucccaguauuugaagagaaauugccauggggcuucaauuucauccaggaaauaagaugccuuaguuagugcaauuggucuaugacuacauauauaugcauaugguuucuaaaguaaaagcaucaguuuucuuucguaauuuaauuuuuuuguugucuuuuagauaaaaauauauacucuggaagagcaugauguuuuaucuguuuggguugaaaagcacgugggaaguccagcacauuuggcuuaucgucucuugucugacuuuacaaagcgaccuuugugggacccccauuuuguguaagaacaaauuuaaaaauuuuucucaaucaaccuugacauaauguaaaagaugaucuccauacugaaguccaucuccaucguccaaugugugacccauuguuuaaagaguauuuuuagaaguuugacccagcauagcacuuugggaggcugaggcagguggauaguugaguccgggaguucaagaccagccugggcaacauggugaaagcccaucucuauaaaauacacaaaaauuagcuggacaugguggugcaugccuguaauccuagcuacccgggagacccaggugggaggauugcaugagucugggaggucaaggcuacagugagccaagaucacaccacugcacucuagccugggugacacaggagacccugucaaaaauuaaaauaaaaauaaaguuugaucuggacagaauacugcaucaggugauauugagagacacaaaacaaaaauuauacucacuuaucaucuauauugaguugaccugcuuuacacacaucuauuguaauucuaccaguaacuucaaggucaauauuauuuccauuuaagagguucugagacgugccaagauugcacaggcaauaaagugauggaacccaaacuggaacccaagucugucaugcucugaauucuacacucuucuacuuuaauaugcaaccucauugcucuugaggaagugauuauccaauuguccugcauacucucaauauuucauuggcaguuccuuacuuuucugugaagcaacccucccuggugagaagcuaagagagcaagcugugugagccccgaggugaaaggcaugccuuccugcucccccuccugaugaugucccugcuccuauuagccuacaucucccacuccugccacucccugucuccugcaucccuaauccaaucuccuccacuccccagcccuuuccuggaacacaguacagagcugugcacccugccaacugcacugacagagaccagcugcacuggggcccagccaccuuggcuauagcaccccgcagggcuucauggcccaccuuguugacacggaagaguugaugagaugggcuuccuauguguuaagcguuuccuaaucuugacaagauagaggcucaucuucaaauuuucuaaaacucacugugauagagauuuagaaauaccauguaacauaugauuuaauaccacuaaagugaaacaucucugaggucacguguuacauuggcacagaugcuagaguugaaaugggaggaguucccuuauccuccucauagggccugcgacaaggguguggcuuguuucuuccgugcugcucaaaccccuagagggaucaugcagacgcuuaagucgcuuaagucguggggaguguuuuugagcucugaccccacggcagcaucuaggguugacuguuuauggcuucugaagccccgguggguguguguuacgaugcgcucuuucaguuuugcugucugcaggcagccuguguuaaucagcucgaucagacccucugccuuauugcaagaacagagggcuuucuguauccuggauucuugcguuaguguacuggaaaaaacggcucacgcguggccuuggaggaugggugcaagguuuauugagugguggaaguugcuuuuagcaagauggauggggagccagaaggaggauggagugggaagguggucuucuucuggagucaggcugcccagccaccagacucuccucugaccaccccugacugaauuccaugucuuuccaccaucgauggucugccagcgucugcuggugucuggcagugugcuccucuguuccucucaacauccagcccgcuagggucucggguuuuuuaugggcacaggauguggggugcagugggccaaaagguaacuuuuggggugugaaaacagaaaugccuguccucauuuaggucugugggcacaggcccgaggguggagcccucaccagggacccugcccuucccuacccaacauuucccugcccaccuccuguaucagaaugauacaucgugguuaaugcuaucauaauaaaucauucugagagaagaggaacacuucucaauuuucuugcaucaauuuaguagauacucuaccaguacaagcuuuuaggaauaacaaugccuaaacuuugguguuaugcuuuaaaaauguuucucccacuaucucuaugucacuugacauuccagccaaauugaaguugaacaaauuggggagugaaugaaugaauucuaauccaacuaacuuuucuuguacauguacuaugauucagguacuaugccagguguuuucacugaauccuugcaauaaccccacguaucauuaucuaaauuuuacagaugaaaaaaucaaaugacuugccuaacgcaacuuauguagcgaguaaguggcaaucugggagucaaaagaaaguugugugacuccaaagcuagugcgguuuccaauauaccacauuucuuuaucuauauaaacaauccuucuuggacugacuauaugauuuaccaguccucacaauguuuuuacuugauccuggagaaaaauaauuuuguguaaaacagcucaaugccuuucacugaaguauugagaauuaugaacuugaagucagauggccaccauccucuaucacuugcagaauuauuccuucugaucaaagagcucuugcguuuuuuguuuguuuguuguggcuuuuuuuuuuuuuuuaagaucucacugugucaccuaagcuggacugcaguggcacagucauggaucacugcagccucaaccucucaggcucaagugauauucccaccucaaccucucgaguagcugggaguacaggcaugcaccaccacacucaaauaauuuuuuaaaaaauuuuuauaaagauaggguuuugcaagauuuugcccagguuaguccugaacuccuggccucaagugauccucccaccucagacucccaagguguuaggauugcaggcaugagccacugugccuacccucaaagagcucuucuaaaggcagacuugagcaauaaugcuggcuuuuagggagaugauuaggugagcugaaggggcaaauauggauacaaauaaugagauuauguaagcaaauaagggaagugaaugccugagcagguagaaaguauaccugcuuuucacuguucuauauacacagguccugugaagucauagacugggugagugaagaugaucagcuguaucacaucaccuguccuauacugaaugaugacaaacccaaagacuugguaguacucguaucacgaagaaaaccccucaaagaugggugaguauaugcaguccaaguguucuauuaauauuucauaguauaggauagaaauuaaaaguugaugugaaaauaaugaagucuguguagauauuucugcucuugaauuauguuuauuugaauuauaccuagaugaaucuuuagcuauuauuuuaaaaauuaacagucaucuauuaagagccagcuguuugcaaaggacaaugcaagaauccuaaaguaguuccuuuuccuacguaaauguaaaacugguauucaguaaaccuuugaaacauaccaugauuaguaaaaaugucguggaagccaaauaagacaucaggaauugguuuagaauucaccaaggcuugacuaugcuagacauccaccauggcugguugucagcuggggcugucgaucagaguauccagacauaguuuuuccauguacauugaacuucucagagcauggcagcuagcuucuaagagaaacugucccaaauaaucccacacacauaugaguauuaacagauguucaguguuguaucauuuauuaugucaaaagauauuagaaacaaauggaaaauccaucuuauaaauuaugguagagccauacuacaaaguauuguaccaucauuaaaaaggaugaaggagcuauagugggacugauagagaaacaccuucaaagauuuauugcuaaaugaaaaaucaaauuguagucaauauuuguaaaaugauauuuauguaaaaaauuuugugugcauuugcuuauauaaaugucauucuuauacacuuauuuuaaaaagucuagagggcuauacaguaaaauguuaagcguguucacuucuaggguagaaaauagcaugggagcgcaauuggacuggaggaagauuuuuauuuuguagccuacaggguucucuauuguugagaguuuuucuuuuaacaacaauggguauuguuuuuauuauuauuauuuuagaugauguguugcccaggcuggagugcaauggcacaaucucagcucacugcaacuucugccucccggguucaaacgauucuccugccucagccucccaaguagcugggauuacaggcaugcgccaccauggucagcuaauuuuauauuuuuaguagagauggaguuucuccauguuggucaggauagccucgaacuccugaccucaggugaucugccugccucagccucccaaagugcugggauuacaggcgugagccacugcacccggccuguuuuuuaauuuaaaaaggaaaggaggcugaaauuacaacccugucgggcacaauaaaacuucaguuuggugguugacuccaguuucauggaguuacacaaagcauuguauaugcaauucuaaggcagaaaacacuauuuccuaccuugaagguagccuguagaguguuuucugaugagaccacucuucuagaagaucugggccuucauaguuucacuucuaccuguauaaguaaauuggguuaacuauagggauuuauuuucuaacaacuauucuuuauuucucacaagagcuuagaaaguguuuucuuucaguaacacuuacacaguggcagugaagucggucauuuugccaucgguccccccgucuccacaguacaucagaagugaaaucauaugugccggauuucucauccaugcuauugacagcaauucaugcaucguaaguuugaugaaacaucugcagauuaauuggcucugccagauagcgaaaaaucucuuaauuuacccagauguccuaauuaauuguaaucuuguaauuuguguccacacuaugggaauccuaaggucauccuuucggaucaucuauuccagaaggucccccagaagauuagggucuuagccuccccuacaccagcaagacucagauccuuucuugaaaaagcuccaagucaauaagaaauuaaaauauuguacuuucuuuuugaaacagguaucuuacuuuaaccauaugucugcuagcauccuuccuuacuuugcuggaaaucuugguggcuggucaaaauccauugaagaaacagcagccucuuguauacaguucuuagagaauccuccugaugauggguuuguaagcacauuuuaaaggucaacuuucaauuacugguaauuuaauuucccacuuuuaauuccaagcacccuuagcccugacaucugucaagcuuuggggccacaaaauaauuuaauauaacccuaagcaaaaugcagugacggaguuaaaaaacaaaaugcaucuuaagucaaauaccagugauuuggauuagcauuaaaagagcuuuagaauucuguuguaagucaucuguggcucugccucuuccaggggcacagauaguggaaaauugccuguaugca

SEQ ID NO: 192903 - RNA, 64042 nt, Homo sapiens
ugcauacaggcaauuuuccacuaucugugccccuggaagaggcagagccacagaugacuuacaacagaauucuaaagcucuuuuaaugcuaauccaaaucacugguauuugacuuaagaugcauuuuguuuuuuaacuccgucacugcauuuugcuuaggguuauauuaaauuauuuuguggccccaaagcuugacagaugucagggcuaagggugcuuggaauuaaaagugggaaauuaaauuaccaguaauugaaaguugaccuuuaaaaugugcuuacaaacccaucaucaggaggauucucuaagaacuguauacaagaggcugcuguuucuucaauggauuuugaccagccaccaagauuuccagcaaaguaaggaaggaugcuagcagacauaugguuaaaguaagauaccuguuucaaaaagaaaguacaauauuuuaauuucuuauugacuuggagcuuuuucaagaaaggaucugagucuugcugguguaggggaggcuaagacccuaaucuucugggggaccuucuggaauagaugauccgaaaggaugaccuuaggauucccauaguguggacacaaauuacaagauuacaauuaauuaggacaucuggguaaauuaagagauuuuucgcuaucuggcagagccaauuaaucugcagauguuucaucaaacuuacgaugcaugaauugcugucaauagcauggaugagaaauccggcacauaugauuucacuucugauguacuguggagacggggggaccgauggcaaaaugaccgacuucacugccacuguguaaguguuacugaaagaaaacacuuucuaagcucuugugagaaauaaagaauaguuguuagaaaauaaaucccuauaguuaacccaauuuacuuauacagguagaagugaaacuaugaaggcccagaucuucuagaagaguggucucaucagaaaacacucuacaggcuaccuucaagguaggaaauaguguuuucugccuuagaauugcauauacaaugcuuuguguaacuccaugaaacuggagucaaccaccaaacugaaguuuuauugugcccgacaggguuguaauuucagccuccuuuccuuuuuaaauuaaaaaacaggccgggugcaguggcucacgccuguaaucccagcacuuugggaggcugaggcaggcagaucaccugaggucaggaguucgaggcuauccugaccaacauggagaaacuccaucucuacuaaaaauauaaaauuagcugaccaugguggcgcaugccuguaaucccagcuacuugggaggcugaggcaggagaaucguuugaacccgggaggcagaaguugcagugagcugagauugugccauugcacuccagccugggcaacacaucaucuaaaauaauaauaauaaaaacaauacccauuguuguuaaaagaaaaacucucaacaauagagaacccuguaggcuacaaaauaaaaaucuuccuccaguccaauugcgcucccaugcuauuuucuacccuagaagugaacacgcuuaacauuuuacuguauagcccucuagacuuuuuaaaauaaguguauaagaaugacauuuauauaagcaaaugcacacaaaauuuuuuacauaaauaucauuuuacaaauauugacuacaauuugauuuuucauuuagcaauaaaucuuugaagguguuucucuaucagucccacuauagcuccuucauccuuuuuaaugaugguacaauacuuuguaguauggcucuaccauaauuuauaagauggauuuuccauuuguuucuaauaucuuuugacauaauaaaugauacaacacugaacaucuguuaauacucauaugugugugggauuauuugggacaguuucucuuagaagcuagcugccaugcucugagaaguucaauguacauggaaaaacuaugucuggauacucugaucgacagccccagcugacaaccagccaugguggaugucuagcauagucaagccuuggugaauucuaaaccaauuccugaugucuuauuuggcuuccacgacauuuuuacuaaucaugguauguuucaaagguuuacugaauaccaguuuuacauuuacguaggaaaaggaacuacuuuaggauucuugcauuguccuuugcaaacagcuggcucuuaauagaugacuguuaauuuuuaaaauaauagcuaaagauucaucuagguauaauucaaauaaacauaauucaagagcagaaauaucuacacagacuucauuauuuucacaucaacuuuuaauuucuauccuauacuaugaaauauuaauagaacacuuggacugcauauacucacccaucuuugagggguuuucuucgugauacgaguacuaccaagucuuuggguuugucaucauucaguauaggacaggugaugugauacagcugaucaucuucacucacccagucuaugacuucacaggaccuguguauauagaacagugaaaagcagguauacuuucuaccugcucaggcauucacuucccuuauuugcuuacauaaucucauuauuuguauccauauuugccccuucagcucaccuaaucaucucccuaaaagccagcauuauugcucaagucugccuuuagaagagcucuuugaggguaggcacaguggcucaugccugcaauccuaacaccuugggagucugaggugggaggaucacuugaggccaggaguucaggacuaaccugggcaaaaucuugcaaaacccuaucuuuauaaaaauuuuuuaaaaaauuauuugagugugguggugcaugccuguacucccagcuacucgagagguugaggugggaauaucacuugagccugagagguugaggcugcagugauccaugacugugccacugcaguccagcuuaggugacacagugagaucuuaaaaaaaaaaaaaaagccacaacaaacaaacaaaaaacgcaagagcucuuugaucagaaggaauaauucugcaagugauagaggaugguggccaucugacuucaaguucauaauucucaauacuucagugaaaggcauugagcuguuuuacacaaaauuauuuuucuccaggaucaaguaaaaacauugugaggacugguaaaucauauagucaguccaagaaggauuguuuauauagauaaagaaaugugguauauuggaaaccgcacuagcuuuggagucacacaacuuucuuuugacucccagauugccacuuacucgcuacauaaguugcguuaggcaagucauuugauuuuuucaucuguaaaauuuagauaaugauacgugggguuauugcaaggauucagugaaaacaccuggcauaguaccugaaucauaguacauguacaagaaaaguuaguuggauuagaauucauucauucacuccccaauuuguucaacuucaauuuggcuggaaugucaagugacauagagauagugggagaaacauuuuuaaagcauaacaccaaaguuuaggcauuguuauuccuaaaagcuuguacugguagaguaucuacuaaauugaugcaagaaaauugagaaguguuccucuucucucagaaugauuuauuaugauagcauuaaccacgauguaucauucugauacaggaggugggcagggaaauguuggguagggaagggcagggucccuggugagggcuccacccucgggccugugcccacagaccuaaaugaggacaggcauuucuguuuucacaccccaaaaguuaccuuuuggcccacugcaccccacauccugugcccauaaaaaacccgagacccuagcgggcuggauguugagaggaacagaggagcacacugccagacaccagcagacgcuggcagaccaucgaugguggaaagacauggaauucagucagggguggucagaggagagucugguggcugggcagccugacuccagaagaagaccaccuucccacuccauccuccuucuggcuccccauccaucuugcuaaaagcaacuuccaccacucaauaaaccuugcacccauccuccaaggccacgcgugagccguuuuuuccaguacacuaacgcaagaauccaggauacagaaagcccucuguucuugcaauaaggcagagggucugaucgagcugauuaacacaggcugccugcagacagcaaaacugaaagagcgcaucguaacacacacccaccggggcuucagaagccauaaacagucaacccuagaugcugccguggggucagagcucaaaaacacuccccacgacuuaagcgacuuaagcgucugcaugaucccucuagggguuugagcagcacggaagaaacaagccacacccuugucgcaggcccuaugaggaggauaagggaacuccucccauuucaacucuagcaucugugccaauguaacacgugaccucagagauguuucacuuuagugguauuaaaucauauguuacaugguauuucuaaaucucuaucacagugaguuuuagaaaauuugaagaugagccucuaucuugucaagauuaggaaacgcuuaacacauaggaagcccaucucaucaacucuuccgugucaacaaggugggccaugaagcccugcggggugcuauagccaagguggcugggccccagugcagcuggucucugucagugcaguuggcagggugcacagcucuguacuguguuccaggaaagggcuggggaguggaggagauuggauuagggaugcaggagacagggaguggcaggagugggagauguaggcuaauaggagcagggacaucaucaggagggggagcaggaaggcaugccuuucaccucggggcucacacagcuugcucucuuagcuucucaccagggaggguugcuucacagaaaaguaaggaacugccaaugaaauauugagaguaugcaggacaauuggauaaucacuuccucaagagcaaugagguugcauauuaaaguagaagaguguagaauucagagcaugacagacuuggguuccaguuuggguuccaucacuuuauugccugugcaaucuuggcacgucucagaaccucuuaaauggaaauaauauugaccuugaaguuacugguagaauuacaauagauguguguaaagcaggucaacucaauauagaugauaagugaguauaauuuuuguuuugugucucucaauaucaccugaugcaguauucuguccagaucaaacuuuauuuuuauuuuaauuuuugacagggucuccugugucacccaggcuagagugcaguggugugaucuuggcucacuguagccuugaccucccagacucaugcaauccucccaccugggucucccggguagcuaggauuacaggcaugcaccaccauguccagcuaauuuuuguguauuuuauagagaugggcuuucaccauguugcccaggcuggucuugaacucccggacucaacuauccaccugccucagccucccaaagugcuaugcugggucaaacuucuaaaaauacucuuuaaacaaugggucacacauuggacgauggagauggacuucaguauggagaucaucuuuuacauuaugucaagguugauugagaaaaauuuuuaaauuuguucuuacacaaaaugggggucccacaaaggucgcuuuguaaagucagacaagagacgauaagccaaaugugcuggacuucccacgugcuuuucaacccaaacagauaaaacaucaugcucuuccagaguauauauuuuuaucuaaaagacaacaaaaaaauuaaauuacgaaagaaaacugaugcuuuuacuuuagaaaccauaugcauauauauguagucauagaccaauugcacuaacuaaggcaucuuauuuccuggaugaaauugaagccccauggcaauuucucuucaaauacugggaugucuagaggucuguccaggaugcuguagucucguguccucuaaacaauaugugacuugagggugggcuauuuaauuauugcacaacaguuuuuuuuuuucucaugaaaaauguaaaaaccuaggccuuucucuccuugucucuuugugauguuucccugccucuacugaggaaaaaaagaaaauaucaccagacugcuaggcaggucagcaccucaucucccucaaaagagcagagucaaggcuauagcuuaggacacuuucccaggaugucaggcgugucuuuaagugggccaaggggauccaggaacugaaucaaccacuucuagaaccaucucagccucuuagcagggccccuggagcaccauauuuccucagcacgaagcacccuuucauuuccgaaucacaguggcuggaucauccuucugaaaggccaguuccugguuuccuaaugcacauuauuccuuagguaagaggaggcuuguccuggggagccauuugacauauacuuaagcaugaaugcaucccuugcuacucugagcuuuucuucuacuguguuuuugacaauaaucagagauguguguucagcuaagaacacauuucuauccuucccguuuucuuuaucucuuucaggauacuuugaaguuaguguugaaauuugcuaccuuauaaccauucccauggcaacaagcugugagaaaacaaacaaauaugggguuaggacuucacugcaggaaucaagcagaugggaaaaaucaggcuguaaaggagaaggcuuuauuuaaacauaaauaucaucaauaagagaaugagaaaaugagaaauuaacuacaagcugcucagaaaggaaacaagugauuauuugcuuacaccauuuaaccucuccaauugaacuugguuccaagccucccuuuaaauccagccugcaaaggaagacaugacugaggcugugagcacuuaucaaacaccaagaaaacuagggauggggcuccagguggcuggugagacacacccuacuuagcaugggcaugccuaacuuugcccccagcacagggggaguugaaggaguuucauugguguauauccagagagauuaucagauucaucagucauccaaucggugguugguagguaaguggcucuaggauggccugcuggggcucugcaaucucagaggagcugagggcagguggccagggugaacuccauagugccaguccuaaucugcccuuggggcagccaugcuccauucugguggaacaagauggagugggaugcaauauugugcugagcacuuauuaagaguugaauuauuucucuacccuuccacccccaaauucauaugcuguagccccaaccuccuguaccucagaaucugaccuuauauggaaauggggcucuugcagauguaauuagucaagaugagguugugcugugguaggaugggccccuaauccaauaugacuggcauccuuauuaaaaagggacauuggacauagacaugcuuauagggagaacacaugugaugacaaggguggagaucuggugauguuucuauaagccaaggaaugccaaagacugacagaaaaucaccagaagcuaggagacaagcauggaacagauugucccucacaggcucagaaagaagcaacccugcugacaucuuggucucagacuaccagcuuccagaauugugagacaauagauuucuaauguguccacuacccaguuugugguccucuguuauagcagcccuaggaaacuaauacagcacuuuucugggggugcugcuccccagguugcagucacaugcuucugcuuccuauccuggagccaaaccaaacaucaagcuaaguuguaaccaccacugaauucugcccuuacagagcucacuugacuuauccaaugucagguacaguacuggaugagcaaauucgauuuugaucuuuccccuagaaggugaggguagcagaaaguccccguugcccugcuguauaaaucaaugauauugaugcaaacaaagcagacaaggaaaugcaguaguuaguuuugguucucuuuaaacccugcuaauaaaggccagcuuuugcuuagugaaaaaauuuuccaggaacaauucuccaagaaaaugaauuaccuuucacauuugggaauauagagauucaauuuauuuauuuauuuguaaccaacugauauggauuggauuugugauuucaaccaaaucucaugucgaauuguaauccccagugcuggagcagggaccuggugggaagugacuggaucaugggaguggacuucccccuugcuguucuugugauagugagugaguucucaugagaucugguuguuugaaaguguguggcaccucccccucucucuuccuccugcucuagccauguaggacgugccugcuuccucuucaccuucugccacgauuguaaguuuccugaggccuccccagccaugcuuccugugcagccuauggaacccugaaccaauuaaaccucuuuucuuuauaaauuacccagucucagguaguucuuuauagcaaugugaggaugaacuaauacgccaacucaaacguuuucuuuaucauuugaugguuggagaauuucauucuacgaaaugaagcuuaaagcaagcaggcucaaaaucugcuggaucuugcuaacauuuuauuagugauaucauuguuuucauucuaauaagauucuuuuugaauuugaauuuaaugucuuauacaaauaguauaagagggcuugcaaucccaacacuuugggaggccgaggugggcagaucaccugaggucaggaguuugagaccaaccuggaaacauggugaaacccugucucuacugaaaacacaaaaauuauccaggggugguggcacaugccuguagucccagcuacuugggaggcugaggcacgagaaucccuggaacccaggagggggaguuguagugaaccgagaucacaccacugcacuccaaccugggcaaagagugagacucuaucucaaaaaacaaacaguacaagaggaaacaacuaaaaauuugagaauuuuuguaccaucuauugacaaauauguuauggagacuacacugugguaaagagggcaaaagugguuuuuacagaagccuaggggagccuucauuuucccuggagguaucuggagaugaccacgggggccaagcgggugggggucggaagggcggagcucugggcccagccccucccccggcuccaugagaauagcuccccucuggucuguuuccuauacuaggggucuguccuauguaaagguuuucaagugguucaugucauucuggcuuucaucauaauuuucccaguacauccccaggucuuccuuaaauaaaaaguuacuccugucaggccagucuccuacucaaugcuaauuuccaccaggagaacuuggcuuaaacuacccacugccuagaaagcccuauuucucccucagcaauccacuccugacacugucuucaaggagguaagaauggccuccucucuaaaguucucccuauauaacugucuucucuuggaauugccuauaagagcugacuuuuaugguuuaagcacuguaaucucucacuuguuaauaaacgaccuuauaauuauucuucagcuguuucacauaccugugugauguuuccaaaauauacauuuugcuccuuguauuacuacuacaauuaauucuaucauuauacaugaaacaugaaacgaauuaaaaccauaagcccuauccaauuucaucacauauacuacaaucuuaaauuuuuaccaucuaauuuauauugaaaaccuggaaaaaacaugauuuuuuuuuauagagaugaagucauuuuauguugcccaggcuggccucaaacuccuaggcucaaacaauccuucuaccucagauucccgaguagcugggacuacagguggaugcugucagacccggcuuugaggaaaguaugauucuuuuuuuuuuuuugauauagggucucacucuguugcccaggcuggagugcagcugcacaaucucggcucacugcaaccucugccucccagguucaagugauucucaugccuaagccucccaagcagcugagauuacaggugcccgccaugacacccagcuaauuuuuuauuuuuaguagagaugggguuucaccauguuggucaggcuggucuugaacuccugaccucaagugauccacccacuuuggccucccaaacugcugggauuacaggugugagccacugcgccugcccagaaaguaugauuguuuguuguuuuguuuuguuuuguuuuuuugagauggagucucacucuguugcccaggcuugagugcaguaacacgaucucggcccacugcaaccucugccgcccagguucaagcaauucuccugucucagccucccaaauagcugggauuacaggcgccugccacugccccugucuaauuuuuguaguuuuaguagagacaguguuucaccaucuuggccaggcuggucuugaaccccugaccuugugauccaccugccucggccucccaaaguguugggauuacaggcgucagccacugagccuggcccaaaaguaugauucuuaacagacaacuguguuguaagaauuauuccacuaaaagguggcagaaaaaaauuagagucauauuuugaaauuaaaaacauauaagcuguaaaacgugggagagaagaggaggaaaacucuucaaaaacaucuuuuaucagauuuuuaaaaucagauuuuuaucauaaguauaaucuuuaaaggagaaauucaaauucaauggaaauaacacaagaauauuacuuuauacaauauccucuaguaacuaucuguauaagaaugaagaauuaaucauugauagcucucccacaacacuagcaaauuuauuuggguaugcuuugggccacacccucccaaagaacugcaguuuuaauauauucuacgacuucacuaaauauguucuuucaguucauuccagacaugaauuuguucuuuccacugcugcucaugaaugcucagaugccagcaaugaugaaagaaguaaguuuuauaauaguaaaagaaaacaaaguagugaagcaucuuuuaugaaagauaaacaaaugcauuaguuaaaccuguguuucugcaucacugaaccaggcaaagacagaaauuuaacuggauccaaaugggauaaggaagacuucuaaaggauuuaauaaugaggacagagaacucauaaaaggaaacaaccaaaaacaaaacauucagaagaagucaaagucagaguugaaacgaaucaaugaaguagcaucugaauuuacuuagauuuaaagguaaaguaacaauauaauuuaucauccaaacuggaacaccaagagacuguuaauaauuaugaugggacaacagguguaagccagagcugucccaggaaaaucaggacauauggucauccuauuucauaggcugcugcuucacugaugaugaaaaucagugcauacugaaauaugaauguagccaaagugcuggcauuagugagcaucucugaagugccaggcgcuccuauggucuggguguaguggugagcagaucggcccucagggagcuuacagucuaguuauugugggcaugagcuuccgagggucuccuaaaaaaccucugaaaauagauaaaauuaugauccaaaugauguaugucucuuuaaaccugauggcaugcaaaacacuguaauagguccuaagagagauacaaagaaguccagacaaggccucuuucuuaagagguuuauaauguacuuagggaaagaagaccauguguaaaaaguuaaauuuccauguaaggcuuaaauauuaauuugagguagcuguggaagaaaugucacaagauaguguauaauuaauugaccaauuauuuauuuauuuauuuuuuuuagagacagagucuugcucuauugcccagacuggaaugcaaugaugcaaucauagcucacuggaggcugaaaugccugggcucaagugauccucccaccucaaccuccuggguagcuaagacuacaagugucugcuaccacagccggcuaauuuuuaaauuuuuuguagagauggggucucauuguuuugccugggcugguaucaaacuccuggccucaagggauccuccugccuuggccucccaaaguacuaggauuacagacgugagccagcacacucgaccaaaaaaauuaauuuuaaagaagucaugacaguuacuagaaaaagaaguccuuaagucaaguguggcaguugaggcuuuauggagaagcaucuguccugaucuagaucaggugggauuuggguagauggagaagagaaggagggagagacgggaugugagaaccuaagcucagagguaggagcauguuggguauauuugaaggacuccaaaucaaccagcuuguagagacagggcugaaaagaugguugcgucuuagaaacaguuuccucaaaagauuuuguuaccuucuuaaaagccucaguagaagcaguagaaccaccaccaccacagcuuucguuugugaugggcgauggauuaugcaaauaccuggaaguguccuaccuuuuccacagugcugguaaccucccaaccccuuuuggcugccaguuuuuugagggccuccacauugcugucacucagggaugccuagaauagaaauauuauauuuuuaaagcuauguguucaauacauggaugugugaucauauauuuucugcuuaaaaaaugggcacuguuggaggagguauguguugaguccuagugauaauguugaguuuagaacuaaacuacaggccaggugaaguggcucaugccuguagucccagcacuuugggaggccaaggcaggcagaucacuugaggauaggagcuugagaccagccuggccaacauggugaaaccccauuucuacgaaaaauacaaaaauuagccggguguuguagugcaaacuuguaaucccagcuacuuggaggcugaggcagaagaaucgcuugaacccgccaccgggaggcggagguugcagugagccaagauugcgccacugcacuccagccugggcgacagagugagacucugucucaaaaaaauaccaaaaaaaaacccaacaaaaacaaaaacaaaagcaaaaacgaaaaaaaaacaaacaaaaguaaaaagaacuaagcuacagguaacauauacuuuuuaucuugaacccuuaauucagaauucagacaaaguaacuguauacuuaacaacugcguaucauuuuaguaucauuuuaguugguguccugagcaaagacagacuaccuuucaguaugacugauaaucaauguguaauaaguaaacuuggauuucucuuuacauuuaaugguuaaaaauauucaaaugacuacuacuuuguuauuguuuuuauaaaaaugcaagcuggugggcacaagucacggugagauaccagguggcacugugccaugcuucuggaacauaucugauggcagagcauccugagucugcaguuugggaacuguaagaagucaaacaaggcuaaacugccgauugguaagcaguaacugauagccugguuuuguuucaucuugacaugacuggcugauauaauccaccuuuucacauagccugcguaggcacagccuaggccaguuaggcaagcggauuuccauuuuuguaaugaugagacuuuuauaugaagagcuccaaaucacaaaacaucaccugcuugcugauaucccaguguaugcaaaguggaaccucuucuuugugggaaauaacauauuuucuggaaaaaaaaauuaaaguguuaaaugacaguuuuuuucucugcauuuagcacacaacaauaaccauaauacuuucuugaacuucuaucagccauggauaucaguggaacaacguggaagaacuauuuccauaagucaguagucagccuuugcggccaggaaacaucagaccuucucuuuuuccguuacgugggaauagagacccagaggggggcucuuauauaauuugucagauuaacgaagacuccauaaaaucauuacaccuuauguuccuuaccugccuaggcgaauucgcuugcgugcaauagcuccccgauagcgucugaaaucauccuuuaaucaaaaacaaaguaaaaucaauaaaauaaaauaaaauaucuacuaucuuagugcuauaauccuuaaguauccuucuccuaaaucagucaaaagggcuaacugagauguggugucucuccaugaacugacuucaucaagucagagucucugugcugaauccacaaagggcaguugcacugacaaaggugcaaucuuugcagcuauuuucuuccuuuucucaaaaguggagauuauuaacauuccuguuaccagaauuauacuuaauucucacuacagaguuuuuagaaaaaauuaacauuggcaaucagguaauuuagggaugagggaaagauaugguuuccaugaaccuggcacguggcacagcaucaagagcuagaguuaaggaagugagagaagagacccagaaacaggacauagaaggugacauccuacccacagcaguguguagcccgguagaggugaggucuucagggcuuccaucauuugaacaaaugaucagagugaucggggggaaaaggaaaagaaaaaagcccacuucacuuugugaugcugaaaagagggaaaaccaaagggaaagagccaaagagguuguugccggugggaggagauucuagguagagcucucuauucacagguccggcuauugaaccucgugugauaauaacugaccuuugaaauggguuggauucugggaaacgugaugagauuuuccuuaucaucagcagcauuguaaaugagaaaagcacuguugaugugacgcccucggcccucggcccauuccugacagucaaaggccuccacgcgaacuccaacuucaacacugugaagggugaugcagggcggugggcaaagaggaucuugacccaucaggcccuccuugcacaccgcugccaccuccucgcccaccgcugccaccuccucuaagcaacaggaggauaagggccuggguuuucuuguuuguuaucagcaaaccugugcaacuauuaaaauccauuuucaggucaaugggcugcuuuuuacaagccccuaagagcauuuccauuuuacuuccccacuuucaagugggaaaaaggccaggaagggcuuuauauacauucaagaacauauuuuggcaaugugggggagggcuuaaauuaugccaaaguuaaguuuucuucccuaaaaacaauaauucuguaauuaaaaaauaaacacugaaauuagacaggaaacacagauauucauuuuuacauuuaaaaagaaaauaauacuaaaucaaaucuuuucauuguguaucaagaauaauaaaaauaacugggaagugguuuggauuucauggugguaauaccagguccauuaugaguugauugaccaucuagucacugggacugaaaggaaaaguuaauaauuaugcagggaugacagguacaaaccagguccuacuugggccaauugggacauacggcuacccuuauaagacaaaaaccaguccuucacaauuuacuaauugugaaaaggccccaagcagaacaaaggguuaaaaauauguucauggauuuugaaaauugcaugaaaaaaauggaauuucacuaaaguaguucccauacucaccuccaggcugaaauuaaaaauuacauuugugcaaguuuaaauuucuucauagcagccuaagggcucacuuuaccaggucugaaauguauuguugacaauggcagugaagacaagacgaucuccaacuguagaugguccccggaacuuaaacauaucuacggacuucagaaagggaugagcccaacacaggcggcuggggagacaaagggagggagagagaagaaagcgaucacacauucauucaucgaacaaaugcacagacaagucuucaaauaagcauuucuuuaaauuugacugaaauaaauaacuggauuauguggguugaggguaggucugcacgcuaccugccaauauuuugggaaauaccauguccccgagcaguggggucuuuacccagauguugaugcuucuacuccuuugguaacaguccuacucuugucucguuuccuguggaagucccuuggaacaacaaaccaaugcuuuuuguucuaaucugaauuacagucauccugauagcucaugacuguagucccaagaaguucugauccagguuggagugggguccaagugaaggcagguguccuuacacaauuccucagcuuuacaguuaaucaaauucacccacagaucaaaagauaaguuuuuuccccucacagaaaaauuaccuggauugcuacauaaagccugaaaggcuaggagauacacauuuuauaauuuuuguguguaugacacuuugaaauaauuauauauaauauuuaauuucagaaaguuacuuccauaauuuucuacauuuuagauucccagucaucauucaauuacucugugccaacaccaagcgaacagaugcugccauaagccuuuacaauagaacauguucaauugcuuuacugucacuaagaaugacaaucucauuuuaaaaacaagcucucuuauuugugcauaauuuuuagaaaggauaacuacugguuuguaacuauagucauaacuauagacauauuaauaauaaaauuauuuuaauuugagggaaauacaaccuuaaaaauuuucaaugguuaugaaaauugucagaagggcagauccuauucaaaugcauuuacaggguacagaguguucccuaaaacugcucaauuaccuacaucuuuccauuaagaauaaaauaaccuuuuugaaauugaggagucuuuaaaaguauucuaaauauucucuucuuucuuuuccuauuuuucaauuauuucuuuggccauaauuauuuuuaaccagcaccuuuaaaggucagaccuaacuguaaauugucuuuaaaaagguuuguaacuaacugacuuuauuuauuuacuuacuuauuuauagagaggcuggagugcaguggugugaucauagcucacuguagcuuugaaucccugggcucaagugaucgucccaccuccgccucccaacuagccaggacuauaggugcacaccacuacaccagcaaauuuuuuuuguagagucagggucuugcuauguuucccaagcuggucuugaacuccuggcaucaagcaaucuuccugucucggccucccagagugcugggauuauaggugugagccacccugcccaaccuagacugauuauuuuuaagugugaagccugucuucuauuucuguucugcauuuacuuugucauaagcuaucaagacaaugaguugcaguuucauaagaucaauauucauaauucagaauaaaguauuaaaacugucaucucauuuuuauuuuugaaccaaaauauuuaaacauucaccuucaaacaaaaggacagauuaauccuaaaguaagaaaguaaaugauuuagaaaucauuauaaaaggcaacauuuuccucaguccuuuccuugacuucuugacuaucccaagaacuggaucucagucccuuucuacuuucuccucacuggucccaaaaucauaggccgaaggucaaaaccaagaaccuugcagaaauaguagccacugucuccauccacgccauaaucuggccaccaaauguauuuccgugaugguuugcauggggugggaggaccaguucaaugcucugaacggaggugccccuuguggaaaccgcuccuuccucuucaucaaaaaugagaucugaaagguggauguaaacauuaaugaugguggagugaaccauaggcccuggggcuccagcuuuuccuucccggcaguacauucaacucggauuuauagaaaaauuaaaguguucucaaagccuuaagacugagaaaauugacagguucuacagagugacucuuaucuuaauggugaauauuugcaaugaauuggguuaagauaaucagaaagggccuuuuagagauuguauucuagccuauaaaauaagucuauuggaauuuugacuaaaagaaugguuacacugaaacuugaguuguuuguggugggguagggacagaucaggacaggaaggggcagaaauguugggggugauggauaugucauuaucuugauuguggugauguuuucacagguguaaacuuacuucaaaacuuaucaaauuauaugcuuuaaauaugggccauucauuguuugucaauuacaccacaauaaaguuguuaaagauaaaggaaucugagcuacaaaggaccagagacaccaggaagcuugaaacacuaccuucagaauggaaauguggccuccugcggaaacuguuuguaaugauugcagucacaagcaggaaagacacaaucuguuauacuucuucauguccuucugcucucucuuuuuuuuuagacagucucacucugucauccaggcuggagugcaguggugcgaucucagcucacugcaaccucagccucccagguucaagcaauucuccugccucggccucccgaguagcugggcuuacaggugcgugccaccacgccuggcuaauuuuuguauuuucaguagagaugguuuucaccauguuggccaggcuggucuugaacuccugaccucaggugaucugcccgccucggccucccaaagugcugggaauacaggcgugagccaccgcgccuagcuuucugcuucuuuugaaucauaucugcuccguuuacuaacaaauugguuuuuacucuuaacaauggaaaaaucauuuacucuggcugcaaagcaguaaaauguauucaauuaugcuuuuugcaucacgaagugaaccaccggcuagguuuccaucucacaugcuauuguugggaaggagggggaaaggauuuacaaacugggacaccaucguggcuguacugucagaggcagagcugagcuugcagugugagagggaagauaugcccagcaacuguugcugcucucggcauagucacaucuggugauccagaaggguagucacagaaacccuuaauuccacuuccuaauguaauuuuuagauuuauaauuaauugaugaucucuuuuauuuuuucuuauuuccagugaucguuucaguccccagcuuaaaacaagucaguagcuacccauuguucucguauaaaaccccaaauccuucccauggccugcaagcccugcauuccuggucuggccucacucucccucucccuuugcuccagccacgcuggucuuuuuucacuuccucugaggaaguauuaccuucaacaacagggcauuugucacaucccugcugucuacggcaaucccccuggccaccaucaccugugucuucaauuucacucauacucuguggcccccccuuggucauuacuuccucaguggagccuucucugaccuccacagcucagccccaccuucagggucucuugaaggaucuuucuuucauggcuauaguuuuauguuauuugugugcccuuuuauuaugugacccacuagauccuaagcuuuuuggugcagggacuauggauuuuuaaaauucucauauaauuccugaacauaggugcucaauaaauauuuauuaaaugaaaugaaugaauaaacuuaacuuagcugauuuccuuaacauucauaguccuuacucucaacagaauauuuuuagguaauaaaauaguuguacugacacuucugucugcuguugaugagaguccccacugguccccauuuuugcuuagaaguaucagacacucaacuauuuccaguuugguggguguggaagaguaucucacguugguuauaauuugcauuuuccugauuacuaaugaguuccaacaucuuuuuacauguauauuaaguauucuugucaccucuucaugaaaugucucuuuauaucauuugcuucaaauauugcuugucucauuuccggagaauuuuuuugcauguuagacauuucucuccauucuucauguuuccuaaccucccuuacauguuccccaucucuuugucuaucuggcugcauucuaguuaacucuuucagaucuaucuuccaguuccuugucuuaucugcuguuucauucauucacugaguuucaaauuuuaauuauuauauauucuuuuuuauagaaaucgucuuuguuucuuuguuaaaccuucuagguuaucuuuuuuguuguuguuguucuugcauuauacucuugauacucuuuuauuucuuaaaacauauuaagccucuucaucuuacuugauaaauucauuaucugcugucuuugugggccucguucagacuuuguggggccuggugucacuuccagaucuugaagccuugcuuuauuucuaucuuuuaugauuuuucacuaggaucucauauugcuuggaucuuuuucuguggaaauucuugggagcuggcuuuaaagucauuucuucacaaaggagcugcauuugcagcugcagauccccugggguccuacaacacagcaccacuuuacacuaaaguuuacuuguucuguuuuagcccagacaggucaugugacuucugaggauccaaaucuucaugaggaugcacuugugauugaauucugaaagggagagaauuuuuuuucccauuccaccuaaggcuaaggcucucuggaggguggaauuuuucugguugacucacugagggaaucaccuuuuggagguuccagcaccaaggaagguucccugauccaaccuucucccucacauggacgccugguuuugucuccugagcccaagcaggcccaccugcuggguccuccaggacaaaugccagcccccaugcuuccuugcacugcggcauuuguguuuucucaccauuucuggacuucaaaguuuucucuuauuuuucugccugcugagauguguuugcaaagauguuuguaaauauuuuuccagaaauuuuugguuuuacccaacaaugaauccacuauauugcuagaaucaaaauggaaucacuuucuaaagugaucuuugaaagaaauacacaaucuuaaucccuuucaauuucucucucuuucuaaaauugauuuuauuugaagauguuuuauacauaucccaaacuaguauuuauugagguuguuuucaggcuaauguuacuuacucaaauggcacauuuuuuguuuaaaauaaauuaauacaauuaucugacuucaaauuaugcuacagaguuguaguaagcaaaacagccaggcacuggcauaaaaacagacacauagaccaauggaacagaacugggaacccagaaacagauucacacacccacagugaacucauauuugacaaaggugccaagaacauacauuggggaaaggacaaucucuucaauaaauggugcugggaaaacuggauacucauaugcagaagaaugaaacuagaccacuaucucuuaccauacacaaaaaucaaaucaaaauggaugaaaggcuuaaaucuaagaccucaaacuauaaaaccauuauaggaaaacaucagggaaacucuccaggacauuggucuggacaaaaauuuauugagcaguaccccacaagcacagguaaccaaagcaaaaaucaacaaacggaaucacaucaaguuaaaaagcaucugcacagcaaagaaaacaaucaacaaagugaagagacaacccacagaaugggagaaaauauuugaaagcuauccaucugauaagcgauuaauaaccagaauauauaaggagcuuaaacagcacuauaggaaaaaaaucuaauaaucugauuaaaaaaugggccaaagauuugaauagacauuucucaaaagaagacaugcaaauggcaaacaggcauauaaaaagguaucgacaucacugaucaucagagaaaugcaaaucaaaacuacaaugagguaucaucucaccucaguuaaaaugccuuuuaucccaaagacaggcaauaaccagugcugguaaggauguggagaaaagggaaccuucauacacuguuggugggaauguaaauuaguacaaccccuaugaagaacaguuuggagguuccucaaaagacuaaaaacagaacuaucaucagauccagcaaucccauugcuggguauacacccaaaagaaaggaaaucaggauacugaagagauauaugcauucccauguuuguugcagcccuguucacaauagcuaaaauuuggaagcaaccuaagugucuaucaacagaugaaugaauaaagaaaauaugauacauauacacaacagaauacuauucagccauaaaaaagaaugagauccugucauccgcaacaacauggauggaacuggagaucauuauaagugaaauaaggcacagaaagacaaacgacaaacauugcauguuuucacuuauuugugggagcuaaaaaucaaaacaauugaacucauggagauagcagaagcaugcuuaugagaggcugggaaggguagugggaggguggggaugguuaauggguacaaaaauauaguuagaaagaaugaauaagaccuaguguuugacagcacaacagggugacuacagucaauaauaauuuaauuauauauuuaaaaauaacgaguaucauuggauuguuugucacacuugaaggaguggauaccccauuuuacaugaugugauuauugcacauuuguaugcuuguaucacaguauuucauguaucccauaaauauauacaccuacuguguacccacagaaauugaagugugugugauagugacggucucugaaggugggaagugagacgguaggcagacuuacuuuuuaacuauaugccuuuuuaugcguuuugcauuuuuuacccugugcauguacuaucucuuuaaaaauaguuuuuagauaauuauaaauaaaaaauuaagagaaggccuuaugagagacauuguaaagacucaaauauaaagcagcuccuucuuuucugagggauaacuuuaaagagaaaccacauacuuccuaugaagacauauacaguauauacuggaaccuguagagggaggugcuaggugagauuauacgugcaccagcaucagcuaugauacguaugcagaaauauauugaguuagaugacuuuggugcagaaguuugcuuauuuggaguuaauuuacaaccaacgaaaaaaauaggguuuucccagguucagagagcaauucaggcucgcaguucugguuuggguuaaguaaacagaacucacccuuucugcuggcuuugagugaucaaguucaauacguguacuuuggauguucuuaaaguacugugucaucaaccugcuuugacaacuuuacauucacucuacauuuguagaucaggaacuuugaccugaauugaggucaugcuagcccuaguuuucuuucugcauauccagaaaauuaaccaugauaaugcucuuaagaucugauuuucuuacucaaaaauuaaauuaaaaugcuuucaaauuuuaaguuuuuccccuauaugucaagcuugcaaauaaugauccaguaguauuucugagaugugcgugcuuauacacauuccagaaauauccugcuuuuacaaaacuaaucucaucucuuuucuuuucuuccgaaaggauaugaucuggauucaauguucucacuguucuaauaauaugcauuuccaucauacaacaucuugaaaaauauuccaaucuuuuauguuugauauuuauaaccaacacaaaccccugguuuucuaaaaacaugguacaagaacagagauggguugguucucuucuuuuagaacacacaauguccuaucaaaaaccaacuccaucugaucuaaggagcagcagguggagaaaucacauacuacacagcggcuuuaaaugucagagucuggcucuugcauucuuuaagaugaauugcuuuuaaguucucuggcaccuuugcuggcauggaaguuaguaaaauuuccaaaaacaaaaucagaucaguggaauuagguuaaaaguuguuuuaugugaaaggauguagaauaaguuagggcagauuaaacaaagcagaugauaaaagaagacuuugagaaaaaucuauaauuugaaauugaacuuugaacuagacauguagauguagaucuaaucuggccaacuuuguaacacacugaaacucaagucaauugcaaucguuuuaucucuauauuugaaugacugucaugugugccugucacuaauuuagacuaucuccaguauucaaaguacuguuaguguugugcagacaaauugucugcugcugauuucacuuauuagugcaacuugcacaacaccagaagaagccggugcagccacccauguuuaccuggcucuuguuaccuugaggggggugugaagacagcuucagucaccauccuagcaacccuucccaauagacgaacccucgcaagggagcucaggguagcagagauccccauuccuccaagauaaaaacaugacaacaauuucccagugucuaaaguacagauuugacacgaauuaucucuuucuuuuauaauuaacuucuuccucaauaauuauuuuuaucaauuaugucuuuuuuuuuuuauuuuugagucagaaucuggcucuguggccuaggcuggacugcaguggugcaaucuugguucacuguaaacuccgccucuuggguucaagcaauucucuugccucagccuccugaguagcugggauuacaguagugcaccaccacgccuggcuaauuuuuguauuuuuaguagagacaggguuucaccauggucucgaacuccugaucucaagugauccgccugccucagccucccaaagugcugagauuauaggcauaagccaccgccaggccucaucaaucaucuugaucagccuggaaccaugaccaaauuucuccuagccugaaaaacaaugccccuugacuuugagggucgccuguagcuccaggcuauuucuuucauccuuuacagcauaguuccugagaagcaucugucuuuaacucuuggcucuaauuccuccuguggaggggaccucucaaacaauaauagaaaugacagcacuuucugcaugccugacacuuucuauauuaacucauuuaaugcucccauaaacccauuauguaaguaccuuuauuauucccauuuuacaguucucguuuuguuuauuauuuaccuugcuucggcaagcugagaaaagcaaagucagagguuuugguuauagaccuguuacaguacuauucagcauaacacagaaggacauccugucauuugcaacaacauggauggaacugaggucauuaugucaagcaaaagaaguagggcacagaaagacaaauaucacauguucucaccuauuuguggaaucuaaaaaucaaaacaauugaacucacaaagauagagagcagaaggaugguucugccaagucagaggacuugguuacagaccuggauaaaaaaagcguuggauaagaaaauaaaaagagcagcuuugugcuggggcaaccacugacuaugagaaaaagaugagccaaugcauagggccagcuccuagcaauucgccuuuaggaguaaguccggugggaggagguagcucucuccaggguggaugguuuggguugagugggccgauggaugccuccugcuuccuguggggcuggguccagaggccagagaggagcaaguuccaccuuggauggcuggagugaaggaaaauaccuugagagaagugaguuccugcuaaaugcuagugcugcugugggaaacaaugccuuaguuuuccacaaaagcaaaggcucugaacuagccaagcugcucuaagagcugcaauggccacugugucccucaccguccacauguccugcaacagaugacacucgggcuguuggggccaugaggcucgcagcucuacuucccuccccaccccccgcauccuuguacaugugcuucaaacaagccuggugauaggaguguuuacuuuggccuguguauaugacauaaagguuaugguaaacugucccucaucccauuauuccucuaaguaauuaaggucauccaagugucucccacacuucuucuaaccccacacuugccgaugucaccaaugccuuccugauucccaguccaguagacagguuuuauuccucacuuccugggacgcaguugaccacuuacuauuucuucuuguaacucugcugccuuggcgugugacacugcucucuccagcucucccugcaccccucugauuagucccuccaggucuccuuaguagguuugucuuucuggauccucucuuagaugccugugcuuugcagguucuguucuuggcccagcacccugugggcugcagguugucuucauuugaacuacuucucuaagcaguugucucucagaugaaaucuccccagcuguggucucuuccuuuuggauguccacaggcacuucagacuccauaugccuaaaacugaacucaucaucuaccucccaaaaauugccguucccugccccucagauccaugaucucaguucauggcacaacugcuaaccagcugcuccaagcagacacccaggagucagccuaugcuccuucuuccucgcccuucuccccacagccaaucggugacccuauuuuguuggugugaucucguguguauuuuuaaacucuuucccuccugucucuccccacuaucacugccugguuuaggcaccccucgccuuucgccuggucucucucccucuagccagagugaccauauuaagugcaaacccagucaugccccaacccugcucaaaauccuucaauggcucccaucaagaacagaagaaaggccaagccucucgacauggcccagggagccuccaugacacaauccuaccuucuuccucucccgccucccucuaccuugcauuuucucucuagcaauacucuuguguugguggcuucccagcacacagugugcugguucaugccuccgugccuucacccucacugcuacgcaauuccucgccuucccaacuuucuucucauagccccuccugcagcgagucucucgugaacccugaagggcccuuccucugggcucccacauuacuuagagucuacagcucucuauucacuuacuauauuauuuagaaacuauuaauaugucugucuccagcacuaaacuacaaguuucuuaagagcaaagacccugcauuauucaucuuuauaccucuaguggcaagcagguuccuggcacaugacaggcguuucauacagaacuguuggaaggaacuaccagucaguguggaagucuuuccuugcugcugagagggaaggaguccuuccaccuauaugacuaucaaugauuuuauccacaaucacacacacacacuccaucuagcaugcaccggggcaaacuggccagcaccucacgcaucacagggucacccucuuccuggugggcagcagcuugaucuagagaguuccgggcaaaaggguggagaaugaccuugagaugugauucagacgagggaugacuuggagaggaugaaagcaguucuuguaagaaucucuggauaaacaugcacagauuucaaaagaacuguuccuugcugggcgcggugacucacaccuguaaccccagcacuuugggaggccaaggugggcggaucaccugaggucaggaguucaagaccagccuggccaauguggugaaaccucgucuccccuaaaaacacaaaaauuagcugggcgugguggcgcaugccuguagucccagcuacucuggaggcugaggcaggagaauugcuugaaccugggaggcagagguugcagugagcugagauugcgccacugcacuccagccugggugacagagugagaccccaucucacaaaaaaaaaaaaaaaaaaaaaaagaagaagaagaaaaacaacuguauuuugacauugucaaucagaauucugguuguuuaguggcuuauuucuacuuucuccuuaugaacucagguaguguaauuucauugaggacagaaagcuuuuuuaaaagacauaacugcagaaaggaagaccaaugaaacuaggggaaaugcauaugccuauuaaaaacuguguuaaaugcuugaguuuccuaagauguccuaagagauuuacuugucaugcauagaacggguuugcucauuaguaaguauuuuaucugucauuucauuucuuccuugggauuuaagggaugaggagacagcaggguuuuguuuuuuauuaaugguugucucaccugccucagggugccucagcagcuucucuugguucucuugguucagcuauuucauuacuugagcaacaugcauuugaaauguauuuuggugcugagaccagcuuuauaaacggagacuugcucuucuuaacaccgucauuuaaugaugaagucuucauuuccuuaaaaauaacuuggucugggcugggcacaguggcucaugccuguaaucccagcacuuugggaggccgaggcaggcggaucaccugagguugggaguucgagaccagccuggccaacauggugaaaccccaucucuacuaaaaauacaaaauuagcugggcgugguggcacgcgccuauaaucccagcuacuucggaggcugaggcaggagaauugcuugaaccugggaggcauagguugcagugagccgaguuugcaccauugcacuccagccugggcaacaagagcgaaacucugucucaaagaaaaaaaaaaaaaucaaguugguaauggguauugcccuuugaaaggucagcaaugaguagaaaccuuugaaaaaucucuuuuucaacccguaagucuucugugggguggucccaggauauccccuggggcagaauaaaggcuuugcacuucugccauacuggcugcuaccucucccuuuccucuggccuuuccaugcacucuuucuccuucucuuuugacauccuuguucugacauguucuuguccucuccuuuccuuccucuucuuccggugccuuccuuuggagccaaggguugcugaaccuucugcccucuuggcaguggugagcuuguggggccugggcgggcucacuucacuuccuccccucccucauugugcucuccaccggcaccccuuggggcuucagaagauagggucagacaaaaagaaagggcagaggaggggcaagggcggggcucugccuuucccuaccagucuggcuccaggaggcaucaaagagcccaggaaaucacugccagagaacuaaggaaguguggcucauaaaacgcagggugauuguggaaagcaccaggcaacaggagcaggaucuuaagucucugcucauaccccauaugaucuuuagcaaauuucuuuccuacucagaguugcagcuuucugcucuguugagauuacaugcagcuccuaugaaaccguggacgagaaacugcuuaguaagccacgaagcaccgugucaauguauggcauugucaucaacccuucauucagccaucauuagugaauacaugcuuacuaaugacugccuggucccugucacccuuuuuccccaucuccuuuccuggagaucuuccaauuuaaagaggccuuaggugucagcaguuacauucucaauggccagguuucuucuccagccaccggguuuguuggaaaggauaccuagugucaccaggacugaaugguaauaauaaggugaaaauaagugugcucuaagaaaagacuccuuugccugucacaguuauagaauuaaaauucuuauaaguggauuuacugaccaucaaauuugcuacuuuccuucauuaaauuguuaaagguaucuucauguuguaaucgaacuuuccuucucucagcagccagauuauguuccacaugaucuuguucaguuagaagugugacugguuuuaaaugaaucuagagaaagaaaagcauuuaucuuuuauugccuuguuaaauuauaaaagcacagcaugaauuuugcaaaacaaaugauaugcuacaugguuuucuaacucaaguaaauagagcuuuuaugaguguuuucacuaaacauguuaugacuaaauuuuuucuuaaauuauuuuuaaacuaaaaaaaucaacauaggcguaauuauuucuucaugcaauaagauaugugcuuuaaaaauucucucuauuauuuucccugauuuuaaaauuuuucaacagaacuacaaaauaagaaauuauucauauugaugaaugaggagauggacuuugacuccacugaaaucuaaacauuuccuaucuuugcaaaauuaagaaagcaaagagagggaauaaauuuugcaaaauuaagaaagcaaagagagggaauaaagauguucuagagaaaguuaucuuauaccaugauaccaauuuggaaauuucauuacauggugaaaacauuaucuaauaagcaaaacaaaagaaucaauauguaggaauaaagcuuucaccaacuuccagaaaccuggaaauaugaggcaacagaaccaagagcucaaauucuuacauaaaugcccuuugcugacccuguguguagaaggaagggucaccuugaagcuggacugggguagcuccaugcuuguuuccaagauacucaaagucugguacggacccuuggccaagauaaggaugaaauaagcuagugaucccugggugugguggcucacaccuauaaucccagcacuuuguggggcugaggugggugaaucacuugaggucagguguucaagauuauaggugugagccacugcaccuggccaacacguugaaacacugucuguacuaaaaauacaaaaaguaaccggguaugguggagcacaccuguaaucccagcuacuuaggaggcugaggcacaagaaucgcuugaacccaggagaaggagguugcagugagccaagaucaugccacugcacuccagccugggagacagagugagacuccaucucaaaaaaaaaaaaaaaaaaaaaagaaauaagaaauaagcuggugauuuauaauaugcugcuuaaaguccaaaacugcccuggacuaccuuguggaauuugguuaggaauguguagauugauggcaugcacugguuuaacuccuuuuuuuuuuuugaaacagggucucacucuguugcccaggcuggagcacagugguguaaucauagcuuccuguaaccucaaacucuugggcucaagggauccucucaguaggauugcaggcaaacgucacuaugccuggcuaauuuuuuuauauuuauuuuuuguagagaugagggcucacuauguugcccaggcuggucucaaacuucuggccucaagcaauccuuccuucucagccucccaaagcacucagauuauaagugugagccacugcacccagccugauuuaacaauuuuuguaguguuguuuuaguugugugacuagcaggguauacaagacugcuugguaaacuuguguguugguucuccugaaaccaagauaccucgcauauguuuuggugauuucuguucugcagaaguacaucuuguguuacuaaggccccagcagcauggcugugccuggagaccuccacccucucugaggcuggccugugcuugcuuucucccuccgcaccaucugcuuuagcuuaguaaggcuuugcaugaguguacccuguggagucuugcaagucccuucaaugaucuggccugugcaauuguugaacuaagucugguuaaucauugccaauuucuuuuuuguuuuuuaaucaggguacauuaugcuuugaaccaacuucauccuaaaauaaacucacugugaacagaaauucaaguaguccuauggguucaaaccaaaccacugauuuuucaugggucucuuugugaugagcugcugaaccagcauauuagcaacuaggaaauaaguuagucuggaaaggugcuuuacaauuaagguuaucugaaccaaccaauuauguuagcaccauaauggaucugauuuuccacuuucagaacccaguucuccagucucaagagagauuggacugaagugugacuauuauauucuuuuuuuuuuuuuuuuuuugagacggaguuuugcucuuguugcccaggcuggagugcaauggcacaaucuuggcucaccgcaacuucugccucccagguucaagugagucuccugucucagcuucccaaguagcugggauuauaggcaugcaccaccacgcccaguuaauuuuuguauuuuuaguagagaggggguuucuccauguuggccaggcuggucuugaacuccugaccucaggugauccacccgccucagccucccaaauugcugggauuacaggcaugagccaccaugcucggccgacuauuauauucuuauuccacacguccaugaaguuggagggagaagucugaggcuggagggggaauaugacggucuuccucugcugccccucgcaaaggaaugggauugcaagguguauuccuuugucacuugcgcucagauacgggcaccugcacccauccccuauucucucacuuccaagagucuggagauuuguggggaugccaggaaaaacagaaugguugggaagacuaucucagugucucagauuuuagugaacacaggcuccgugggaugcuuuggcaaaguacagauuccaagauuccacacuagugauucuaauuuaguagguccaugauauggcccagaaaacugcauuuuaaaaaauagaauuagcugauaugaacuuccauuugaaaaauaacacccuugggcaauaugaauuugccuugcaacauguuuaauguuagacugagagugcaggccaggcuccauagcucacaccucagaacuuugggagaucaaggcaggcagaucaccuguggucaggagcuugagaccaaccugaccaacaugacuccuccuugcuucagaguagagcuaggagaagccacugugucuagcucugggaugauccuuggagugaaagacucauauuccagauugaauuaucacaguguuuagacuaaaugggacccuccuccaggcacccugacacugaaaaaaaaaagccaagaaauuguaaggagcaaaucuccagcagccuccagaugaguggaucuggaucguguccaggcagccggcuaggcaagcucaucaggccaaaguaucacuucggaggguguuuucaccccacaugcccagaagcuuauuuuuaaacuucaauaacucagcaauguugacaguuuuccuucagguauuaacagugguuaaucuauaacaugcaacugcuugcuaaauugcucuugcuuuuuuaaaaaaagauuuuauuuuaagucaauuuugaguuauaugaccacaaaugaaaagcacuaaaccaguaggcaguauuuuaaagaaaccaauaugaccuucagaucauuuaaaacaauguggauuuuuuuuuguauuuuacaaacuuucuauaucgucuuuucucuaagguacuuuucuguaaaguuccuauuccucugauguuaccacagagugauaacuuuugcaauaaauauuggugaauaacaaaucuuggggaaguauaucucauggaaagaagaagugucauuuuuuucuauaacauucugaugcaauuguuacuaugucccugaauuacaugcuagauacaucuucacauacaaaauuuaccuuuucuuuuccaacugguuuggcuacaaauguggagaaagccacacuaacaagcuucucaaugccagugagcauauccuguaccaugaccuugauacugaucuaaaaugaaaaaaagauaaauaaauacacucuuggccaguucagauuucagcauucaaaauuuagucauauguaugcaccauuaccuucuuucauuuuaaaaaugaaaccagaauuuuaauuuauuuuuaagcaauagaauuauuucaaugauguucuauaacacuggacaauuagcuuuuuucugauuauaaaaauuauuuauuuaccaugucaaauuuauggaaucugacuauccagaguauauauuaucaguaaucccaucacccagagauaauaauuauuaaauuuuaggugaauuuucuucuagcuuuuucuauauaucauauaugauauauaaguguauaugauauauaugaugucauauaugauauauaauauauacacauacauaucacauaauacauacacauauauaauaucauauuacauaauauauacacacauuuuauauuacauacauaugacaugaaauacguguguguauauaugcauguguauauaaaauuauuguaauguauuuacaguuuuauguucuaauuuuuuuuuuuuguuuugagacggagucuugcucuguugccaggcuggagugcaguggcacgaucuuggcucacugcaaccuccaccucccggguucaagccauucucuugccucagccuccggaguagcugggacuacaggcacgcagcacuacacccagcuaauuuuuuguauuuuuaguacagacaagauuucaccauguuggccaggauggucucgaucucaugaccucaugauccacccacuucggccucccaaagugcugggauuacaggggugagccacugcaccuggccuguuccaauuuuuaaaaauuuggcauuauaugaaagcucuuuuaaauuucaugauuacuaaauaugcuuuugaaaacaagauauuggugucugccuuauaaaaccaccagagagauguaccauaacuuuuuuuagccuuuacucucagaguuuuuuuuccuuuuuuuaaaugucucuaggcagcauagucucagaguuucauaaccaagcuaacacggacagaauugcaucauguauuuacagcuuuguuucugugauuaauuuuucaggaguaauaagaagguagcugagacacuuuauguugauacuaaaaugggcuagauuucccccugugugaagagcgcugaagcuugguccucaggauugcacuucgcagaaguguugguaaacucagguacuugucuuuagauucuggcuaauaaaccuuuucccuacauauuucagaugaguaauacuaucuucugaaaauaaugagcuaucucaggcacagcucagcacuauguuaucaacgauaaagaauauccguaucuguaucuuuacuguguacaccauguaaaaagaauaaucaauaaucuaugacucauuuuaagucacucaauucauaaaugcaaauuaguauuuacaugguaaauccuaaauuaacuagaugaugauuagccaaaauuaaacuaucuauucccaacucucaacccucaaucccacacagcuuucugcuuuuagagaaauggacaaaugaaaaauaaaauaaaauaccuaacaguaaaaacaaagcaacaauucuggaguguuaaaauaaguucuaaacacugucuucuacuagaagaguuaacuuaguuauaugugauuaccaaauguuucaaaaacauaugccagggagaauuucauuguguuauaagagauuagguaagauuggaauuacauccugugaaaacaacuagaaaacuggacaaaauauaggaagcaucuacuuucacaccuacgaaaauaggcaacacaggacugugauccccaaggcgggaaaaacaacgagagcacugcguucccagguucucaggcugaagguaauuuacgguuagguuagagaagaaaaaccuaacucugcugaauugaauggagcuaaaauuuguggguuagaguaccagagaaggaaacuaaaaaaaaagagaaagaauuccagaaauaugccugugagucuuuggguugauacuaacuggaccauauacagggugaaaccccagacaagaacagcuucugaggaacaagcaauuccugggaaacuguaacauggacaauuccaagaacucacacacagcuggggaucuuuugaguucucuccagccagauuucacugaauauauaacaccuucauagacauaacagaagaucccaacuuagaagaggggcuaaaguagcccuaaaguagaguauucuaaaucuuccauagaagaguuuaaaacguaucuuuaaaggcucaaaccaaucugcaaguaacaacaucuuccugccaggaaaagucugacacucuuuuuaaagaaauauaacaaaagccagcacuaaacaauauaaaauucacaauguucagcaucgaguaaaaaauauuagaugcaagaaaauuauuaggugaaagguaauauaaauaaaacaacagauaacagaaaugauggaauaacaacaaaggauacuaaaacaacaauuaaauauaagcaccaugaacucagagauuuggaaaaggagucagcaauaucuucuuaaaggauaaggccagauaguaaauauuuuaaguuuuguggucacauggacucuauugccacuacucaacucugucaauguacugugauagcaaacacagacaaaacauaaauuaauggguguacuacaaaaaauuuuuauucauaaaaacaggucuauaggccauaguuugcugacuccuaauauagagaaaaagaugaaaauaaugaggaaagaacggaaaauauaaaaaaaucaaaguggacuuucuaagguaaaaaaauacaacaucugaaauaaaaaacaaaccagauaagauuaacagcaguuuaguuaaugcaggggaaaaagucagugaagcugaagaugacaaaagaagcuacacagaauguagcaugaagagaaaggaagacugaaagaagaaaaacgaacaguaucagugacccguggaacacuaacaagaagucuaaaacucuauaaaguccaaaaggagagagagcacaaaagacaggaaaaaaguuugaagauauaauagcugaaaaaauccacauuucuuagaaacuauaaauccauagauccaguagcucuagaaacccaagccauaucauaauuuacauaagucugcugccaggcuagaauucuauaccuacugaauaugagcaucuuuuaaauaugaagaugaaacaaacacauuuuuacacgaacaaaagcugaaaaagaaaugcuaaaggaauaucuucagacagaaggaaaaugacacuagggagacaucuggagauacacaauacgcaaaagaauaaagaacaccagaaauggcaaauauguggguauauauauaaaauacuucuuuucauuucuauucuuuuuaaaagaugauugacuguuuaaaacauaaauaauaacuauguauuguaggguuuaccuccuacauaugugcauguaaaaggcaugacaauaacggcacaaaggcugggacaugggaagggaaguguguguacuguuauaagguuauuacacuauacucaaagggauauuauauuauucgaagguagucucagauaaguuaaguagucauauugcaaacccgagaaaaacauuaaaaccaaaacaaauauguauaguuaaaacaccaacaguggagauaaaauggauuacuaaaaauuacucugcucuaaaaaaugcaggaaaagauggggacaggaagaaacaaagaacagauggaagaaauagaagacaaacagccagaugauagauuucaacucuaccauauagauaaucaaauguaaauaguuuaaauacuccagguagaaggcagagauuguuagaauaaauaaaaaaauagcauccaaauauauucuguuuauaagaaacccacuuacauguacaaaaagacagguuaagagaaaaaugauggggaaaaaaacacuaaaccaaagaaagcuugucuggcuaaauuaaugucagacaaaguagauuuuaaaacaaaaaccagagauaaaaaggcaaacuucauaaugauaaaagggucacaacaucaggaagaguuaagaauccuggcagggcacgguggcucaugccuguaaucccagcacuuugggaggccaaggugaacagaucaccugaggucaggaguucaagaccagccuggccaacauggugaaauccuuucucuacuaaaaauacaaaaauuagcugggcgugguggugcacauguguaaucccagcuauuugagaggcugaggcaagagaaucacuugaacccgggaggcggagcuugcagggagccaagaucgcaccaccgcacuacagccugggagacaguucaagacuccaucucaaaaaauaauaauaauaauaauacagaagacuugaacaacacugugaaccaaguuaggcuaacugacaucugcagaauacuucauugacuauaagcaacacauucuuuucaagcacauauagaacauucaccaaaauaguccauauuuugggucauuaaaaaagucuaaauaaauuuaaaauaauugaaauuauacaaauuauguucucucucugcaaaggaauuaaauuauaaaucaaaaacauaaagauguaucuggaaaaaucaucagagauuuggaaauuaaacaacacacaucuagacagacuagaggucagggaagaauuuacaagaaaaaaaggacauauuuugaugcagguaaagcaauauauugaagaaaauuuuacgaucuuaaaugcuuauauuugaaaaaaagaaaaguuuaaucaauuucccaagauucuaccuuaagacacuagaaaaagaaaggcaaauuaaacccaaaauaaauagaaugagaauaauauaauaaccaacagcagaaaucaaauauauuaugcuaaguaaaauaaauuagacacaaaaauuauauauacuauaucauuccauuuauacaaaauacaguaaagggcaaaaaagaaaaaaaaaaggguacugaccugaaguaaaugagugguugucacaagcuggggucugagagagcugauugcaaaggggcauaaaggggcuucguguagugaugggaacguuguauauuacagugguggugauccaacuguauaacuuugucaaagcucagcaaaauguauacuuaaaaugggagaauuuuaauguuguaaauuauaucucaauaaaacugauucuuaaagacauauucuaaggacaaaaaaaaaaaaacucacacucauauaaugugcucuuagugcaaaugagacaauaucaucuauuaauaguaaugcaucacacaccuuccagaggugggaagagggaagagacugaucaguagagucugagaauccccuggaaguagguuuggcacagagcagaguuccugcuugcuuuggauucagggagaagucagucauuuauuucugcucagcaaauuagcagagggcuggccucaguuguggcaggaaacugaaauugaacaggaagacgcuaaaggacauguccaguuugaaaaaguaaaaauaaaaauguuuaguuggcaucuauauuuaaggaaaaaaauccaagaaauuucuaccaggugguagaaaguaugacaaaauuuagaggcugccuggucaugauuugcagaagaugaaagagaacaaaauucugcacggcggaucaggccuggaaagucaguggaggcuaggguuuacuuuccccagcaucagaaaucugugguuucaaacucacuggguuuuacuuuuguuuucuuagcuuuuagauaagccuccuuuagaaauucuagccugucuuagggaagaggaggaaaaggagaaauguaaaggagguuuuaucuauauuuggacugucuaucaggagaauguguggcccucaggagacaggccaagcccagaggcuccugugugcaaaggcuaagagccccacaguugaauaaacgcuccagaaacaccauuugcugacagagcuuguuuucuucacgacauuuccuuucugcuuucuucaagugcuuuguauucugcuuauuuggauacugcuagaaagugaacacaucagccaggcacaguagcucacgccugugaucgauccuagcacuuugggaggccaaggugggcagaucaugaggucagaagauugagaucauccuggccaacauggugaaaccccaucucuacuaaaaauacaaaaauuagugguggcaugcaccuguaaucccagcuacucgggaggcugaggcaggagaaucacuugaacccaggaggcggagguugccgugagccgagaucuugccauugcacuccagccuggcaacagagugaggcucugucucaaaaacaaaagcaaaaacaaaaaaaaagaaagugaccacaucaggguaaagccaccaccaauggcaugguuacugucaaaacaguuguuauaacugaacuguguucccccuuccaaauucuuauguccuaacccccaguaccuuagaauguaaauguggaaauagcacuguugcagauguaauuaguuaagaugaggccagacugcgguggggcaggccccuaauccaauaugaccgauaucuuuauaaaaaggggaaauuuggaagcagacacccacacaaggagaacacgugaagaugaaggcagagaucgggugaugcaguggaagccaagaaauaccaaagacuacagagagccaugggaggguaggagagcagcaugaacagauuaucccuccagcccucagagaaaccauccuugcccauauuuugauguaggacuucuagcucccagaaccgugggacacuacuuuucuguguuuaggccacccagucuguggugcuuuguuacggcagcccuaacaaaugaauacaaacucuuccaugucuucaugcccagagauugaagggacugauccugagcaaccugggagguacaauaugagauccagcaacuccuuuccugcuaauuuaaccugaauggagaucucaagagccccugagaauccaguauucacaaugguagagaaaauaaaaucaaguggaugcagaauaaaaaucuucuaaauuuaccuucuuacuaaaguccaguuauccugcuuuuaaaaaacuaguuaaucaugggacuaguuucugucagagguugaggggauggagaacaaacagaauuagaauaauaguagagucagcauaauuaagaaauaaaaaccaugcuuuauaaagaauuaagacuguccuuuucucuugcagguuuacuuucuguauauccuucuauguagaaauaguguacuguaucauguuuaaauguguugguuuuuuuuguuguuguuguuucuuaagagacaaagucuugcuaugucacccaggcuggaauguugugguacaaucaaagcucauuguagccucaaacuccugggcucaagcaauccgcccaccuccgucuccugaguacccagggcuacaggcacuuaccacugugcuggcuaauuuuuuuuuuucuucuuaaagauugggucuugcuaucuugcccaggcugguguggaacuccuggucucaagugaucuuccugucucagccucucaaagugcugggauuauaggugugagcuaccaugccuggccauguugaauuuuagcugggaaacaguggaaacaucugcugcuuauuauuuaccugugaccugacuacacauuccagagccuucugaaauagagaaucucacuaacuccaaauauuagucuaggccuccugcucuacccuuuguaaacaaugaagaagugagcaccaacaggcagauguuugaaaaggugccucuuaccuccaugcuugugcugaaugcucuaguaacuuuugcuuugaugguuauaacuuguccaacucuagggaaaaacaaacaaaaaaaccucaguaguuuuagcacauuucauuucagauaagacuuaaagauuacuuaaaugcaugccauaaagcaguuccaccuuaucaugcugauaauuuucaugcaugcgaaauucagguuaaugauaauggaaaaagacaacacuuaaaaacaaaggccgauaacuguaaaccacacuuaugguguuagcggaccaccaauauuuaaacagaaaagagacuuugcagagauagugugcgacaugacuccaaaucggcaacacauacugacuauacagcagcuguuuccccaagagaaguuaaggaaaauacaccagcaaaucuauacagcugguauuuauuuuugaauguuaguuaauacauaaauggacaaauauacaaaaaggcaagcaagcaaacugaucagcuucaguagguuuguaugggcccucaaugaugcuagguggucuacucacuuccuacuauuauugaaacuucgaucauguaaccugaaguuguuccaaaacuuuuguauucaggcccuucagucagcucuaauuccuuccccuuagcagaagguaagagguaacccaauagaagcccccuggauuuuucuuccuuaacuucaauguuaaacugcauuugcaccuuucucuuugcucuucuguuucagggaaagagggaucucuugagaccuaaucucuuucuuuaccugugccauuggucccauccuccaguggcccuguccccucccuuguuggcucugccucaucagcucuguucucuuuucugccuucaaucucugccucuucccugaaucuccaucagucuaugacaaugcucaaagcuucuccuuucuaaaauuuuucucucaaaccuauucuaucucaaguugcuuuucuuuucuucaauucaaacuuccuaaaaacaucguuuauuuuucugacuuauacauuucacuaauguuuacugaguuaauuggcauuuuacugaguaguccuggcauuaagccaggucuaaagauacagugaugaauaagacaaaacuacugacuucaaggagaccaaucuuuccuugggaugcugggauguaaauagauaaagcccaaaagauuaccaaggaauuauugauaauucauuaacaauaaaaaaucccugucauuaauuaaaugaaauuuaauguuucucaguguggccauacuaauaacaaugacuacucucuacugaauguuguguguaaaucaggcaccaugggauuugcuggcaagauggccgaacaggagcagcuccagucugcagcuaucagcgagaucgaugcagaaggggggugauuuuucugcauuuccaaaugagguacccaguucaucucauugagacugguuggacagugggugcagcccauggagggugagccgaagcaaggugggucaucacccuaccagggaagugcaaggggucaggggauuucccuccccuagccaagggaagccaugaaggacugugcugugaggaauggugcacucuggcccagauacugagcuuuucccauggucuuugcaacccgcagaccaggagauucccuccggugccuaggccaucaggacccuggguuucaagcacaaaacugggcggccauuuggggagacaccgagcuagcugcaggaguguuuuuuucauaccccagugguaccuggaacaccagcaagacaaaaccauucauuccccuggaaagggggcugaagccagggagccgaguggucuggcuuggcgggucccacgcucacggagcccagcaagccaagauccacuggcuugaaauucucgcugccagcacagcagucugagaucaaacuaggaugcucgagcuuggugaggggaggggcguccaccauugcugaggcuugaguaggcaguuuuacccuuacaguguaaacaaagccaccaggaaguucaaagugagcaaagcccaccacagcucagcaaggcugcucuggccagacugccucucuagauuccuccucucugggcagggcaucucugaaaaaaaggcagcaucucccugggacagagcacaugggggaagggguggcuaugggcgcagcuucagcagacuuaaaugucccugccugauggcucugaagacagcagcagaucucccagcacagcguccgagcucugauaagggacuacacugccuccugaagugggucccagacccccguguauccugacugggagacaccucccaguaggggccgacagacaccucauacaggauagcucuggcuggcaucuggcaggugccccuaugggacaaagcuuccagaggaaggaacaggagggaaucuuugcuguucugcagccucugcugggaauaccuaggcaaacagggucuggagugggccuccagcaaacuccagcagaccugcagcagaugggccugacuguuagaaggaagacuaacaaacagaaaggaauagcaucaacaucaacaaaaaggacauccacucagagaccucaucugaaggucaccagcaucaaagaccaaagguagauaaacccaugaagauggggagaaaacagcgcaaaaaggcugaaaauuccaaaaaccagaaugccucuucuccuucaaaggaucacaacuccgugccaggaagggaaaaaaacuggauggagaaugaguuugaugaauugacagaagaaggcuucagaagguagguaauaacaaacuccuccaagcuaaaggagcauguucuaacccaaugaaaggaagcuaagaaccuugaaaaaagguuagaggaauugcuaacuagaauaaccaguuuagagaggaacauaaaugaccugauggagcugaaaaacacagcacgagaacuucaugaagcauaaacaaguaucaauagcugaaucaaucaggcagaagaaaggauaucagagauugaagaucaacuuaaugaaauaaagugagaaacaagauaagagagaaaagaaugaaaauaaacaaacaaagccuccaagaaauauaguacuaugugaaaagacuaaaucuacguugguuugguauacuugaaagugauggggagaauggaaccaagucggaaaacacucuucaggauauuauccaggagaacuuccccaaccuagcaagacaggccaacacucaaauucaggaaacacagagaauaccacaaagguacuucuugagaagagcaacccuaagacacauaauugucagauucaccaagguugaaaugaaggaaaaaauguuaagggcagccagagagaaaggucagguuacccacaaagggaagcccaucagacuaacagcggaucucucugcagaaacccugcaagccagaagagaguggcggccaauauucaacauucuuaaagaaaagaauuuucaacccggaauuucauauccaggcaaacuaagcuucauaagcgaagcagaaauaaaauccuuuacaggcaggcaaaugcugagagacacugucacccccagggcugccuuacgagagcuccugaaggaagcaccaaacauggaaaggaacaaccgguaccagccacuccaaaaacauaucaaauuguaaagaccauugacacuaugaggaaacugcaucaacuaacaggcaaaagaaucagcuaguaucauaaugacaggaucaaauucacacauaacaauauuaaccuuaaauguaaacaggcuaaaugccccaauuaaaagacagacuggcaaauuggauagagucaagacuuaucagugugcuguauucaggagacccaucucccgugcaaagacauacauaggcucaaaauaaagggauggaggaauauuuaccaagcaaauggaaagaaaaaaaaaaaagcagggguugcauccuaguuucugauaaaacagacuuuaaaccaacaaagaucaaaagagacaaagaaggacauuacauacugguaaagggaucaauucaacaagaagaguaacuauccuaaauauauaugcacccaauacaggagcacccagauucauagagaaaguucuuagagaccuacaaagagacuuagacucccacacaauaauagugggagacuuuaacacuccacugucaauauuagacagaucaaugagacagaaaauuaacaaggauauucagaacuugaacucagcucuggaccaaacagacuuaauagacaccuacaaaacucuccaccccaaaugaacagaauauacauucuucucagcaccacaaagugcuuauucuaaaaucgaccacauaauuggagguaaaacacuccucagcaaaugcaaaagaacggaaaucauaacaaacagucucucagaccacagugcaaucaaauuagaacucaggauuaagaaacucacucaaaaccacacaacuacauggaaacugaacaaccugcuccugaaugacuacuggguaaauaaugaaaugaaggcagaaauaaauaaguuauuugaaaccaaugagaacaaagacacaauguaccagaauaucugggacauauuuaaagcaguguguagagagaaauuuauagcacugaaugcccagaagagaaagcaggaaagauccaaaaucaacacccuaacaucacaauuaaaagaacaagagaagcaagagcaaaaaaauucaaaagcaagcagaagacaauaaauaacuaagaucagagcagaacugaaggagauagagacaugaaaacccuucaaaaaagucaaugaauccagaagcuguuuuucugaaaacgucagcaaauagauagaccccuauccggacuaauaaagaagaaaagagagaagaaccaaauagacacaauaaaaaaugauaaagaggauaucaucacugaucucacagaaauacaaacuaauaucagagaauacuacaaacaccucuacgcaaauaaacuagaaaaucuagaagaaauggauaaauuccuggacacauaaacccucccaagacuaaacuaggaagaagucgaaucucugaauagaccaaugacaaguucugaaauugaggcaguaauuaauagccuaccaaccaaaaaaaguccaggcccagauggauucacagccgaauuauaccagagguacaaagaggagcugguaccauuccuucugaaacaauuucaaacaacagaaaaagagggacuccucucuaacucauucugugaggccagcaucauccugauaccaagaccuggcagagacacaauaaaaaaagaaaauuucagggcaauaucccugaugaacaucgaugcgaaaauccucaauaaaauacuggcaaaccgaauccagcagcacaucaaaaagcuuauccaccacaaucaagucagcuucaucccugggaugcaaggcugguucaacauacacaaaucaauaaacauaauucaucacauaaacagaaccgaugacaaaaaccacauaauugucucaauacaugcagaaaaggccuucaacaaaauucaacaauccauucaugcuaaaaauucucaauaaacugauauugauggaacguaucucaaaauaauaagagcuauuuaugagaaacccacagccaauauaauacugaauggggaaaagcuggaagcauucccuuugaaaacuggcauaagacaaggaugcgcucucucaccacuccuauucaacauaguguuggaaguucuggccaggacaauccggcaagagaaagaaagaaaggguauucaaauaggaaaagaggaagucaaauugucucuguuugcaaauuacaugauuguauauuuagaaaaccccaucuucucagcucaaaaucuccuuaagcugauaagcaacuucagcaaagucucaagauacaaaaucaaugugcaaaaaucacaagcauucuuauacaccaauaacagacaaacagccaaaucaugagugaacucccauucaccauugcuucaaagagaauaaaauaccuaggaauccaacuuacaagggaugugaaggaccucuucaaggagaacaacaaaccacugcucaaggaaauaagacaggacacaaacaaaugggaaaauauucccugcucauggauaggaagaaucaguaucaugaaaauggccauacugcccaaaguaauuuauagauucaaugcuauccccaugaagcuaccauugacuuucuucacagaauuggauaaacuacuuuaaauuuuauauggaaccaaaaaagagccugaauagccaagacaauccuaagcaaaaagaauaaagcuggaggcaucaugcuaccugacuucaaacuauacuacaaggcuacagucaccaaaacagcaugguacugguaccaaaacagauauauagaccaauggaacagaacagaggcuucagaaauaacaccacacaucuacaaccaucugaccuuugacaaaccugacaaaaacaagcaauggagaaaggauucucuauuuaauaaauggcguuaggaaaacuggcuagccauaugcagaaaacugaaauuggaucccuuccuuacaccuuauacaaaaauuaacucaagauggauuaaagacuuaaagguaagaccuaaaaccauaaaaauccuagaaaaaaaccuaggcaauaccauucaggacauaggcgugggcaaagacuucaugacuaaaacaccaaaagcaauggcaacaaaagccaaaauagacaaaugggaucuaauuaaacuaaagaguuucugccaagcaaaagaaacuaucaucagacugaacaggcaaccuacagaaugggagaaaauuucuacaaucuauccaucugacaaagggcuaauaucgagaaucuacaaagaacuuaaacaaauuuacaagaaaaaaacaaccccaucaaaaagugggcggaggauaugaacagauacuucucaaaagaagauauuuaugcugccaacaaacauaagaaaaaaagcucaucaucacugguuauuagagaaaugcaaaucaaaaccacaaugagauuccaucucacgccaguuacaaugacaaucauuaaaaagucaggaaacaacagaugcuggacaguacauggggaaauaacgcuuuuacauuguuggugggaguguaaauuaguucaaccauuguggaagacaacguggcgauuccucaaggaucuagaacuagaaauaccauuugacccagcaaucccauuacugguuauauacccaaaggauuauaaaucauucuacuauaaagacacaugaacacguauauuuauuguggcacuguucacaauagcaaagacuuggaaccaacccaaaugcccaucaaugauagacuggauaaagaaaauguggcacauauacaccauguaauacuaugcagccauaaaaaaggaugaguucauguccuuugcagggacauugaugaagcuggaaaccgucauucucagcaaacuaacacaagaacagaaaaccaaacaccgcauguucucacuuguaagugggaguugaacaaugagaacacauggacaaagggaggggaacaucacacacgggggucugucaggggguggggggcuaggggagggauaguauuaggagaaauaccuaauguugauaauggguugaugggugcagcaaaccaccauggcacguguauaccuauguaacaaaccugcacguucugcacauguaccccagaacuuaaaguacaauaauaauaaaaaaaaaagcaccaugcuaaacgcuuuguaucauaaucuaacaacacgucauucacugagcaguaaccccaugaggugggcauuaucauucccauuucauucccaucaggaaacggccuuagaaggugacauagugacuggcaggaucagaguucaaacccuggucuuaucuggcuccaaagcuuugacgacauuacccuacucagguuucugguaaauaauugcaauucauacuauuuuaaucauaguagagaggcuuguucagauauacauaucucacucugucacccaggcuagagugcagugguucaaucauggcucacuggagccuuaaauuccuggggucaagcgaucuuccugcguuggacucccaaagugcugggauacagcaugagccagugcaucuggcccagauauauuaaagacagucuacaagaugaaccaguuggguuuaccuagaagagugacugcaucugguuaaagccuuugcacacauauuguuacucuacauaccugucauaaucuguagcauuuuuuggcagaaaaacuggagguaaagaguuuaauaauacauacauauguauauuuauuuaagcaauuaauuccuauauuagaaaucugaacaaauuuaaauuucuggcacaguuuuauuaacccuuaauuuuauaaguuugaaaacugauaaaaccuacauaacaacugcucuggagaggaauuuggcaauguuuaauaaaaugacauaugcauuuacccuuugacucagcaauccuauuucuagaaaucuaucccacaaaggccaggcaugguggcucacaccuguaaucccagcacuuugggagggugaggcagguggaucaccugaggucaggaguuugagaccagccuggccaacauggcaaagcccugucucuacuaaaaauucaaaaauuagcugugugugguggcacgugccuguaaucucagcuacucgggaggcugaggcaggagaaucgcuugaaccugggaggcagagguugcagugagccgagaucgugccauugcacuucagccugggugacagagugagacugucuuagaaaaaaaaaaaaaaaaagaaaagaaaucuaucccacaaauauacuggaaaaaauacaaacaaacauacaucugcacaagacuacaaauugaaauauuauuuguaauagcaaaagacuggaaacaauauaaauguucaucaguggagggccaguugaaaaauguagugcgucuccacaauggaguacuauguagauacuaaaaggaaugaugaauaucuacuuacaguuaugccuaguuuaaugacagggguguguucugagaaaugcuucauuaggugauuuuguuguuguggaaacaucauagaguguacccacacuaaucuagaugguauagccuccuacacaccuaggcuauacgguauagccuauugcuccuaggcuacaaaccuguagaggauguuauugugcugaauacuguagguaaccguaacacaaugguaaguauuuguguauccaaacauagcuaaauguagaaaagaugcaguaaaaaugcaguauuaaaaccuuuuuuuuuuuuuuagagaugggguuuugcucucguugcccaggcuggagugcaguggugcaaucuuggcucacugcaaccuccgccucucagguucaagugauucuccugccucagcuucccgaauagcugggauuacaggcgcgugccaccacacccagcuaauuuuuucuauuuuuaguagagaugggguuucaucauguuggccaggcuggucucaaaauuccugaccucagaugauccacccaccucagccuuccaaagugcagggauuacaggcgugagccccugcacccggccaguauuaaaaucuuaugggaccacugucacugaccaaaaugcugcuaugcagcacauaacugcauauugguauggagugauuuucuagauggaaauacuacauauuuuacaguguauauuuuauauacuauauauacuuuucuccaccucauuuuuaagugaaagaagugagguggagaagaguacacacaguguguugaaauuuauuuuuaaaauaacauggauacauauaaauauuucuuuacauuaaaaaaaagaaggauacagcacaaaauaaauaaagcuuacauagaaagagagggaggggccuagacagaagguagggaggagccaguuuccccagggugaaaugggucuguuuuccagauuugacucugguaccuguagauauuuuaaacuauaaaacaaaauuaaaugaaaauaaaagucauuccuacaaaauaaaaagcaaauuaaacaaaugaacuuaagaauguaugaagucaguagcuuaaccacauggaaaaugauuauuucaaaugacuucaaaauacagugacuuggcuguaccagaugagauacaguuugagaaagaaacugcauaaauaaucuuaagcuacuuucucuauucauuuguuagugauaauauugguacuguuauucugaaucuaauuaauguguauauacauauuaauuucaaucaaauaaguuuaugucuuuaaauaucaugauauucagcauaaaauaaaauuaaaacucagagauauagacauaaaaucaaagaaauuaaguaaaaccauauaacccuaaauuauugcaguuuauuaauuuaaaugcuuuaaaaauacauaauuucuaauucuguccgcugaaaaggccgagaacgaaugcccauuuugaugugaugugcaccuuuccugcccagguuguggucucuacuucucauuucuacugcaaggaaucaggacuccuuggagaaauaauggauucuaaguuugugggggaaaauguaaaagaugagacugaaacauuuuauaccagaaggccaaggaguuauuaagcaccuuuaacuuugggcuuuuguucaagggacuuagggauuaaacugaagaagcucccacugcucaaagauggggcagucugaacuucuguaagaauaauaacauugcccaggcgcaguggcucaugccuguaaucccagcacuuugggaggccgagguggguggaucaccugagaucaggaguuugagaccagccuggccaacaugaugaaaccccaucucuacuaaaaaauacaaaaaaaauuagcuggguguuguggcaggccccuguaaucccagcuacuucgggaggcugaggcaggagaaucgcuugaaccugggaggcggagguugcagugagcugagauugcgccaucgcacuccagccugggugacaacaguaaaacucugucucaaaaaaaaaaaaagaagaagaauaacauggaugaauuguaacacaucaaguacaugaaaauccauaggcucuuaaugaauaaagggaaagagucaagacuuuccugaacaaacuuuuccucaggauacucaggucauuagugagaguuucccucuagagaaguauuuuagaaaauaaaugaagaagaaaugauagaauuagcauauuaccauguuuccaauaucuaaugacagaaugguuguagucuaugaucauuagauaucauauggccuugacaugagaaauuuuuaccgaauaucaaacccucaccagccgggcgugguggcaggcgcauguaaucccagcacuguggaucaccugaggucaggaguuugagaccagccuggccaacauggcaaaacccugucucuaauaaaaauacaaacauuaucagggcaugguggcagcugcccuguagucccagcuacucgggaggcugaggcaggacaaucgcuugaaccuggguugcagugagucaagaucgcaccacugcacuccagccugggugacagaacaagacuccaucucaaagaaaaaacaaaaucaaaccuucaucaugucaauuuuuagauguaacugucagauuacaagaaauacaaaggacaggagaacacauuaaucaaggcuacaguggauguaaauucuauaaaacaaaugaccagguuucuuuaaaaaauaaauugcaagauaaaagaaggaagggaacauuuuauguuaaaagacacuuaagagaccuaucaccuauacugaauccugguuuaauaaaucccauaagaccuucuaguaagacaggauguggaagcagaacagugauacuggugauccugacccuguguaggccuaagguaauguauguguuugugucauuguguuuaauaaaaaaguuuaaaagguaaaaaaaaaaaauaacaaauuuuaaaaacagaaaauagcuuauagaauaagguaaggacauaaagaaaaauauuuuuaaacagcucuauaaaaggcuuguguuuuaagcucaguauuauuacaaaagaaucaaaaagauuuuuuuaaguuuauagaguaaaaaaguuacaauaaucuaagguuaauucauaauuaaagaaagaaaaauauuuuuauaaauuugguguagccuaagugugugguauuuauaaauucuaagguaguguacaguaaugucuggggccuucauauuugcucagcacucacugacuccugcacuccugcagagcaacuuccagccuuccaagcuccauucaugguuaagugcccuacauagguguacuuuuuuuuuuuuuuuuuuuuguagauagagucuugcucuugucgcccaggcugcuggaguguauuggcgugaucuuggcucacugcaaccucugccucccagguucaagcuauucuccugccuuagccuccugaguaacugggauuacaagcgcccgucaucacaacuggcuaauuuuuguacuuuuaguacaaaauuaguacaaaauagacgggguuucauguuggccaggcugguuuugaacugcugaccucaggugauccaccccccuaggccucccaaagugcugggauuacaggugugagccaccacgccuggccagguguaccauuuuuucaucuuuuauacuguauuuuacuguaucuuuuuaauguuuaacuauguuuagauacacaaauagucaccauguuauuauaauugccuacaguuuucaguacaguaacaggcugcacaaguuuguagccuaggagcaauaggcuauaccacauagccuagguguguaagaggcuguacuguugagguuuguguaaguacacucuaugauguuccuacaaggaugaagucguuagugaugcauuucucagaacauaucccgucauuaagugaugcaugacuguauagacugaaacauuuacagaugaugcuugggguuuuccucaaaacaauccaggcauaugggggaguguggagagguauugauaaagcaagagugucugugaguugauaauugcuauagcuaggggugaaggguccuugcgauacacuguacuauccucucuuguuuuauaggcugguggaaaaguaaucgcaguuuucucaauuaccaaccuaaauauguauguuugaaauguuuguguaucuugaaauuuucuacaguaaaagaugguuaagaacuuucacacauaaaauguuuuucauaauuuacucucucuacucagaugaauuaguguuuaccuaacaaccugaugaaauucaccauuauaaagauacuuauuaucauuaauuauucuucuaguacaggaaggggauguuaauaauuagcuuauaguagccgggcaugguggcucacuccuguaaucccagcaccuugggaagccaguggguggaucgcuugagcccaggaguucgagaucagccuggacaagaugaugaaaccccaucucuaaaaauaaauaaauaaauaaauacaaaaaaaauuagccaggugggcaugguggcaugugccuguagucccagcuacuugggaggcugaggcaggaggaucacuugagcccaggaggaauagguugcagugagccaagaucacacuacugcacuccagucugggcagcagagugagacaauuaaaaaaaggagcuuauagaaagucuguuuggcuguuaugccuuaugccacaaugcaucuaaggcugagagcuauuucuccacaaaauugagacugugaaguuacacuuaagaguguuucuuauaaguaggcccuaugauuauuuuuuuacuuaccuaaauugggucacauguuauuuauuuuauuaagaaacaagaucacuaccucugccugaauaagcucaggugccaccaauacaugucccagaugaacccacaaacccaggagaaaggagccauggagcaaugucacuuaccuagcugucuccucaaacuguaugucauccacugaggcuguaacgcaggaaacuccagcauguuucucagcuucaaaaaauacauaaaaaugugcugcuuuaguggugauaugagaauauuucaguauaagggaaaggaaugaaauguaagugcauugauuuuagucacccaucccucauucauuauagcaccacugugccuacacuuucuggaucaacuggcucauuacaagcuucuuugcucugugaguuauauuucuaauguaugguaauuacugcacuuuuuauccuaauuuuuaacuuacauggucuuguauuugaaauuuaauaccaagauccugcaaaucuagcuauugaaauagcaauuuuaguaaguuggugcugacuuuaaauauuuuaucagguacuauccuucuuguuuuaaaaucaaagcaucacagguguagccacuugcccacauaaccaguagcagaaucuguuuaaaugauuuaaccaccguaagcacuugagcgguaugggaaaccccgagucaucccaaaucaaagaggaucuucucuggguaucagagaaagagagaugggcacacaguagauauuuagucaauauuuauuuuauuauuaccaaauuuaugccaaauucaguauacauuaauuaccuugaaggaggaguauugaguagggugggagaguucaggaagaagcuuaguuauuuccauguucuaugucugcacguaauuugcucagauuuuuuuuuuauuguugguuuugcuuuacauaaaaaacaccagaauuuauacucuguggggaagauuuugacaugugcuucugccagauuugauuuugagaaacacaauugaaagccaaacagauuauauuggcuuuauaagaacuuuugaccucauuuuaguuuuggagacuucaguccuggugccacaugaugaagaaaagagugaauuacacugaauuugucuuccuugugcguacuggaucauuauaacuacauauguauuaauugauaguccuagguaagaagacaugagagauaccccacugcgcacguauuuaacacauuccugucuaggaucuaauucugcagaaaauuggacauucaaauguucaaggaagggaaaauggaagaaucggacucuaggaaugcucaagguggacucaacuuaauucaaugcaccaaacauuuguuaaguucuugcugauuuccagacacugaguuggaugaguuccauuuuuuuuuuuuuuuuuuuuuuucuuuuuucagauagagucucacugucacccaggcuggagugcaauggugugaucuuggcucauuucaaccuccaccuccuggguucaagcaauucuccugccucagccuccugaguagcugggacuacaggugugcaccaccaugcccagcuaauuuuuuguauuuuuaguagagaugggguuucaccauguuagccaggauggucucgaucuccugaccucgugaucugccugccucagccucccaaagugcugggauuacaggcaugagcucuaucuuuuaagcaguccacucuguggcacuuagagauccagccauagucaguacccuuuuagagcuuaaguuuuccagggaacugcugaaaccuugcaaauauaugcuuaaaucauugauuaaagaauacuuaauaaacauucauuccaguuacuugacaugagggaaugggauguugagguuauuaauucuuaguaauaaaguguuauaauguauaccaacaugaguaucuugaguaucuuuuuuuuuuuuuuuuuuuuaagagacgaggucuguaucaccuaggcuggagugcaguggcacgagcauagcucacuccagcgucgaacuccugggcucaagugaucuugccucagccucccaaguagcugggacuauaggcaugugccaccacagcuagcuaacuuuuaaaaaauuguuuaaaauauuuuuuguggagacagggucucaugauuuugcccaagcuggucccaaacuccuggacucaagugauccuccugccuuggccccucaaagcacuggaauuacaggugugagccaccaugcccggcugaguuaucaauuuugaaugacuuaaaugauaacuaaaaugcaguaaccaguaaaaaaauuaaacuuuuauuguuuauauuggguaucuauucuguauauguagcacuauacuagauuucuuaagggaucaaaaaguaauaaaaucaugacaguuacuuuuuauuaagcauuuauuauugaucaggcacuggacuagucauuuaagcaugucgauuacaugaaguugguacuauuauuagcucccuuuuauaaauaagaaaauuuaggcuuagaaagauuaaaugcauuguucuaaauagugauuuugacuauagaagcaauaggaacuuucaggaaagaguagguuagacaaaccagagaacacucccagagaaggacguggcuaaauauggguuucaggagcucaauaaucaugauuuauaccauugauuuucaagggucauuaaacuaaaaggaaaaaaaauauggggaccaccauaggguccuggcuucacaugucauuacaugcgugcuguguuuuuaaacgagugucaauuagaugacaugaacucacaggacuggcuuguucugguucuugauuuugauugcccuucauaccagcagaaguggaaaacccuaaagcuguuucugauuuccugggagaacaaagagaagcuaagugauuguaaguagguacgaaaugaugacugauaaaaauagugguaaccuuccuucauuucuuccuuccuucagcagauauugauugaacacuuguuuuauuuuauauaaggcagccucugcguaaggugcuggcaaugggaaacagccaggaccccugcucucauggagucuaguggaugagcuagagguuaauuaaauggauauugauaugguuuggcuguguccccacccaaaccucaucuugaguuguagcucccauaauucccacauguugugggaaggaaccggugggagauaauugaaucaugggggcaggucuuuccugugcuauucucauaauagugaauaagccucacgagaugugaugguuuuauaaggggaaaccccuugugcuugguucucauuuucucuccugccaccgccauauaagaagugccuuccaccuuccaccaugauugugaggcuuccccacccacauggaacugugaguccguuaaaucucuuuuucuuuauaaauuacccagucucagauaugucuuuaucagcagcaugaaaauggacuaauacagauacauaaugacaaaauggacuaagugcucugaagaaaacagggauuuuaugacagucaguaacugagauaauacacuaggugggguauccaggaaggcuggagggcagaggaggggaaggccugcugagcagagggaacagugacuacaaagguccuggugacugcaaugcagagaguaggagggagagugggugagaugaggcuggagugaaggcugaggacaggcuaugcacagggccuugaagcucuugguucaaaguuuuuguaauuauuauucuucaagauauuguugcacugccuucuggucuccacuguuucugaugaggucagugguaauucuaauuguuguucuccuauauacgguguuucagucuggcugcauucaagauuuucucuucaucauaguuugacuaugauaugccuggauguauucuuuguauuaguuuuucuuucuuucuuuuuuuaaauuggagacagagucucacucugucauccaggcuggagugugguggcacaaucuuggcucacugcaaccuccgccuccuggguucaagagauucuccugcucagccuccugaguagcugggaauacaggcgugcgccaccaugcccagcuaauuuuuguauuuuuaguaaagaugggauuucaccauguuggccaggcuggucuugaacuucugaccucaggugauuugccugccucagccucccaaaguacugggauuacaggugugagccaccaggcccagccuguauuaguuuuucuugauguucuaugaccuugaaucuguaauuguaugucuuucaccauauuuggaacucuaauuauguuuauguuuuauuuuuccacaaaucucugacacuuuauuuuauuuauguauuuuuuuuuuuuuuuuugagacagggucuugcucuguuacccaggcuggaguacaguggugcaaucauggcucacugcagccucgaccucccaggcucaagucauccucacaccucagccuccugaguagcugggacuacagguacaugcuaccaugccuggcuaauuuuaacauuuucuuuuuuugguagagacaggaucucucuauguugcccaggcuggucucaaguuccugggcucaaaccauccuccuaccugagccucccaaagugcuaggauuauaggcaugagccauuguaccuggccacacuuuauuuuuaaaauucauuuuuuucuguucuuagauuggauaauuuauauugauguauuuuugcauuuacuaacucuuuucucagccauguccauucugcuguuaagccuagccauugaguuuguuauuuuagacacuguauuuuucaguucuggaauuaccauuuggcuuuuaaaaaauaguuucuauuacucugcagaaauguacugucuuuucaaucuuuuucuucuuuuucuuuuucuuuugagauggagucucauucucaaaugagacuccagcacuggcuggagugcagugguacaaucucggcucacugcaaucuccaccucccagauucaagugauucuccugccucagccuccuguguagcugggauuaaaagcaccugccacaacacccggcuaauuuuuguauuuuuaguagacaggguuucaucauguugaccaggcuggucuugaacuccugaccucaagugauccaccugccucagccucccaaagugcugggauuacagcaaucuuuauuaucauauuuuuaauuauauuauugagcacaguuauacuagcugcuuuaaaauccuugaagcuuaauuccagcaucaggguugucuagggaugaaucuccauugaucaucuuuucucuuaagaauaaaucauguuucccucuguauuucaaguaauuuuggauaauauccuagccauugugagugauccauuguagaaacuguguuucucugaaaaguguugguuuuguuuuugguuuuguuuuuuaaagcaagcaguuaaccugaccaaaccaaaacuauaaucugucuaccuagagaugggcacaacuauuuucaguucuuuuggccucaaccaggagguuuggagucuguccuauguauacaugauucaagauuugccagauaucugggaaaagauuauagauagauuuuagggcucugucucucuggcucuuuccuuucuggaacuuucccuuuuguauuucauucaguagcugugcuuuucccaaacccugucuuugggcucuucaaaccagcaagccuguggguuuuccaucagaacuauagcugggagcagacuggcauuuucuuucaggcuucaagucauuuauaaaacaaacacagaaaaagccaacaccacuuuguucuuucauguguuaacuuucaaguguuauaagccuacuuuuguucacuuuucaccugccuuaagucucuuuuauuuaguguuuugcccagaguuuauaauuauuaucugugggagauuuuuuaguaggaagcacuugaacaucuuagaaaaauccuuaaagcccuuggugaagaaaagaaagggaaaaaugaacaaaacauaugacaugaucaaucagauuagcaucuucaaagauuacuuuagaagcaguguggagaggagaccagaacgaauggagaugaguuuggaaaucacugcugaagucugcaugaaacaugaugauagcuuggaguagauggucgcaaugggggugcagcaaagugcuuggauuucagagacuccuuuaggggguaacacugauaggacuugcuccaugcauagaguaugugaagugagaaguaagguggagagagaaauaucaaggaugacuccuagacuuuugacuugcucaacuagaugaguugggugccacuccagagauaguaaacccuggaaaagauucacaaauaaaaaaccgugugugugagauguuccaaaauaauacauggacgugugagauagaggauuacucagauagcuucaagacuuuagacuuaagggacuggaaaaauaauggggccacugacagaaguaaggauagugagaauauuucaucuuucuuuaaauauugagaagacauuuuggaauccagcagugccuaggggucauagaaaugccuugggggccaugacugggauugcaguaauguggcuaaagagauaaugcuggccuauaaaaaacucugagaaaaucccagagaaaucaguuuuauauuacuacacagauucaguuacaccuuggcuaaauaauguccccugcuuauguggugccucaggucaccauaaaguguuuaacacaggcguuauucauguugcccaaaccaacuuuaucauacagguuuucuuaauauuaguaacauuaucaguuauuaauauuauacuacuaauaguaauguaacuauuaagguauagaguaauugauugucaauuggaucuuuccaugguuuccaaagaugucaggucauagaaaugaugacaauugcaggugggccauuguuucuccaucacaagacagaggcacuaagcaagguaacuaaaagucacuucaguggucucauaauguauucaguugccuuggaaacaggcaucauuauuauuagcaaccucagugguuuauguauuauucuuuuuuccuauguguggauuaauuuuguauucauguuuccauuguuaauauaaccaaucucaaauccuguuaaaaaaaaaaaaggcuuaaacgaaucauugauuucucacaauuguggaggcagggaaguuccaaaucgaggugcuugcccauuguagguccuagugagggcucucuuccuggccuguggauggcugucuuccugcuguggccucacauggcagagagaagcucuccagugucucuucuuauaaggacauuaauuguaugggaccaggauuccacucuuaugaccucauuagccuuaauucuucacuccaaauagagucacaccagggguuaggacuucaguguauaaauuucgguggguggugugggggauauaauucaguccuuaauaaauguuuuugccauuuuuacugucauucugucacaagaacacaguggaguuuuccagagacuacauaagggugugguagcagcagggugaaugcagaagcagguaugaguagucagcaauccuccacuagccagaccuuagagagacucgccaggauguaaccuuuaucaccacuccucucgcuacacuuuuguucuuguggaaaauaguuauuucuuaauuaaaaauguuaugcuaacaauguaguccauuucuuuuuuaaaaauaauuaaaaauuuuaaauuuccauuacgguaaaugugauauaaauagccuacauaaacaaaagcugccugggugcgguggcucaugccuguaaucccaacacuuugggaggcuggggccucccaacacuucaggaucacuugaguccaggcguuugagaccagccugggcaacauagugagaccccaucucuacaaaagcaaaacaaaacaaaacucccaaagucagcugggccugguggcgugcgucugugguccuaguuacucuggaggcugaggugggaggaucgcuuuagcucaggaggucgaggcugcagcgaccucugauggcgccaccgcucuccagcccgggagagagcucaacaacaacaacaacaaacaaacaaacaaaaaaccccgcagaagcucucugggcuccucacuuguuuaauggaaugaaggagucccgagagccacacauuugggaaccaccggucucggccaugcccagcgcgggcgcacuguugcaacaccccuaucccuggcugcgcaggguucagcucuccgcaaguaccuuccucgccuuccuaccccccccagcccccagccgccgccgcucccgcagccccggucccgcgccuccccgcagccccggcgcccgccuacccgccaggcaggcgguggugucgauccacuugagcagcugccccgcgcucagcucgccgcgcgcaguggcgugcgccggcuggauggcuuggcucaugaccaccucgccgggcgccggccgcuccauggccagggcgagagcgcuacgccugcggcccccgacaccccaccaugcccgcucc

SEQ ID NO: 192904 - RNA, 12123 nt, Homo sapiens
caaaaggacagaugcagaggacaggcgccaggcacagauaccaucucccuuccccaagccagcugcccccaacccucccccugcccgcaauuaguccucuggggcgggagcggggcacagagcagagcccucuugggggaggggaagcccgauccgcacccacccuuccuuugccccccucuuccuucugcugcuccaauaucaauuucagccagugaccucuccaccaauuugcacauccccacucucccgguccguuucaccgccagacaucgguuccauuucgacccucacuggcggucauucccacccccucugcuggucaauuucaccccuuuuggcggucaagugcagucccccauuucccgggcaauuucccccuccccuccuucucccucuccccuccccuccccagcagugucacucccagcugcuccccaccucccgcgcuccgcgcucgcugcggccagucucgggcgucccggucaguguccagcugccgcggccucggccccggcgacucccgcccccagccccccuucccuccgcgggcagcggcucccucccuccccagaacagcugaaggucucagucaccuccgaggggagcgcagggggaggggaggggcgggggacgcggcggaggggaggugggggagccuugacgcugcugcccgggacgcggcccggggcuggugggaacaggggcguccuccugcgcgccccccuccccagcgucccaccucccggcggcggcggggaaagucucuccgaaagcgugaagggggauuggaggagguuuuuauuucccuuugugcggguggcuggggccggaucgaggcggcgggggccgcgggacugggggcuccccgcugagccgagaggagcgcgacaaaggaugcgucccgccggggucacagucuccgcggcccaacuuugcgcgcggcgcccgcgccccuggggagcccgcccgcugcgcugagaacccaggcguccgggcugggagaggggccgggagcguccgcagguggcgcuggcccggaucucccgaccccaggaagggaucccggagcuuccuggaggcggcgggcggccgugucgcuccagggaaccgcgcugcccgcggaaacuccgcgcgccuccgcggaugccccucgcccuagcccccagcgcgcgggguucggggcccugcgagguccccccuucccccgcggugcuucccaagcugggcuaaggcgggcuucucuuccucccuccucugucgccuccuuuuccucccccucguucaccuuuuccuucccucuauccauccagagccccgccaaagggcgcaccugaucuuucucauccuucccugcucuucccuuccucuccaccuccuccuccuccuuggggaaaggggcccggagaagggcaugugggggccccucugacaguggcccgauuggggugacaggcgcccaaauggccaaguggcuacgggacuaccugagcuuugggggucggaggcccccuccgcagccgcccaccccggacuacaccgagagcgacauccugagggccuaccgcgcgcagaagaaccuggacuucgaggaccccuaugaggacgcggagagccgcuuggagccggaccccgcgggcccuggggacuccaagaaccccggagaugccaaguaugguucucccaagcaccggcucaucaagguggaggcugcggauauggccagagccaaggcccuucugggcggccccggggaggaggugcguggcuggguggccuggggagacuggguggaggggaggcucaggaugggcucucuggaucguggagagcuuauuuuaugugugaucacaggaggggacuggggcaccagacagacccuucccaguccuccagaccuccaccugcuuggggaagucuguucuuuuuauguauuuauuuauuuugagacagucucccccugucacccaggcuggagugcaguggugggaucucggcucauugcaaccuccaccuccugggguucaagcgauucuccugccucagccucuccaguagcugagauuacaggugugugccaccacacccggcuaauuuuuguauuuucaguagagacugguuucaccauguuagccaggcuggacucaaacuccugaccucaggugauccucccgccucugccucccgaagugcugggauuacaggugugagucacugcgcccgguggauaucugucccuuuucaaugcauaaugcugguuguccuucugccucucugaccacccugcuuggucuccggguccuccuccuccuccauggucauccccugcagucccccagcccccuccccucagcaccccuuccucuuggaaccuggugggaucuuccuaaaauagaucugagugaguugcuccccugcugggcaccuaaauauccucccggugaugcugcccuuccuaccacuauguucccguuuuacagaagcgaaacugaggcucgcagaacgguagugacuuggcuaaggucucacgggguucuagcuuacuaggauuugaacccaggccaccgggugcaguagcucaugccuguaauuccagcacuuugggaggucgaggugggaggauugcuugagcccaggaguucgagaccagcccgggcuaacagagugagaccuugucucuacaaaaaaaaaaucaaaacauuagcuaguugugguggugcacaccauagucccagcuacucaggaggcugaggcaggaggaucacuugagccuagaaggucaaagcugcagugagucaugauugcgccacugcacuccaaccugggugacagagcaacacccugucucaaaaaaaaaaaaaaaaaaaaaaaaaaaggcuggguguggugguucacaccuguaaucccagcacuuugggaggccaaggcagguggaucaccugaggucaggaguuccagaccagccuggccaacacagugaaaccccaucucuaccaaaaaugcaaaaauuaaccaggcgauguggcgugcgccuauaaucccagcuacuccugaggcugaggcaggagaauugcuugaacccaggagguggagguugcagugagccaacaucgcgccacugcacuccagccugggugacaagagcgagacucugucucaauaaauaaauaaauaagaaguaagacguugguaagaagagccagggacucgaggaaaccagucagccgggaucagacucggccucuuacuuaccagcugugugucccuaagcaaaacacuuacugucucugugccuuggcuuccuugucuggaaaaggggaaugguguacuuauuacauguugguauuacaaaucaacacagguaaauccuugacaauagugcacggagaagcacugaagugggcgaaggagggaggcaggugucugugcuggggaaaugggaucaagacagagggagacgugggaagccagccgcugucugcgagcacuuuuggguaacagacucccucuccaacccccaaaaagaacucuuggagaggccaggcacuguggcucaugccuguaaucccagcacuuugagaggcugaagcgggcggaucaucugaggucaggaguugaagaccagccuggccaacauggugaaacccugucucuacuaaaaaugcaaaaauuagccagguuugguggccggcaccaguaauuccagcuacuccagagacugaggcaggagaauugcuugaucccgggagucggagguugcagugagccgagaucacaccacugcacuguagccugggcaacggagcaagacuccaucucaaaauaaauaaauaaauaaaacucagcugggcgcgguugcucacgccuguaaucccagcacguugggagcccgaggcgggcagaucacgaggucaggagaucgagaccaucccggcuaacacggugaaaccccaucucuacaaaaaguuagccaggcaugguggcgggcgccuguagucccagcuacucgggaggcugaggcaggagaaugacgugaacccaggaggcagagcuugcagugagcccagaucccgccacugcacuccagccugggugacagagcgagacuccaucucaaaaaauaaaaauaaaaauaaauaaauaaauaauaaaaaaauaaaaacucuuggagaggugucagauggcccugugggcaggcaagaggugcagcgucaauuagcagggaagccccucugaguccuugucuucuccccuuccuucucuccgcagcuggaagccgacacugaguauuuagaccccuuugaugcucagccucauccugcacccccggaugauggguacauggagcccuacgaugcccaaugggucaugaguggugaguaggcacggcuugggggaaggugacagggucccagaugggagcaggagcugaacagugucccuggccuccuagaacuucccggcagaggggugcagcucuaugacaccccuuaugaggaacaggacccagagacagcagauggacccccuucugggcagaagccucggcagagccggaugccccaggaagaugaacggccagcagaugaguaugaucagcccugggaguggaagaaagaccacaucuccagggcguuugcaggugcuucucagacccacacucugacaucugaaugccccaucccugcauuuccucaucuggucaugucuccuguuucaguuuacaaaguagaguccaauuacuugucacuuuuguaguuuguuaauucucacuagagugugaaugacugauaguccuaaauucuuucuuccaagacaaccugcaucuuccuuggaaacgcaaacacuuuuuagaguggaauggaaccuacuuauccugcucagugugguguggggagaggaauauggcuugcuuuuagaauaggauguggggguggcaggggcagcauuucuuuauuuuauuuuauuuuauuuuauuuuucuuucguuuuucuuccaggcggagucucacucugucgcccaggcuggagugcaguggcgugaucucggcucacugcaagcuucgccuccuggguucacgccauucuccugccucagccucccgaguagcugggacuacaggcgcccgccaccacgcccggcuaauuuuuuguauuuuuaguagagacgggguuucaccaugucagccaggauggucucgaucuucugaccucgugauccacccgccucggccucccaaagugcugggauuacaggcaggagccaccgcgcccccgcccggggcagcauuucuuaauagcugcuaguaaacuacaggugaauuuccagcugaauuggaugagcuuggagaagccucugaaccuuaguuuucucuucuguaaaagagauaaugauaaaaucaguuuuaaaaaauaaaauaauugccgggcacgguggcucacgccuguaaucccagcacuuugagaggccgaggcggguggaucguuugaggucaggaguucgagaccagccugaccaacauggagaaaccccgucuuacuaaaaaugcaaaauuagucgggcgugguggugcaugccgguaaucccagcuacucaggaggcugagguaggagaauugcuugaaccuggaggcggagguugcggugagccaagaucgugccauugcacuccagccugagcagcgagagcaaaacuuugucucuaaauaaacaaauacauaaaauaaaauaaauaaaauuuggaccaggaagaguugugcaaacacgacuuugcccccaaaguuuuaugacugggaggguauuuagagcuuagugccuuuguccaccugucuguagauugggggugauuuucuaguuuuaggacuuggccacagucugggcugaaccccagaagggguuuagggacuagggcuccucuuuggaaacuucgaaccgaccccgucuagccacgccccuugugcuccuugccaccagauuuauaaaugaccgcaccuauuucuuaggaaggccaaaagguugcaccuguggccaauccugccccugccuuaagcccagccccugggcugugauagguugucccaagcuggcccugccuuucuaccgagauuccauuggcuugccccugccccgccccccaagguaggcuggacuuaacccuuuccucucuaaaucuccuuuccagugcaguuugacaguccagagugggagaggacuccaggcucagccaaggagcuccggagaccuccgcccagaagcccccagccugcggagcguguggacccagcccugccccuggagaaacagccgugaguggggaagcugaagguggaagagccccguugaacguaucuguagacuccaauguaucaggcagaaguuuuuucguuucccagauuagaggaacugggggaacuucgauucauucauccacuuauuucuucagcuaaucuuuacgggcuccagagccugcugcgugccaggcacccagcuagacacaaaacaaucuuauggggucccuuuuccuuugguaucaaguucuggguucacauuccugcucuccucuccuggcuguguagccuggggcaagucacuuaaccucucugagccucagguucaaacagaaaaggcaauuuccuuccuuaacuuggguggggcuuacagccucagagccaagagacagaaaucauucucagccaguucuugguucuugggauggaaccaggagaugcaggauuuuggugggcucacagcuccgugcugggguggcacgugagccgggagacgcugacucuguguccuuccagccugggcgcuccuugagggagugcccaaguccccagaauccagaccauguugucacagucaccccuaaaaucucuucggugggcaauacagaacuggcuauuuaacucugaggccgagggugugaagauuguucucuuuuuuucuuucucuuccucccucccucccuccccgagucuugcugugucgcccaggcuggagugcagugacgcgaccucggcucacugcaaccuccaucucacagguucaagcgauucucaugccucagccuccagaguaggugggacuacaggcgugcaccaccaugccuagcuaauuuuuguauuuucaguagagacagaguuucaguauguuggccaggcuggucuggaacuccugaccucaugauccauccaccucggccucccaaagugcugggauuacaggugugagccaccccgcccggcccuuccuccuucucuucucuucucuuucuuuucuuuuccuuucuuuuuuuuuuuuuuuuuuuuugacagagccucgcucuugucgcccaggcuggagugcaaugacacaaucucagcucacugcaaccuccgccucccugguucaagcaauucucuugccucagccucccaaguagcugggaauacaggcuccuggcaccacaccaggcuaauuuuuguauuuuuaguagagacagaguuucaccauguuagccaggcuggucucaaacuccugaccucaggugaugugcuugccuuggccucccaaaguguugggaugacagccaugagccaccgcaccuggcccgcucuuucuuuuucuuucuuucuuucuuucuuucuuucuuuucuuucuuucuuucuuucuuucuuucucucuuucuuucuuucuuucuuuuuuucuuuccuuccuuccuuccuuccuuccuuccuaccuuccuuccuuccuuccuuucuuucucucuuucuuucuuucuuuugagacagggucucacucuguugcccaggcugaagugcaguggcacaaucagcucacuguaccccugcacuccugggaucaagcgauccuccagccucagccucuccaugggaccacaggcacgccauaugugcuuauucucuuuucagauuucuuucauugugaacaacagcaaaggcucuggugcuucucugucuuugauaucuugcuugcuacugcaaaccccuuugugagcacauuaaagcaaaacauuaggccaggcacgguggcucacgccuguuaucccagcacuuugggaggccggggugggcagaucaugaggucaagagaucaagaccauccuggccaacauggugaaacuccaucauuagccggacaugguggugcgugccuguaaucccagcuacucgggaggcugaggcaggagaaucucuugaaccugcgagguggagguugcagugagcugagaucacgccacuguacuccagccuggcgacagagugagacuccaucucaaaauaaaacaaaaaaacauuaagaaaggggcuggguaagguggcucauggauguaaucccagcacuuugggaggcugaagcagcggauaaccugaggucaagaguuugagaccagccaggccaacauggugaaaccccaucucuacuaaaaauagaaaaaaauuagccaggcagccgggcgcaguggcucaugccuguaaucccagcacuuugggaggccgaggugggcggaucacaagguuagagauugagaccagccugacuaacauggugaaacccagucuuuacgaaaaaugcaaaaaauuagcugggcgugguggcgggugccuguagucccagcuacuugggaggcugaggcaggagaauggcgugaaccggggaggcggagcuuacagugagccgagaucgugccacugcacuccagccugggugacagagcgagacucugucucaaaaaaaaagaaagaaaaagaaaaaaacagaaagggacaggugggugagguacaagaugaagcaccacuuuugugaaagugguugaaguugacaaggacaugagggaggcugugaagaucaaugucaaguguacgauaaccagggcuccucuugaaaaauccaaggguauuggccgggcaugguggcucaagccuguaaucccaguacuuugggaggccaaggagggcagauaaccugagguuaggaguucgagaccagccuggccaacauggugaaaccccaucucuacuaaaaaugcaaaaauuagccauguguggugcuaugcgccuguaguuccagcuacucuggaggcugaggcaggagaaucgcuugaacccaggaggcggagguuguggugagccaagauugcaccacugcacuccaaccuggcaacagagcaagacucugucucaaaaaaaaagaaaaaagaaaacuccaagggaauuguccuucuucauuugcccagaugccacaagcccaugcaccagcugugacccaacagaucccagaguguguuuuuuuguuuguuuguuuguuuguucguuuguuuugagacagagucucacucuguugcccaggcuggagugcaguggugcaaucucagcucacaacuuccaccucccugguucaagcaauuucccuaccucagccuccugaguagcugggauuacaggcacccgccaccacgcccggcuaauuuuuuuuguauuuuuaguagaaacgggguuucaccauguuagggagacugguuucgaacuccugaccucaggcaauccgcccgcgucagccucccaaagugcugggauuacagggccccagaguguguuugaagggaauggcccuugaugagacaucuguccauacucgcuaggugguuucauggcccccugaacagggcggaugcagagagccuccugucccucugcaaggaaggcagcuaccuagugcggcucagugagaccaacccccaggacugcuccuugucucucaggugagaacucagccucacagggacgaagggucacaggauugcgugagucacccuuuuggguuaauucagagggaaggggaggguguggcucccgcagccauagggaagggcuuccaggucagugggugggacuucuaggagaaggggugggaguucuggggaggccauuagcugguugcaauugagaaugagcucaccaucgcuggagguauacaagaagauggaguggaaggcaucgaggagguccaggccuuggguaagacaaggaacuaggugcacaagauuccucuggacuccccuuguccaaaaauggagguauaucaauuuguguccaucugaagccaaaauuucaggguguaccuguaagcguuuuagguugagacccuguuuguacgcacuuccgucccuaaaauucuaagucugucuaauuauaaaccacuccuaagauucugcuaggugucugaguggaagaucuaaaagcacgagauuggggcugagcgcggcagcugacgucuguaaucccagcacuuuggaaggcugaggaagguggaucacuugaggucaggaguucgagaccagccuggccaacauggugaaaccccuucucuccuaaaaauacaaauauuaguugggcauaguggugcauaccuguaauuccagcuaccucggaggcugaggcaggagaauugcuugaaccugggagacggaagacuuucggcgcauaccaccgugcccagcuaauuuuuuuuuuuuuuuuuuuuuuuuugagacggagucuagcucugucacccaggcuggagugcaguggcgcgaucucggcucacugcaagcucugccucccggguucacgccauucuccugccucagccucccgaguagcugggacuacaggcgcccaccaccacgcccggcuaauuuuuuuguauuuuuaguagagacgggguuucacuguguuagccaggauggucucgaucuccugaccucgugauccgcccgccucagccucccaaagugcugggauuacaggugugagccgccaugcccggcuaauuuuuguauucuuaguacagacaggguuucgccauguuggccaggcuggucucaaacuccuggccucaagcaauccgccugacucggccucccaaagugcugggauugcaggugugggucacugcaccuggccucuuauuauuauuauuauuuauuuauuuauuuauuuauuuuuugagacagagucucgcucugucgccuaggcuggaguauaguggcacgaucucggcucacugcaagcuccgccucccggguucacgccauucuccugccucagccucccgaguagcugggacuacaggcgcccaccaccacacccagcuaauuuuuuguauuuuuuaguagacacgggguuucaccguguuagccaggauggucuccaucuccugaccucgugauccgccugccuuggccucccaaagugcugugauuacaggcgugagccaccgcgcccagccuauuuuuuuauuauuauuauuuugagacagagucucacucugucacccaggcuggggugcaguggcacaauaucagcucacugcagccucugccucccagguucaagggauucucaugccucagccucuugaguagcugggaccacaggcacccgccaccacgcccggcuaauuuuuguauuuuuaguggagaugggguuucaccauguuggccaggcuggucucaaacucguaaccucaagugaucugccugacucggccucccaaagugcugggauuacaggcgugagccaccgcacccgccuaauuuuuaaauguuuuuugguggagacggggucucacucuguuggccaggcuggucucuaacgccuggccuggaguaagccuacagccucagcuucccauaucacugggauuacaggugugagcgaguauaccagccaccacacugcuguuuaccagagacuggagacacacgagcaccuggccugggcacugugggagguggcuuuggggauggugccuuucuggguggguccgggaugcucaggagucccuuucucccucaucgcccaggagcagccagggcuuccugcaucugaaguucgcgcggacccgugagaaccagguggugcugggccaacacagcgggcccuuccccagcgugcccgagcucguccuccacuacaguucacgcccacugccggugcagggugccgagcaucuggcucugcuguaccccguggucacgcagacccccugacagugacccucggcccccuuuugaguccucgggcccagaaucguaucccaaagcccucccauggccuagaaaauaaauaaguuauuguuu

SEQ ID NO: 192905 - RNA, 23277 nt, Homo sapiens
ggccgccgcacuuuaagaggcugugcaggcagacagaccuccaggcccgcuaggggauccgcgccauggaggccgcccgggacuaugcaggagcccucaucaggcgagugccccgcgucccccugauugccgugcgcuuccaaucgccuugcguucgguggccucauauuccccugugcgccucuaguaccguaccccgcucccuucagcccccugcuccccgcauucucuugcgcuccgcgaccccgcgcacacacccauccgccccacuggugcccaagccguccagccgcgcccgcgggcagagcccaaucccgucccgcgccuccucacccucuugcagcugggcacagguaccagguguggcucuugcgaggugcgcgggcgucugcaaaccaggugacagcuggcgaguggcugcaugcaucucuggccgcugcugcagucgcgggcgcagaagaggguccggucccaggaaccccgagcaaagcuuccgcgaugcgaggggaccgggcuucuggggguccuggaaaucacaacgggagcugggcgcgggaggggcccaggcuuggccccuccuggaagcgcgggcucuggucuccgaggggaggccccaaccguccggcggagcccuccagguugguggugcugggagaagcgcuccuccuugccuccggguccaagggcggagacgcugccuggggagcaggggggacaaggggcggguggacccugaggagucuucccugcgcuucgcacccgcucguggucgaacaggcagcauuggcuauuuuccugcuuggguuaauauucauaucccaacagacccaagccaauucuugguaaaauccuaagucauugcguggcagcaacuguaaaguaaggucuaagagggagaucguguuucucugaagaucaaguaccuggaaaaggauagagaaccauuugcgggcuugaaggugcaggcguucagcggcgccgggucccacugugugugcuacguguggcgggcagagagacuacaugugugaaagggagcgguccggcuacgaaacgcaaucuaugagcuuccaaucccggguucuuaaaugggagcuguuguagacacugcagguuagaagcaucuuucucuuuaaaaauaagcccacaguacaagucggggcgguggcagggggacgcugagaaacaccugcuucguguauggucauuaacacgcuuaggccuaaaggucagggcccuguaucuuuugcguucuuccagaaccauccacaccacagucccacuuccaggaggggaggucuuagcaguuuggaaugcguccuuccaaccacuuuuccagugaauucacaacacacccacuguuccuccggagcaugggggaaggaggugugggcugacucgcacuaaccaauccugguuggccucugagcaggauucaggcugagccugucccugccucugacuauuauaacagcucaccaaaauccaaaaugcaucuguguggggucucugugaggucgugugaaguggaagugacuugcuuaugagcuguugacaaaugaaacauugggaaaccuugagucuccuaggacacauuccuuccagcuuggcucaucccaggagugaaugacucuaccuguuauggacaagcuguugcugcaguucuuugaaaucuaccugcuuccaggcugaacuacugucauucugugaaaucuaccugcucccaggcugaacuacugucauucugugaaaucuaccugcucccaggcuggacuacugucauucugugaaaucuaccuguuaccaaacuaaacuggaagaaaacaaucuguaauucuuguugaagggaaaacaccuuuucuucccugccccucucuaaaacccuguccgggcaaaagagccagaggccagguccuaacauauuugcuaauugugcucuugcuggacuucggcuuccucucaggguuccuuaauuuaaaccagguccaggaugucauaauucugucuuuauuaguaacuacauuuuaccaaggaaagaaccgaaucaaugugcacaaaaauuuuuaaaaaucagguacuuguagucaguggugaaaccuuaacccaggcauuuguuagucagcuagaaucguuaggggccuugguccugaggaaagcagccugaggucucacaacaaagcuccagacaucaaggagguccacaugcagguugacuaucacagacaaagucugcucuguuccuguguucugccagugauaacauuccugccaaacgcugaaguuguuaugaagcugguacauguuauaagcuucgugugaaauggcugcuuucauagcuaucuagcacauuuuuccuuuccuugaacaaggaacucuagguuuugugcugcuauuucaguacaaauuucaccagucuucuuagugacauuaguaaggaauuaaguaugcuacaagucaaucucucagcuuucugcuucuugaauuuaaauucuuauuuuaacgaaacugcaaaguguucaaagacuucauggucauguauugaacacuugauaaugucaagccuuuagguagcuugcgaagaacugagccaugaaccaggcaguccuugucggggcgaguuuaucugggggguaggugugcucccaccugcauaugucacguccaagagcccuaggggagccgggcagcaggaagucucgucaaggcagcacuugcuucccugcuuccugccacugaccccaccauccucugacacugucucuacagcucagggacucuucuccaggccuguggagcacuuucccagcccucccuuccuucucugcguggcugugcuugaccucacacuucccuccuuggcauucccugcugcucuuggugacagugcucgguuggcuucuguccaauuccuguguacugcuucuuccucccacgguggcugccucuuuuucuuccuaaugaugagaugcagaguucccucagccaucacugcccccugaauauucccaggcacuauuuuacacagccuguacugcugcccccucacccaugacaccaaaauauuucacuuugaggaagaccuuaauacugggcccuuuuccuccauagguggcauguaaagaaagcuuuuuaauucucuguacggcucagguuuguuuuacuggagaagaguucaggucuacugucagucuguggcuuguugguguauuucacacacuuuuggaaguuggcggcgcccugccucccucggggcagaauacaaaaccuucccuucccaccuguuccugagagacaugccguuucacagcguucuaugaagucugacuuuuccucucuggauuucugugaaacagccuacuuccuuaaacaaacuguuuccuuauaucuucccuguuagaggguuauuucccuuucuguuuccugugguugugugcccccacuuucacaggaauuaggagcggcaguucucauguguggugugucuaaacgcaggauccuagggccgcucaguggcccugcuuuuaggcacggugcugauggccagugauagagaugacucuacucagcgggcuggaggugacuuggguggagacgguggcuuguucauguagcagcagauucgguaccuguaggguccuggaguacauaggccuggcgugcagaacaucucauucaaccccuuucuguguuacauaugagacagccuugauuuuacauaauuugacccagaaaucacucaccuccuccuugacaagaaggugggguguaaauuuccuuuccucugugcccccaccagccuuuccuccagcagugacgcagcucuugguuuggaaaugcuacaggugagaacaauagguguuuuuucacugacgauggcaaucuugagggcaggugaaggcagggagaaccagaaaugguugccagcucuuaucuugucagacagguaaagaccgcaggaaccuggaauuaaucaucugggccaggucaccggagcacaggugcuuacgaaggcgugagcauguucguccaaugaggagaugcagggccagggcugcgccuuugaccacuggggcuggaccuagcauuggaagacauggaccauguucucucauuucucugauuuuggccuagcaucuuucacucaguaaauagauggcgugcugacaggcgcugugggaaaguaggagaugcaccgccagacuccgugagacagaugcuagaggccuugugcaagacuguggugacuuccugccuugggggcgaagaggggcucuuucucgcugcugaggccgggcccuucucucuugugggagccgcgucuucuggccaggugccgcaccgcuggguggaagccggagcuggauucagacccuggucuagccuuugcugcccugacgauucgccuccugcuuuccccaggccuagguuucacuguaagguggaucccaaggagugguaaggcaaggcgcuagcucucacacacgaggguuuggcauccagcggcacuugggccuuucugucacccuccuugaggggacuucagcuaguuuaaauuucagcugccaugaugagguggaggcgacgccaggguucugaacgugaaauguaacacagcccguccucaccgcccucuccccccgggucaccaggagugagagugugcccgaauuccccguggugucagcacagcaguguuguuuauggcauuguguaacugagaacccugcgucacucucuuaaucgaggugacaguucagaagcugugugccaguccuggggccgcguuggugcacagcccggccgggcgaggcucugauuggcuaggugggucccuggcaaacgugugcgggucauucugacagguccggagccccaacccagcacauuucccucgggcuugccucauugaaaacaaacuguguagcaacuuugucuacccagaagggaaaggcguugagggcaugaacucgaagcgcugcugugcuuucagccauagagcagcuuuuccgcacagcccucuagauagauguuuauugcuugagauuugaaguucagaggauggauaacaaaacaaccugcucccacaaccaaaaaaagucuuggcuuuggacagaccugggaucagguuuuaucuuuuucccuuauugacuggcccacuuggagaagccacucugagccucaguuuucucauccgugaaguggggcaauaguuuccuugcaagguugugaggauaauuugcuaauauuaauuaauauugaauuaaugggcaugguggugcacaccuguaaucccagcacuuagggaggccaaggugggcagaucacgaggucaggaguuggagacaagccugaacaacauggugaaaaccuuuucuuuacuaaaaauacaaaaauuagccaggcaugguagcgggcgccuguaaccccagcuacucaggaggcugaggcaggagaauugcuugaacccgagaagcagaggcuguagugagcccagauggcaucacugcacuccagccugggcaacagagcgagacucugucuccaaaaacaaacaaacaaaaauugaacuaacauuaacaagagcugaaauugcuaauacacugcuggccauggugcuuagaugccagcaguuaugaggcccugaugucauccuggccaaggauacuccagaccaaauucuugccaaugaccuuggucugguucuagaacgacacuuuguuggugaggcaccuggagaaggcacaaacacucacgauuauggaaagccugaaacugggaucaagcugguagcgugaacucaacaaggcgauuuuugagagccagcuuguuacucuacucucagguuuuuggucuguuuuuuguuuguuuguuuguuuguuuguuuguuuguuuguuuuagagacagugucacucuuuugcccaggcuggagugcacuguggccccaaucuagggcucgagcaauccccuugccucagccucccaaguagcuaggacuacaggcaugcaccaccacgccugacuaauuuuuuuuuucaauuuauuuuuuguaaagaugagggucucacuauguugcccagauuggucucuaacuccugggcucaagugacccuccugccucagccuuccaaagugcugggauuacaggcaugagccauugcacccagccaacuaucgguuuuuuauauuacaaacaauuugguaagucauugaauuuucacuuggauccauuugcagagcuuuaaguuagauaauauacuaucuaaaauguaugugccuacaacuaagcuagguauuacaggaaauauaacaacgaagucuuuauccauacagaaaauaaagcauggauagauggcugugugucauaaagugccaaaucgcaggugacaggcauuggcaauccgugcagguguucccuaguauuuuagcauucagugaguuaauccagaaaaacugcucuaagagucaaaaagcagugaugugcucacuuugugucuuuuucaagguuguccugaaacuacacccuuuguuucauucucuugaauguccguguacaagcauuuguccaaauagccacuaauuugagcaccugugguaggugggugcucuccggggugagggaaguguccaguccugcucugugggggcauggggauucaaugaggucacacagaugccacuaucacggugccuggcucuagguaagaccugaacccuugcugauuucugauuguguuauuugcaaucauuuuguuaugaaucuauuucugaauguaaaaaagucggccaagagugcuggcucacgccugaaauccuagcacuuugggaugcugagguggguggaucacuugaggucaggaguuugaaaccagcuuggccaucauggugaaacucagucucuacuaaauauacaaaaaauuagcuggccaugguggugcacgccugcaaucccagcuacucaggaggcugaggcaggagaauugcuugaacccaggaggcggaagaaucgcuugaaccauuccagucugggcaacagagcgagacuccaucucaaaacaaacaaacaaacaaaagucugcgguccugggugaaaacucuacauguggcucuacuggccccccuucuagugacagcagcaggguaacugugucuccccucuuggaguuauuuuuauaaaauuucaugccuucaugcuuuuugguuuaaaagcaugcaaucauguguugaaggcaguuucccuuuucuuuucuuuuuucuuuuucuuucaguuggagucucacuaugucauccaggcuggaguacaguggugcaaccuuggcucacugcagccuugaccuucuagguucauccgggcucaagcaauccucucaucuccacuuccugaguagaugagaguauagcugcaccaccacacccagcuaauuuuuuuuuauuuuuauuuuuuuguaaagacagggucucacuauguugcccaggcuggucucgaacuccuggguucaagcuaucuucuugccucagccucccaaagcacuggaauuacaggcaugagagccaccaugcccagcagguuuugcauuucuuaaauugcuaucaaaagcuucaucugggaggcugaggcaggagggaggacugcuugaacccaggaguucaagaccagccugggcaacaaaguaaggcccugucucuacaaaaauacaaaacucagacaaacaugguggcuugcaccuauagucccagcuacucaggaggcugaggcaggaggaucgcuugagcccaggaggucaaggcugcaguaaguugagaucacacuacugcaauccagccugggcaacaaagcaagacccuguaucuaaaaggagaaaaaaaaaguaaauuuuugaauuaauucuuugauaaauguggacuuaauccaaaguguccugugauguaagcccugaaggucuuuucuuucuugugauuccagccacaguucuaagggugguucugcuguucuugguuccuccuaaguugauuucagaaacuucauugauugcuauagugaccaauauugcacuuuugaauugauuucuggcuuacccuuauuguguaaacauguagcuaugugcacgugucugagugcacugagucucuaacucugcguaacuacuucauggccacuagaaaucauucuuuuggauuuuuuaaaucucccacccauauuugcagaauauaauucuuauuucuuguuugaguugaauucccuaaccauuccuucucaaagaguuucagcaaggacuuuggauguucuaguaaaauaggaauaaagauggauguguguuuuggcuugauguguuacuuguuucuucuuuggaauuauguguacacuuguauauauaauuuuuaguaaucccaacaacugaauuucuuucuuuuagaugcaaauauuaaaaaugcauuauuuuuauguacuuucacacuucuucugacagacucuuuuuaaaaaguuuuacuuuucaccuccauuuucaggccccugacauuuaugggaucacagacuaagcgaguccuguucaccccgcucaugcauccagcucgcccuuuccgggucuccaaccaugacaggagcagccggcguggggugauggcaagcagccugcaggagcucaucagcaaggugccccacaucccgcaccucucccccaguccacaggggugcccugcacucacacagggccauggucuugggcucuaagccagggccagcacagaaagaucaagaaaagcagcaucucacuggggggaaacggggagagaaauugggaaugacugcuggugguuauggaguuucuuuuucuuuuucuguuuuugagacaggaucuugccauguggcccaggcuggccucaaacuccugggcuuaagugauccucccaccucaaccucccaagugcaugccaguuucuuucuugggugaugaaagugcuguaaaauugauuguggugacggugggccaacucugugagcauaccaaaaaccacugcaccguauacuuuaaaugaguggaucauaugauaugugaauuauacaucaguaaagcuguuuuuaaaagaggaggaaaagaaagaaggagaaacagcaaguuaaacucaucagacccucucuuggccucagagacucugagaguaaagguuagguauaaaugaucaaggggaacauuacaucucuguaccauaaaacauugagguacagagacaaaaaccuuaaaacagucacuaauggagaauguugcuuuguuucuuugacaagggaggaugcagggauggagccgacuuuggaagucuggguuugguuguaaaggccaggaucuagaacaguguccuagaccaccaaauaaggaagaaucccagccucucagagaagcauaacucagacucaggcacccauggaaacaagaaacaagcauccaacaugcagucucugaagcaagagagacacucagcuacgcacacgaggcuguggcucuuacagcagcaaacaugcaagagcuuucuuuuuauucaucuaaauaaauagguaaucuuagaaauuacaaauauuauuuaauguaaucauuaccucauguaucuuaagaagacagauccauuaaaaaucuuaacuucccggccgcaugcaauggcauguacuuguagccccagcuacuccggaggcuguggcaggaagauugcuugagcccaggagucugaggcugugaugcacuaugauugugucugugaauagccacugcacuccagccugggcagcauaguggguccccaucuuaaaaagaacauucuucacuucccuguuuccaagcaaagacugagucauagacacaagucaagguuaccuuuaccauuaaaauuuuaucagaaucagcccaacacuuuugaaaacuguaacuuaauaaaugucauuggcuggucacauggaaauaccuggcuucacuccauuucucugauguguugcacaccuagacucuggaugcccucgucaucgcuaccggacuggucacucuggugcuggaggaagauggcaccgugguggacacagaagaguucuuucagaccuugggagacaacacgcauuucaugaucuuggaaaaaggacagaaguggaugccgguaagcaaaaacacugucacccaaacagcuacuggguagacuuuuuaccuacaaauuugugugcccuacuuggguguugacuuguccacuuucuuucuuuuuuuuuuuuucuuuuuuugagacggagucucgcucugucacccaggcuggagugcaguggcgcgaucucggcucacugcaagcuccgccucccggguucacgccauucuccugccucagccuccggaguagcugggacuacaggcacccgccaccacgccuggcuaacuuuuuguauuuuuaguagagacgggguuucaccguguuagccaggauggucucgaucuccugaccucgcgauccgcccgccucugccucccaaagugcugggauuacaggcgugagccaccgcgcccggccaacuucuccacuuucuaaauaugcacuuuguauucaccuaacaacuggauccacugcccucaaagggauucuuacaaauguuucuaggaaacuuagucucucugugaacugaggcuauuugauauaaagcaaauaauuccagggaacaggcuuuggccagugaguagcuacagauccuguaaaugcacggaauugacuuggcaacucuucaccaucucuguucuuagaaggcuggagaaguaaacaccaucaaggaaguuagggagaggggugugugugcaugugugaauauggagauuuagaaaaguaaagagacagaaugaagccuucggucucugggaaaacuauagaugauauagcccaaaaaaccuucucaguauaaaaugccuaaaaauguaaagcacaauaucaaaauaucuuuucacauaauaaacugaucuccaagaaagagaaauccucagugguuaaaauguugaggccagcauccagagaggaacacgaacacugaagcuggcaguuccccaggcaucuccucugggguucccccaccugugagcacccacagaccucagggacagaugcugggaggacaggagacagccuccagcugacacaaagucaaggggugagaugugagggucugcguaaagcagggaaucuuagagcucucuccuggcaauuugggccacaagcugcccucaugaggguuuaggcauugcugagucccaaaccccuaagcugagaguucgguuuucagagaucugggggaguagcaucaauggagggguuugcucauuggauucucuuuacuccagccccguuuccaggauugauagugccccagguaacuagcaggagcucaggcaguuccgcuugggaugaacauccauccuggccucaaagaguuuucauucguaacguucucacaaugcaaguucacaaucaaaacacagaacguaaggacucaggcaccacauucaugagaguaagcagaagcaaucaagucaggccugccaggaccgcagauguuggaaucaucagacauacaguauaaaauuaguguacuaaaaaugcucacccauggcuaaguuugacugacuaaauaaauaaauuaauuaaaugcucaaagaaacauuaaaaauaaucuaaaauaagaauagcuaggaauugaagaccagccuaggcaacagcaaaaccccaaucuccaccaaaaaaaauuuuuuuaaggcuuagcugggcaagaugcuacacaccugaaguccuagcuacucaggaggcugaggcaggaggaucacuugagcccaggacuuggaugcugcaaugaacuaugaucacaccucugcacuccagccugagugacagagcaagacccuauaucaaaaaaaacaaaaaauaagaaaauaccagccugagcaacauggcaaaaccccaucucuaccaaaaaauacaaaaauuagccuggcguaguggugcauaccucuagucccagcuacuugagaggcugaggcgggagaaccacuugcuccugggaggucaaggcugcagagagucaugauugcaccauugcacuccagccccagggacagagggaaacccugucucaaaaaauaaaaauacauuaaaaaggaacaagagcuaauaagaacugacuauacagauuugaaauaaucaaauagaauuuuuggaaaugaaaaauauaacaacuaaaaucaaguaaauggagacucagguuagacagagcugaagguaaugauaaaagaucugaaagauguugccugugauguaacacaaagcaguagagguggggaacacgaaggauguuagagaccagacugaaaucuaaucucucucucuuuggcauccucacguagggaaggauuuuuuuaaaacaagauacaaugcacaagucauuuuuuuuuuuuuuuugagacagagucucacucuguugcccaggcuugagugcaguggugugaucucggcucacugcaacuucugccucccgaguucaggugauucuucugccucagccucccgaguagcugggacuacaggcacgugccaccacgccuggcuaauuuuuguauuuucaguagagaugggguuucaccauauuggacaggcuggucucgaacuccugaccuugugauccaccugccucggccucccaaagugcugggauuacaggugugagccaccgcacccggccgauuuuuuuauuuuuaagauauagggcaacacacuccucuacuaccaccaacagcuacuuaaugcagcaauuugcuucaucucagagagugaggcacagacuaugacccagcagcugcuuuccugggcaugaaccugagauuccaacaacaccacgucagcagguguguguuagagcguccauggcagcaaugcccuaaguggugagaacaaacacuggaaacaaaucauguacccuugcagcacacacgugugcccagcacauagaaguacuucuaaguaaauacacacgaagaaacuguaauguggucccugaacagaaugcucuucagcugugaaaaugugugaaguucagcuacaggcauccauguggauacacaucagcuaugcugagcaaaagaucacaggauaauacaguaaacaacgcauccucaaacuuuaucucaggaccucuuuacucuccuaaaaauuaacgaggaccccaaacagccuuuggcaugaucucggcucacugcaaccucugccucccuggcucaaguguuucuugugccucagccucccaaguagcugggaucacaggcaagccaccaccacgccuggcuaauuuuuguauuuuuaguagagacaggguuucaccauguuuuccaggcuggucuugaacuucugaccucaagugauccaccggccuuggccucccaaagugcugggauuacaggcaugagccaccacacccggcuuguaucaauaaauucuauagacaugugccaaucagagguucugagcugcagagacuuugucccuugggggacauuuguuaaugucugaagacauguuaggcuguugcaucuaguguguagagaccagagaugcugccaaacauccugcaaugcacaggacaaccccgacagcaaagacuuauccagccuccaaugucguuagugucaaggucgagaaacuauaagcuauagauagauauagauauucccaauagucaaaauuguuuuuuguuuguuugcuuguuuuuugagauggagucucgcucugucgcccaggcuggagugcaguggcgcgaucucggcucacugcaaccuaugccuccuggcuucaagggauccuccugccucagccuccugaguagcugggauuacaagugccugccaccaugcccggccauuuuuuuuuuuuuuuuuuuuuucauuuuuaguagagacgggguuuugucauauuggccaggcuggucucgaacuccugaccucaggugauccacccaccuuggccucccaaagugcuaggauuacaggcaugagccaccgcccccagugguuuuuuuuuuuuuuuaauuuguuugcuuuuuguuuggagacagucuugcucugucgcccacucuggagugcaguggcacgaucucagcucacugcuaccucgaccuccugggcucccccaccucagccucccaaguagcugggacuacaggcaugugccaccaugccuggcugauuuuuguaucuucuuguagagacaggguuuugccaugcuggccaggcuggcuucaaacuccugguuucaagcuccugagcuccagcgauccacuaccucugccucccacagugcugggauuacaggcgugagccaccccgcccagccaauauucaaauucaaauuguuuggaaguuacugauuagcauauuuuugaaagaaauuaaaauucagaaauuuaaaaauagguauuaauucauuaaaaguaauaacccaauacagauuaacuuaacucacuuuuuuuuuuuuuuagauggagucucgcucugucgcccaggcuggagugcaguggcgugaucucggcucacugcaaccuccaccuccuggguucaagcgauucuccugccucagccucccaaguagcugggauuacaggugccugccaccacgcccagcuaauuuuuguauuuuuagugggguuucacuauguuggccaggcuggucuuaaacuucugaccuugugaucugccugccucagcuucccaaagugcuggaguugcaggcacgagccaccacgaccagccaccagguuaauuuaacucauauuuuuaugaaaagugacuauuuuccaaaacaaaaagauggaggaacggcauuuuuuacauuuuuguaaauuucuuuaaugucuggcuuaauagaagauucuuauaucugcuucuuuauauucagucuguuguaacauauuguuuugauggaaguaugaagaaaauccauccugacacagauaugcagcugggaaaggaggaggauuuuaauagccuauucagauaacugaggauauucuuuuuuuuauauuaugccagaacucaccaagucaugguuucagaauagugaguugagguguuuucagaaaggucagaugcagcguguaaucugaagguauaccagugaaguuggccuccucuguuacagugaauccaucaguccgucuuccauuuugaauggaccuuuuuccuggggaugauuuuguaacagcaggcguuggucauugagaaaaacugauucacugaguuaugcagguuuuccaaaugugcuguggaaacagcacuucuugugagaacaaagaaggcaaacugcaucuuacuguuuauuauggccuuucuuucucuuuuucuuuuuuuucgaggcaggguuugcucugucacccgggcuggagugcaguggcguuaucuugguucacugcagccuucaccuccugggcucaagggauccugccaccuccuccucccaaguaauugggacuaccggugcaugucaccacacccagcuaaaugcuuguauuuuuuuagagaugggauuucuccauguugcccaggcuaaucuugaacuccugggcucaagugauccaccugccucagccucccaaaauguugggauuacgggcauaagccaccgugcuuggccuaguuuugaccucucagucccuuaauagggccucaggauuccuggaugucuccagauuacacuuugauaaacuccacaucaaaucauuuacagauaauucaaaaauaugcaaaauuaacaauauaauguuugagauacacaugugcuaaaaauagagaaaaguaaggggaaaacgcauggcauaaaaaccucuugagaggaggggagaugugggagguggauggggucucuaagggauggcaguguguagguuucauuuuacgucuuucugucccuuacuucuacauauauuauacauauacauauauauuauauauauaaccucacaauuuuccugacugggaaagaaaccacagaccaauuauaaaagcauaauauuuagaauaaaauguaaucuuuaauguagaugagggcugggcgcaguggcucacaccuguaaucccagcacuuugggaggccaagguggguggaucacaaggucaggaguucaagaccagccuggcccacggggugaaaccccgucuuuacuaaaaauacaaaaauuagacaagcaugcugguaggcaccuguaaucccagcuacuugggagguugaggcagauaauuguucgaaccugggaguuggaggugcagugagcugagauagcaccaaugcacuccagccugggcgacagagcaagacuccgucucacaaaaaaaaaaaaaaaaaaaaaaaaaaaagcagguggggagaugucuguagaugagacuauuaauuguggggugaauuagacaaaucauuuaaagcaaauauuggucugcauggcuuuuugcuugaggaaaguguaacagcaaaaauaaugcccccacagaccacagacaccucuguuuguuuucuuuucuuuuucuuuuucuuuucuuuuuuuuuuuuuuuuuuuuuuugagacaguuuugcuuuugucgcccaggagggagugcaauggcgugaucugggcucacugcaaccuccaccuccaggguucaaguaauucuccugccucagccucccgaguagcugggauuacaggcgcccaccaccacgcccggcuaauuuuuguauuauuaguagagacgggguuucgccauguuggccaggcuggucucaaacuccugaccucaggcgauccacccaccucggccucccaccgugcuaggauuacaggcgugagcccaggcggccggacagacgccccugucuuaauccucagccguggcagaugggauuaagugaagguuacuggggcgggguuggggugggguuuguccuggaucaucuggguagaggccgaagucuucacaaggguccuuaugagagggaggcaggugagcaugaaggccagaggcagaggaggaggagagaugugggguacccaccaaggcaggcgcccaagaagccgggaaaagcgaggggccgggccugccccgcagcccccacggcggcccugcgcccuggcuuugacucugaccucggcagugggacagcauugguguguggguuucaugccacugagguucuggucguuuguuacagcagcaguaggagaugggaaaggcggguuuguuuuucuaaaggagacacucagcuaacagggaggaguugguggugggcgcugggaaccugguugcagggcaggguggugggggcggucgaugccacggguguagaugccaccgccggccacgcgcuccagggggcucgcggcccccguuucggcugcgcaaccaccucccuggaucccagccaccuguaggccuuucugggcaaaaccaguuuagacugagaccagaacgcuggagcaggaagccgccagcaggugucucgcuccccggucccagcgcccucaggaagagcgcggccccgcagcccccgcccggcgaggccccagcggauccgcggcgggagggcgucauaauuuuaaccaagacuggagacauuuagggagaguaaaauuaaaacuuucaaaagucagaaagggaugugaggcucggaaaaagaggcgcgggacgggaggagaagcccucucugaugccaggaucugagcuuuccaaacacguuucccggcugagggcucgcuggcgcccccaagaggccgcugagagaaaacggccucagccucagcuuugagugugugugugggggggggggguuggggggggguuguuguuguuguuguuguuguuguuugguuggguuuuuuuguuuguucguuuguuuugagauggagccucacucugucgcccaggcuggagugcaguggcgcgaucucggcucacugcaaccucuaccucccagguucaagugcuucuccugccucagccuucugaguagcugggauuacaggcgugcaccaccaugccuggcuaauuuuuguauuuuuaguagagacaggguuucgccauguuggccaggcugaucucaaacuccugaccucaggucaucugcucgucucggccucccaaaaugcugggauuacaggugugcaccaccaugcccggcuaauuuuuguauuuuuaguagagacgggguuucgccauguugaccaggcuagucucaaacuccugaccucaggucaccugcuccucuuggccucccaaagugcugggauuacaggugugagccacugugcccggccucagcuuugauuuuuaaaguaauaagagggagcuacaaccgcuuagaaaaggaugaugaagucaaccucacccgagauuccaccucacaaaauuuuauuuucuuuuuccuucuuuuuuuuuugacaaggucuugcucugucauccagucuggagggcaguagcacaaucauagcucacugcagccucaaccuccugcccuguucaaggggugcuccugccccagccuccaaaagugcugagacuacaggcaugagccacugugccuggccacaaaauguuuccugaaagacaaauucaagucaaagacaaaugccugauauuuguaccuuggggcagcuuugcucucuuauauuuuuaaagugucacaggagggagagcuuuuaguugacagauuccuaauccauacauaccccagaucuauucaaacaaauucuguaugauccgaauuagaggcuacaacuggaaccacagguggguuugucuguauggugggacaggggaauaaagaaggcuggccacggcgaggaggguuuggguaauuuuagggguauuuacauuuuaaguucccauucaugaggucacugucauuggugaauuuaccauucacagcuucagcggcucccaaccucgaaggcucacaagaccuaguaacccuguguagacccgaauccugagugcugcaagaucuguauguggcacaagccacucagaaagaacagcuccuggccugucauuuguacugggggcagcuuugcucucauauuuuuaaaccauuuuguggggaaaauucuguuccggugcuguuuauaaaccugggauguguagaggucacugacuuccuccucccacccaggggggucuccucccacccagggguucugcugcauggcuuugggcuuccccauggaguccgcucucaacccugggggguuauuaaaacacagaggugcucugggaaggugcccacucugcccucacuucagccauaugauucugguacuuuccacccaguagcccccauaaaauugaaccaaugcugccugcuucuccauuaccauaacuguguuacagugaugagaugagauucuuuugucaccagguaaccaugguggccuccagggcgaguggguccccaccacucaucagggcacaucuauccacugagcaacgggguccuaaaauccaggcccugacgccacaccagacucacccugaguccggaacugaaggcagaucagggacagacgccucguggcuaauuggacacagucguagugugugcaaauggguccugcugaaagcaucucucuaucgauuagccacggagccgcucacagaccuuaaacagacacauaggagaaucugaagcuggcauaagagcagagugaugacgugggaggguuaggaaggcuccugaagccugccccuccccccauugucacagggcagccagcacguccccacuugcucgccgccgaagaggucgggaauagcgagagucaccuucgacuuguacaggcugaaccccaaggacuucaucggcugccuuaacgugaaggccaccauguaugagauguacuccguguccuacgacauccggugcacgggacucaagggccugcugagguaacacacuccaggggucaccuccgggggucugcagacugcacaggguguggcacaggcagcaguccccacccuguuccucugggcucccaggccggcuagcacuguuaggggcaguuggaguaauguugucuggaggucaacucuuaucccacaggcucaucucacacaacagaaaaucucaagccaaaacagauuuauuucuuccaaagaccacuaacuauucauuagaaacaaaagcuaaauaauaaauauaaagaggaaccacauucauuuuaagaacuagagcacuuaauucuaggugaugaugacuaaaaccagagccauggaggucguggccggguuuguacagaacggucaccuagacccuggugaaucacacgccuuugcauguaucuccuguacuccugauaacuucagccuuaccaguaauguggcaugggcguguguccucuccacauaaugccagggcaccgucaucccaaagacgaaggccaggcugguugcacagcaucccaggaaacagaacuuuuagaagacagacuccugauccagccauaccccagacccauucaaacaaauuccaugugaucaaaaggagccuuccuggguguuccugccccauaacugggugccaccccugccauugagccugggacugagagaaacaccagcagucccugcucuaaggaaucagcugugugaccuuucacagacuccuuaacuucucugagccuugcuuuuaucaucuuuaaaugagaagguuggucaggcaugguggcucacaccuauaaucccagcacuuugggaggccaaggucagcagaucacuugaggccaagaguucgagaccagccuagccaacauggcgaaacucugucucuacuaaauauacaaaaauuagcugggcgugguggcggaugccuguaaucccagccacucaggaggcugaggcaggagaauuguuuaaccccaggaggcggagguugcagugagcugagauccgccacugugagccauaaccacaccacugcacuccagacugggugacagagcaagacugugucucaaaaauaaauaaauaaacaaacaaaaaauaaauaaaaugaaaagguugcuuccaagcucuuuaugauugccagggcucuaacuacaccuacuucuacuccaguaaauuuaccguugauccuuaaagaacuaaccucuguggagggaguggaugggagaguggcugauugcaguagaaaggucuucaagucgaaaaguuuugcagcugcugccauuccagugcccccugcacgucccugugggcagggccgcccguuucucuuugaggguguuguuuccgucccccguggccuugacaacugcucugauuugugcugagcacagcaaaggggaaaugcccuccucucagaggucuccuggccucaccugaggugggccaggguguguggcuucucuguggccucaguuucccauucagagccaucaguggcugacucuaaacuacagucacugucauaguguuggagucuugacucccaggagagcuuccuuuuuuuugucuuuuccuuuuugccggguuaggagaaaauagcuuuacacuuggauuuuaaaaguuaggcaagagaguuacaacaacugaaaaagguaagaugaagaaagcuaaccucacccaaaauuccaccucagugaaaucuuuuuucuuuuucuuuucuuauuuuuuuucuuuuuugagacggaaucucacucugcugcccaggcuggagggcaggggcacgaucucagcucacugcaaccuccuccuuucaaguucaagccauucccguggcucagccucccaaguagcugagauuacaggcaugcaccaccacacccagcuaacuuuuguauuuuuaauagagacgggguuucaccauguuggccaggcuggucucaaucuacuggccucaggugauccacccaccucggucuccaaaagugcugggauuacaggcaugaaccacauuccaggcccuuuuucuuuuuuuuuaagaaagagggucucacacugucccccaggcuggagugcaguagcacaaucauaguucacugcagcuuccaacucuuggacucaagcgauccucccaccucagccucugaaagugcugggauuauaggcaugagccaccacaccuggccacaaagucuuucuugaaagacaaguucagccuucuuguuacuaauuuguauucucugauaaauccgaugacaccacaagcagccauggaacucacgacagcccccacacuggaggcaccgccugcuagggacccuguugugggugcugggggcagugggcccuccugaugagacagcugcccaggcuuggcuaucgcauccccaugggcucagucacugcugaauguccugcuacuaccuuaggaagggaagggauuucaguagcagggccccuagaacagcccagcagccgaagcccaggacacagcacaccugugcgggugcggccaucugcuccacacagagcuugccagccacucaacaagcaggccgcacuucagguggcucaugggagccgugcuucuugcgguggucuugggccagcagcaaggggguccucagggagcucacagagaccugcuccuggccagacccacugccacggcagcugcaucugugccagcccugggacacgugcacucugagagucagacagccaugcucuaaaugucagccuggccuccuccgagugccuuuugguggggggagugaaguauucccauccugucuguuucucacuggcccaaaaucccaagcuaaagccuccccaucugccucugccacaggagucugcugcgguuccuguccuacuccgcccaggugacgggacaguuucucaucuaucugggcacauacaugcuccgggugcuggaugacaaggaagagcggccaucccuccggucacaagccaagggcagguucacguguggauagggaugcaggcugucgccggcucuugagccaaacacuguguuucguuuggcucaaugacgaauguugaagaugcuuuuauguucugagccacaugcacuuggaggccgcuggucacgcugcucaggaguggugcccagaaaaggaaagggcuuggugguacaugaagugggggcagugggcagggugcccugggggggaggcauagagggcccugggggucaugggaagcgagcacgcagcaggcgugcccaggagcgugugcaugugucagagccauuugguccaucaucuccugcaauaaacccaucgcaagaaugaccuucaa

SEQ ID NO: 192906 - RNA, 23277 nt, Homo sapiens
uugaaggucauucuugcgauggguuuauugcaggagaugauggaccaaauggcucugacacaugcacacgcuccugggcacgccugcugcgugcucgcuucccaugacccccagggcccucuaugccucccccccagggcacccugcccacugcccccacuucauguaccaccaagcccuuuccuuuucugggcaccacuccugagcagcgugaccagcggccuccaagugcauguggcucagaacauaaaagcaucuucaacauucgucauugagccaaacgaaacacaguguuuggcucaagagccggcgacagccugcaucccuauccacacgugaaccugcccuuggcuugugaccggagggauggccgcucuuccuugucauccagcacccggagcauguaugugcccagauagaugagaaacugucccgucaccugggcggaguaggacaggaaccgcagcagacuccuguggcagaggcagauggggaggcuuuagcuugggauuuugggccagugagaaacagacaggaugggaauacuucacuccccccaccaaaaggcacucggaggaggccaggcugacauuuagagcauggcugucugacucucagagugcacgugucccagggcuggcacagaugcagcugccguggcagugggucuggccaggagcaggucucugugagcucccugaggacccccuugcugcuggcccaagaccaccgcaagaagcacggcucccaugagccaccugaagugcggccugcuuguugaguggcuggcaagcucuguguggagcagauggccgcacccgcacaggugugcuguguccugggcuucggcugcugggcuguucuaggggcccugcuacugaaaucccuucccuuccuaagguaguagcaggacauucagcagugacugagcccauggggaugcgauagccaagccugggcagcugucucaucaggagggcccacugcccccagcacccacaacagggucccuagcaggcggugccuccagugugggggcugucgugaguuccauggcugcuuguggugucaucggauuuaucagagaauacaaauuaguaacaagaaggcugaacuugucuuucaagaaagacuuuguggccaggugugguggcucaugccuauaaucccagcacuuucagaggcugaggugggaggaucgcuugaguccaagaguuggaagcugcagugaacuaugauugugcuacugcacuccagccugggggacagugugagacccucuuucuuaaaaaaaaagaaaaagggccuggaaugugguucaugccuguaaucccagcacuuuuggagaccgagguggguggaucaccugaggccaguagauugagaccagccuggccaacauggugaaaccccgucucuauuaaaaauacaaaaguuagcugggugugguggugcaugccuguaaucucagcuacuugggaggcugagccacgggaauggcuugaacuugaaaggaggagguugcagugagcugagaucgugccccugcccuccagccugggcagcagagugagauuccgucucaaaaaagaaaaaaaauaagaaaagaaaaagaaaaaagauuucacugagguggaauuuugggugagguuagcuuucuucaucuuaccuuuuucaguuguuguaacucucuugccuaacuuuuaaaauccaaguguaaagcuauuuucuccuaacccggcaaaaaggaaaagacaaaaaaaaggaagcucuccugggagucaagacuccaacacuaugacagugacuguaguuuagagucagccacugauggcucugaaugggaaacugaggccacagagaagccacacacccuggcccaccucaggugaggccaggagaccucugagaggagggcauuuccccuuugcugugcucagcacaaaucagagcaguugucaaggccacgggggacggaaacaacacccucaaagagaaacgggcggcccugcccacagggacgugcagggggcacuggaauggcagcagcugcaaaacuuuucgacuugaagaccuuucuacugcaaucagccacucucccauccacucccuccacagagguuaguucuuuaaggaucaacgguaaauuuacuggaguagaaguagguguaguuagagcccuggcaaucauaaagagcuuggaagcaaccuuuucauuuuauuuauuuuuuguuuguuuauuuauuuauuuuugagacacagucuugcucugucacccagucuggagugcaguggugugguuauggcucacaguggcggaucucagcucacugcaaccuccgccuccugggguuaaacaauucuccugccucagccuccugaguggcugggauuacaggcauccgccaccacgcccagcuaauuuuuguauauuuaguagagacagaguuucgccauguuggcuaggcuggucucgaacucuuggccucaagugaucugcugaccuuggccucccaaagugcugggauuauaggugugagccaccaugccugaccaaccuucucauuuaaagaugauaaaagcaaggcucagagaaguuaaggagucugugaaaggucacacagcugauuccuuagagcagggacugcugguguuucucucagucccaggcucaauggcagggguggcacccaguuauggggcaggaacacccaggaaggcuccuuuugaucacauggaauuuguuugaaugggucugggguauggcuggaucaggagucugucuucuaaaaguucuguuuccugggaugcugugcaaccagccuggccuucgucuuugggaugacggugcccuggcauuauguggagaggacacacgcccaugccacauuacugguaaggcugaaguuaucaggaguacaggagauacaugcaaaggcgugugauucaccagggucuaggugaccguucuguacaaacccggccacgaccuccauggcucugguuuuagucaucaucaccuagaauuaagugcucuaguucuuaaaaugaaugugguuccucuuuauauuuauuauuuagcuuuuguuucuaaugaauaguuaguggucuuuggaagaaauaaaucuguuuuggcuugagauuuucuguugugugagaugagccugugggauaagaguugaccuccagacaacauuacuccaacugccccuaacagugcuagccggccugggagcccagaggaacaggguggggacugcugccugugccacacccugugcagucugcagacccccggaggugaccccuggaguguguuaccucagcaggcccuugagucccgugcaccggaugucguaggacacggaguacaucucauacaugguggccuucacguuaaggcagccgaugaaguccuugggguucagccuguacaagucgaaggugacucucgcuauucccgaccucuucggcggcgagcaaguggggacgugcuggcugcccugugacaauggggggaggggcaggcuucaggagccuuccuaacccucccacgucaucacucugcucuuaugccagcuucagauucuccuaugugucuguuuaaggucugugagcggcuccguggcuaaucgauagagagaugcuuucagcaggacccauuugcacacacuacgacuguguccaauuagccacgaggcgucugucccugaucugccuucaguuccggacucagggugagucugguguggcgucagggccuggauuuuaggaccccguugcucaguggauagaugugcccugaugagugguggggacccacucgcccuggaggccaccaugguuaccuggugacaaaagaaucucaucucaucacuguaacacaguuaugguaauggagaagcaggcagcauugguucaauuuuaugggggcuacuggguggaaaguaccagaaucauauggcugaagugagggcagagugggcaccuucccagagcaccucuguguuuuaauaaccccccaggguugagagcggacuccauggggaagcccaaagccaugcagcagaaccccugggugggaggagaccccccugggugggaggaggaagucagugaccucuacacaucccagguuuauaaacagcaccggaacagaauuuuccccacaaaaugguuuaaaaauaugagagcaaagcugcccccaguacaaaugacaggccaggagcuguucuuucugaguggcuugugccacauacagaucuugcagcacucaggauucgggucuacacaggguuacuaggucuugugagccuucgagguugggagccgcugaagcugugaaugguaaauucaccaaugacagugaccucaugaaugggaacuuaaaauguaaauaccccuaaaauuacccaaacccuccucgccguggccagccuucuuuauuccccugucccaccauacagacaaacccaccugugguuccaguuguagccucuaauucggaucauacagaauuuguuugaauagaucugggguauguauggauuaggaaucugucaacuaaaagcucucccuccugugacacuuuaaaaauauaagagagcaaagcugccccaagguacaaauaucaggcauuugucuuugacuugaauuugucuuucaggaaacauuuuguggccaggcacaguggcucaugccuguagucucagcacuuuuggaggcuggggcaggagcaccccuugaacagggcaggagguugaggcugcagugagcuaugauugugcuacugcccuccagacuggaugacagagcaagaccuugucaaaaaaaaaagaaggaaaaagaaaauaaaauuuugugagguggaaucucgggugagguugacuucaucauccuuuucuaagcgguuguagcucccucuuauuacuuuaaaaaucaaagcugaggccgggcacaguggcucacaccuguaaucccagcacuuugggaggccaagaggagcaggugaccugaggucaggaguuugagacuagccuggucaacauggcgaaaccccgucucuacuaaaaauacaaaaauuagccgggcaugguggugcacaccuguaaucccagcauuuugggaggccgagacgagcagaugaccugaggucaggaguuugagaucagccuggccaacauggcgaaacccugucucuacuaaaaauacaaaaauuagccaggcaugguggugcacgccuguaaucccagcuacucagaaggcugaggcaggagaagcacuugaaccugggagguagagguugcagugagccgagaucgcgccacugcacuccagccugggcgacagagugaggcuccaucucaaaacaaacgaacaaacaaaaaaacccaaccaaacaacaacaacaacaacaacaacaacccccccccaaccccccccccccacacacacacucaaagcugaggcugaggccguuuucucucagcggccucuugggggcgccagcgagcccucagccgggaaacguguuuggaaagcucagauccuggcaucagagagggcuucuccucccgucccgcgccucuuuuuccgagccucacaucccuuucugacuuuugaaaguuuuaauuuuacucucccuaaaugucuccagucuugguuaaaauuaugacgcccucccgccgcggauccgcuggggccucgccgggcgggggcugcggggccgcgcucuuccugagggcgcugggaccggggagcgagacaccugcuggcggcuuccugcuccagcguucuggucucagucuaaacugguuuugcccagaaaggccuacagguggcugggauccagggaggugguugcgcagccgaaacgggggccgcgagcccccuggagcgcguggccggcgguggcaucuacacccguggcaucgaccgcccccaccacccugcccugcaaccagguucccagcgcccaccaccaacuccucccuguuagcugagugucuccuuuagaaaaacaaacccgccuuucccaucuccuacugcugcuguaacaaacgaccagaaccucaguggcaugaaacccacacaccaaugcugucccacugccgaggucagagucaaagccagggcgcagggccgccgugggggcugcggggcaggcccggccccucgcuuuucccggcuucuugggcgccugccuugguggguaccccacaucucuccuccuccucugccucuggccuucaugcucaccugccucccucucauaaggacccuugugaagacuucggccucuacccagaugauccaggacaaaccccaccccaaccccgccccaguaaccuucacuuaaucccaucugccacggcugaggauuaagacaggggcgucuguccggccgccugggcucacgccuguaauccuagcacggugggaggccgagguggguggaucgccugaggucaggaguuugagaccagccuggccaacauggcgaaaccccgucucuacuaauaauacaaaaauuagccgggcgugguggugggcgccuguaaucccagcuacucgggaggcugaggcaggagaauuacuugaacccuggagguggagguugcagugagcccagaucacgccauugcacucccuccugggcgacaaaagcaaaacugucucaaaaaaaaaaaaaaaaaaaaaaagaaaagaaaaagaaaaagaaaagaaaacaaacagaggugucuguggucugugggggcauuauuuuugcuguuacacuuuccucaagcaaaaagccaugcagaccaauauuugcuuuaaaugauuugucuaauucaccccacaauuaauagucucaucuacagacaucuccccaccugcuuuuuuuuuuuuuuuuuuuuuuuuuuuugugagacggagucuugcucugucgcccaggcuggagugcauuggugcuaucucagcucacugcaccuccaacucccagguucgaacaauuaucugccucaaccucccaaguagcugggauuacaggugccuaccagcaugcuugucuaauuuuuguauuuuuaguaaagacgggguuucaccccgugggccaggcuggucuugaacuccugaccuugugauccacccaccuuggccucccaaagugcugggauuacaggugugagccacugcgcccagcccucaucuacauuaaagauuacauuuuauucuaaauauuaugcuuuuauaauuggucugugguuucuuucccagucaggaaaauugugagguuauauauauaauauauauguauauguauaauauauguagaaguaagggacagaaagacguaaaaugaaaccuacacacugccaucccuuagagaccccauccaccucccacaucuccccuccucucaagagguuuuuaugccaugcguuuuccccuuacuuuucucuauuuuuagcacauguguaucucaaacauuauauuguuaauuuugcauauuuuugaauuaucuguaaaugauuugauguggaguuuaucaaaguguaaucuggagacauccaggaauccugaggcccuauuaagggacugagaggucaaaacuaggccaagcacgguggcuuaugcccguaaucccaacauuuugggaggcugaggcagguggaucacuugagcccaggaguucaagauuagccugggcaacauggagaaaucccaucucuaaaaaaauacaagcauuuagcuggguguggugacaugcaccgguagucccaauuacuugggaggaggagguggcaggaucccuugagcccaggaggugaaggcugcagugaaccaagauaacgccacugcacuccagcccgggugacagagcaaacccugccucgaaaaaaaagaaaaagagaaagaaaggccauaauaaacaguaagaugcaguuugccuucuuuguucucacaagaagugcuguuuccacagcacauuuggaaaaccugcauaacucagugaaucaguuuuucucaaugaccaacgccugcuguuacaaaaucauccccaggaaaaagguccauucaaaauggaagacggacugauggauucacuguaacagaggaggccaacuucacugguauaccuucagauuacacgcugcaucugaccuuucugaaaacaccucaacucacuauucugaaaccaugacuuggugaguucuggcauaauauaaaaaaaagaauauccucaguuaucugaauaggcuauuaaaauccuccuccuuucccagcugcauaucugugucaggauggauuuucuucauacuuccaucaaaacaauauguuacaacagacugaauauaaagaagcagauauaagaaucuucuauuaagccagacauuaaagaaauuuacaaaaauguaaaaaaugccguuccuccaucuuuuuguuuuggaaaauagucacuuuucauaaaaauaugaguuaaauuaaccugguggcuggucgugguggcucgugccugcaacuccagcacuuugggaagcugaggcaggcagaucacaaggucagaaguuuaagaccagccuggccaacauagugaaaccccacuaaaaauacaaaaauuagcugggcgugguggcaggcaccuguaaucccagcuacuugggaggcugaggcaggagaaucgcuugaacccaggagguggagguugcagugagccgagaucacgccacugcacuccagccugggcgacagagcgagacuccaucuaaaaaaaaaaaaaagugaguuaaguuaaucuguauuggguuauuacuuuuaaugaauuaauaccuauuuuuaaauuucugaauuuuaauuucuuucaaaaauaugcuaaucaguaacuuccaaacaauuugaauuugaauauuggcugggcgggguggcucacgccuguaaucccagcacugugggaggcagagguaguggaucgcuggagcucaggagcuugaaaccaggaguuugaagccagccuggccagcauggcaaaacccugucucuacaagaagauacaaaaaucagccaggcaugguggcacaugccuguagucccagcuacuugggaggcugaggugggggagcccaggaggucgagguagcagugagcugagaucgugccacugcacuccagagugggcgacagagcaagacugucuccaaacaaaaagcaaacaaauuaaaaaaaaaaaaaaaccacugggggcgguggcucaugccuguaauccuagcacuuugggaggccaagguggguggaucaccugaggucaggaguucgagaccagccuggccaauaugacaaaaccccgucucuacuaaaaaugaaaaaaaaaaaaaaaaaaaaaauggccgggcaugguggcaggcacuuguaaucccagcuacucaggaggcugaggcaggaggaucccuugaagccaggaggcauagguugcagugagccgagaucgcgccacugcacuccagccugggcgacagagcgagacuccaucucaaaaaacaagcaaacaaacaaaaaacaauuuugacuauugggaauaucuauaucuaucuauagcuuauaguuucucgaccuugacacuaacgacauuggaggcuggauaagucuuugcugucgggguuguccugugcauugcaggauguuuggcagcaucucuggucucuacacacuagaugcaacagccuaacaugucuucagacauuaacaaaugucccccaagggacaaagucucugcagcucagaaccucugauuggcacaugucuauagaauuuauugauacaagccgggugugguggcucaugccuguaaucccagcacuuugggaggccaaggccgguggaucacuugaggucagaaguucaagaccagccuggaaaacauggugaaacccugucucuacuaaaaauacaaaaauuagccaggcguggugguggcuugccugugaucccagcuacuugggaggcugaggcacaagaaacacuugagccagggaggcagagguugcagugagccgagaucaugccaaaggcuguuugggguccucguuaauuuuuaggagaguaaagagguccugagauaaaguuugaggaugcguuguuuacuguauuauccugugaucuuuugcucagcauagcugauguguauccacauggaugccuguagcugaacuucacacauuuucacagcugaagagcauucuguucagggaccacauuacaguuucuucguguguauuuacuuagaaguacuucuaugugcugggcacacgugugugcugcaaggguacaugauuuguuuccaguguuuguucucaccacuuagggcauugcugccauggacgcucuaacacacaccugcugacgugguguuguuggaaucucagguucaugcccaggaaagcagcugcugggucauagucugugccucacucucugagaugaagcaaauugcugcauuaaguagcuguuggugguaguagaggaguguguugcccuauaucuuaaaaauaaaaaaaucggccgggugcgguggcucacaccuguaaucccagcacuuugggaggccgaggcagguggaucacaaggucaggaguucgagaccagccuguccaauauggugaaaccccaucucuacugaaaauacaaaaauuagccaggcgugguggcacgugccuguagucccagcuacucgggaggcugaggcagaagaaucaccugaacucgggaggcagaaguugcagugagccgagaucacaccacugcacucaagccugggcaacagagugagacucugucucaaaaaaaaaaaaaaaaugacuugugcauuguaucuuguuuuaaaaaaauccuucccuacgugaggaugccaaagagagagagauuagauuucagucuggucucuaacauccuucguguuccccaccucuacugcuuuguguuacaucacaggcaacaucuuucagaucuuuuaucauuaccuucagcucugucuaaccugagucuccauuuacuugauuuuaguuguuauauuuuucauuuccaaaaauucuauuugauuauuucaaaucuguauagucaguucuuauuagcucuuguuccuuuuuaauguauuuuuauuuuuugagacaggguuucccucugucccuggggcuggagugcaauggugcaaucaugacucucugcagccuugaccucccaggagcaagugguucucccgccucagccucucaaguagcugggacuagagguaugcaccacuacgccaggcuaauuuuuguauuuuuugguagagaugggguuuugccauguugcucaggcugguauuuucuuauuuuuuguuuuuuuugauauagggucuugcucugucacucaggcuggagugcagaggugugaucauaguucauugcagcauccaaguccugggcucaagugauccuccugccucagccuccugaguagcuaggacuucagguguguagcaucuugcccagcuaagccuuaaaaaaauuuuuuuugguggagauugggguuuugcuguugccuaggcuggucuucaauuccuagcuauucuuauuuuagauuauuuuuaauguuucuuugagcauuuaauuaauuuauuuauuuagucagucaaacuuagccaugggugagcauuuuuaguacacuaauuuuauacuguaugucugaugauuccaacaucugcgguccuggcaggccugacuugauugcuucugcuuacucucaugaauguggugccugaguccuuacguucuguguuuugauugugaacuugcauugugagaacguuacgaaugaaaacucuuugaggccaggauggauguucaucccaagcggaacugccugagcuccugcuaguuaccuggggcacuaucaauccuggaaacggggcuggaguaaagagaauccaaugagcaaaccccuccauugaugcuacucccccagaucucugaaaaccgaacucucagcuuagggguuugggacucagcaaugccuaaacccucaugagggcagcuuguggcccaaauugccaggagagagcucuaagauucccugcuuuacgcagacccucacaucucaccccuugacuuugugucagcuggaggcugucuccuguccucccagcaucugucccugaggucugugggugcucacaggugggggaaccccagaggagaugccuggggaacugccagcuucaguguucguguuccucucuggaugcuggccucaacauuuuaaccacugaggauuucucuuucuuggagaucaguuuauuaugugaaaagauauuuugauauugugcuuuacauuuuuaggcauuuuauacugagaagguuuuuugggcuauaucaucuauaguuuucccagagaccgaaggcuucauucugucucuuuacuuuucuaaaucuccauauucacacaugcacacacaccccucucccuaacuuccuugaugguguuuacuucuccagccuucuaagaacagagauggugaagaguugccaagucaauuccgugcauuuacaggaucuguagcuacucacuggccaaagccuguucccuggaauuauuugcuuuauaucaaauagccucaguucacagagagacuaaguuuccuagaaacauuuguaagaaucccuuugagggcaguggauccaguuguuaggugaauacaaagugcauauuuagaaaguggagaaguuggccgggcgcgguggcucacgccuguaaucccagcacuuugggaggcagaggcgggcggaucgcgaggucaggagaucgagaccauccuggcuaacacggugaaaccccgucucuacuaaaaauacaaaaaguuagccaggcgugguggcgggugccuguagucccagcuacuccggaggcugaggcaggagaauggcgugaacccgggaggcggagcuugcagugagccgagaucgcgccacugcacuccagccugggugacagagcgagacuccgucucaaaaaaagaaaaaaaaaaaaagaaagaaaguggacaagucaacacccaaguagggcacacaaauuuguagguaaaaagucuacccaguagcuguuugggugacaguguuuuugcuuaccggcauccacuucuguccuuuuuccaagaucaugaaaugcguguugucucccaaggucugaaagaacucuucuguguccaccacggugccaucuuccuccagcaccagagugaccaguccgguagcgaugacgagggcauccagagucuaggugugcaacacaucagagaaauggagugaagccagguauuuccaugugaccagccaaugacauuuauuaaguuacaguuuucaaaaguguugggcugauucugauaaaauuuuaaugguaaagguaaccuugacuugugucuaugacucagucuuugcuuggaaacagggaagugaagaauguucuuuuuaagauggggacccacuaugcugcccaggcuggagugcaguggcuauucacagacacaaucauagugcaucacagccucagacuccugggcucaagcaaucuuccugccacagccuccggaguagcuggggcuacaaguacaugccauugcaugcggccgggaaguuaagauuuuuaauggaucugucuucuuaagauacaugagguaaugauuacauuaaauaauauuuguaauuucuaagauuaccuauuuauuuagaugaauaaaaagaaagcucuugcauguuugcugcuguaagagccacagccucgugugcguagcugagugucucucuugcuucagagacugcauguuggaugcuuguuucuuguuuccaugggugccugagucugaguuaugcuucucugagaggcugggauucuuccuuauuugguggucuaggacacuguucuagauccuggccuuuacaaccaaacccagacuuccaaagucggcuccaucccugcauccucccuugucaaagaaacaaagcaacauucuccauuagugacuguuuuaagguuuuugucucuguaccucaauguuuuaugguacagagauguaauguuccccuugaucauuuauaccuaaccuuuacucucagagucucugaggccaagagagggucugaugaguuuaacuugcuguuucuccuucuuucuuuuccuccucuuuuaaaaacagcuuuacugauguauaauucacauaucauaugauccacucauuuaaaguauacggugcagugguuuuugguaugcucacagaguuggcccaccgucaccacaaucaauuuuacagcacuuucaucacccaagaaagaaacuggcaugcacuugggagguugaggugggaggaucacuuaagcccaggaguuugaggccagccugggccacauggcaagauccugucucaaaaacagaaaaagaaaaagaaacuccauaaccaccagcagucauucccaauuucucuccccguuuccccccagugagaugcugcuuuucuugaucuuucugugcuggcccuggcuuagagcccaagaccauggcccugugugagugcagggcaccccuguggacugggggagaggugcgggauguggggcaccuugcugaugagcuccugcaggcugcuugccaucaccccacgccggcugcuccugucaugguuggagacccggaaagggcgagcuggaugcaugagcggggugaacaggacucgcuuagucugugaucccauaaaugucaggggccugaaaauggaggugaaaaguaaaacuuuuuaaaaagagucugucagaagaagugugaaaguacauaaaaauaaugcauuuuuaauauuugcaucuaaaagaaagaaauucaguuguugggauuacuaaaaauuauauauacaaguguacacauaauuccaaagaagaaacaaguaacacaucaagccaaaacacacauccaucuuuauuccuauuuuacuagaacauccaaaguccuugcugaaacucuuugagaaggaaugguuagggaauucaacucaaacaagaaauaagaauuauauucugcaaauaugggugggagauuuaaaaaauccaaaagaaugauuucuaguggccaugaaguaguuacgcagaguuagagacucagugcacucagacacgugcacauagcuacauguuuacacaauaaggguaagccagaaaucaauucaaaagugcaauauuggucacuauagcaaucaaugaaguuucugaaaucaacuuaggaggaaccaagaacagcagaaccacccuuagaacuguggcuggaaucacaagaaagaaaagaccuucagggcuuacaucacaggacacuuuggauuaaguccacauuuaucaaagaauuaauucaaaaauuuacuuuuuuuuucuccuuuuagauacagggucuugcuuuguugcccaggcuggauugcaguagugugaucucaacuuacugcagccuugaccuccugggcucaagcgauccuccugccucagccuccugaguagcugggacuauaggugcaagccaccauguuugucugaguuuuguauuuuuguagagacagggccuuacuuuguugcccaggcuggucuugaacuccuggguucaagcaguccucccuccugccucagccucccagaugaagcuuuugauagcaauuuaagaaaugcaaaaccugcugggcaugguggcucucaugccuguaauuccagugcuuugggaggcugaggcaagaagauagcuugaacccaggaguucgagaccagccugggcaacauagugagacccugucuuuacaaaaaaauaaaaauaaaaaaaaauuagcugggugugguggugcagcuauacucucaucuacucaggaaguggagaugagaggauugcuugagcccggaugaaccuagaaggucaaggcugcagugagccaagguugcaccacuguacuccagccuggaugacauagugagacuccaacugaaagaaaaagaaaaaagaaaagaaaagggaaacugccuucaacacaugauugcaugcuuuuaaaccaaaaagcaugaaggcaugaaauuuuauaaaaauaacuccaagaggggagacacaguuacccugcugcugucacuagaaggggggccaguagagccacauguagaguuuucacccaggaccgcagacuuuuguuuguuuguuuguuuugagauggagucucgcucuguugcccagacuggaaugguucaagcgauucuuccgccuccuggguucaagcaauucuccugccucagccuccugaguagcugggauugcaggcgugcaccaccauggccagcuaauuuuuuguauauuuaguagagacugaguuucaccaugauggccaagcugguuucaaacuccugaccucaagugauccacccaccucagcaucccaaagugcuaggauuucaggcgugagccagcacucuuggccgacuuuuuuacauucagaaauagauucauaacaaaaugauugcaaauaacacaaucagaaaucagcaaggguucaggucuuaccuagagccaggcaccgugauaguggcaucugugugaccucauugaauccccaugcccccacagagcaggacuggacacuucccucaccccggagagcacccaccuaccacaggugcucaaauuaguggcuauuuggacaaaugcuuguacacggacauucaagagaaugaaacaaaggguguaguuucaggacaaccuugaaaaagacacaaagugagcacaucacugcuuuuugacucuuagagcaguuuuucuggauuaacucacugaaugcuaaaauacuagggaacaccugcacggauugccaaugccugucaccugcgauuuggcacuuuaugacacacagccaucuauccaugcuuuauuuucuguauggauaaagacuucguuguuauauuuccuguaauaccuagcuuaguuguaggcacauacauuuuagauaguauauuaucuaacuuaaagcucugcaaauggauccaagugaaaauucaaugacuuaccaaauuguuuguaauauaaaaaaccgauaguuggcugggugcaauggcucaugccuguaaucccagcacuuuggaaggcugaggcaggagggucacuugagcccaggaguuagagaccaaucugggcaacauagugagacccucaucuuuacaaaaaauaaauugaaaaaaaaaauuagucaggcgugguggugcaugccuguaguccuagcuacuugggaggcugaggcaaggggauugcucgagcccuagauuggggccacagugcacuccagccugggcaaaagagugacacugucucuaaaacaaacaaacaaacaaacaaacaaacaaacaaacaaaaaacagaccaaaaaccugagaguagaguaacaagcuggcucucaaaaaucgccuuguugaguucacgcuaccagcuugaucccaguuucaggcuuuccauaaucgugaguguuugugccuucuccaggugccucaccaacaaagugucguucuagaaccagaccaaggucauuggcaagaauuuggucuggaguauccuuggccaggaugacaucagggccucauaacugcuggcaucuaagcaccauggccagcaguguauuagcaauuucagcucuuguuaauguuaguucaauuuuuguuuguuuguuuuuggagacagagucucgcucuguugcccaggcuggagugcagugaugccaucugggcucacuacagccucugcuucucggguucaagcaauucuccugccucagccuccugaguagcugggguuacaggcgcccgcuaccaugccuggcuaauuuuuguauuuuuaguaaagaaaagguuuucaccauguuguucaggcuugucuccaacuccugaccucgugaucugcccaccuuggccucccuaagugcugggauuacaggugugcaccaccaugcccauuaauucaauauuaauuaauauuagcaaauuauccucacaaccuugcaaggaaacuauugccccacuucacggaugagaaaacugaggcucagaguggcuucuccaagugggccagucaauaagggaaaaagauaaaaccugaucccaggucuguccaaagccaagacuuuuuuugguugugggagcagguuguuuuguuauccauccucugaacuucaaaucucaagcaauaaacaucuaucuagagggcugugcggaaaagcugcucuauggcugaaagcacagcagcgcuucgaguucaugcccucaacgccuuucccuucuggguagacaaaguugcuacacaguuuguuuucaaugaggcaagcccgagggaaaugugcuggguuggggcuccggaccugucagaaugacccgcacacguuugccagggacccaccuagccaaucagagccucgcccggccgggcugugcaccaacgcggccccaggacuggcacacagcuucugaacugucaccucgauuaagagagugacgcaggguucucaguuacacaaugccauaaacaacacugcugugcugacaccacggggaauucgggcacacucucacuccuggugacccggggggagagggcggugaggacgggcuguguuacauuucacguucagaacccuggcgucgccuccaccucaucauggcagcugaaauuuaaacuagcugaaguccccucaaggagggugacagaaaggcccaagugccgcuggaugccaaacccucgugugugagagcuagcgccuugccuuaccacuccuugggauccaccuuacagugaaaccuaggccuggggaaagcaggaggcgaaucgucagggcagcaaaggcuagaccagggucugaauccagcuccggcuuccacccagcggugcggcaccuggccagaagacgcggcucccacaagagagaagggcccggccucagcagcgagaaagagccccucuucgcccccaaggcaggaagucaccacagucuugcacaaggccucuagcaucugucucacggagucuggcggugcaucuccuacuuucccacagcgccugucagcacgccaucuauuuacugagugaaagaugcuaggccaaaaucagagaaaugagagaacaugguccaugucuuccaaugcuagguccagccccaguggucaaaggcgcagcccuggcccugcaucuccucauuggacgaacaugcucacgccuucguaagcaccugugcuccggugaccuggcccagaugauuaauuccagguuccugcggucuuuaccugucugacaagauaagagcuggcaaccauuucugguucucccugccuucaccugcccucaagauugccaucgucagugaaaaaacaccuauuguucucaccuguagcauuuccaaaccaagagcugcgucacugcuggaggaaaggcuggugggggcacagaggaaaggaaauuuacaccccaccuucuugucaaggaggaggugagugauuucugggucaaauuauguaaaaucaaggcugucucauauguaacacagaaagggguugaaugagauguucugcacgccaggccuauguacuccaggacccuacagguaccgaaucugcugcuacaugaacaagccaccgucuccacccaagucaccuccagcccgcugaguagagucaucucuaucacuggccaucagcaccgugccuaaaagcagggccacugagcggcccuaggauccugcguuuagacacaccacacaugagaacugccgcuccuaauuccugugaaagugggggcacacaaccacaggaaacagaaagggaaauaacccucuaacagggaagauauaaggaaacaguuuguuuaaggaaguaggcuguuucacagaaauccagagaggaaaagucagacuucauagaacgcugugaaacggcaugucucucaggaacaggugggaagggaagguuuuguauucugccccgagggaggcagggcgccgccaacuuccaaaagugugugaaauacaccaacaagccacagacugacaguagaccugaacucuucuccaguaaaacaaaccugagccguacagagaauuaaaaagcuuucuuuacaugccaccuauggaggaaaagggcccaguauuaaggucuuccucaaagugaaauauuuuggugucaugggugagggggcagcaguacaggcuguguaaaauagugccugggaauauucagggggcagugauggcugagggaacucugcaucucaucauuaggaagaaaaagaggcagccaccgugggaggaagaagcaguacacaggaauuggacagaagccaaccgagcacugucaccaagagcagcagggaaugccaaggagggaagugugaggucaagcacagccacgcagagaaggaagggagggcugggaaagugcuccacaggccuggagaagagucccugagcuguagagacagugucagaggaugguggggucaguggcaggaagcagggaagcaagugcugccuugacgagacuuccugcugcccggcuccccuagggcucuuggacgugacauaugcaggugggagcacaccuaccccccagauaaacucgccccgacaaggacugccugguucauggcucaguucuucgcaagcuaccuaaaggcuugacauuaucaaguguucaauacaugaccaugaagucuuugaacacuuugcaguuucguuaaaauaagaauuuaaauucaagaagcagaaagcugagagauugacuuguagcauacuuaauuccuuacuaaugucacuaagaagacuggugaaauuuguacugaaauagcagcacaaaaccuagaguuccuuguucaaggaaaggaaaaaugugcuagauagcuaugaaagcagccauuucacacgaagcuuauaacauguaccagcuucauaacaacuucagcguuuggcaggaauguuaucacuggcagaacacaggaacagagcagacuuugucugugauagucaaccugcauguggaccuccuugaugucuggagcuuuguugugagaccucaggcugcuuuccucaggaccaaggccccuaacgauucuagcugacuaacaaaugccuggguuaagguuucaccacugacuacaaguaccugauuuuuaaaaauuuuugugcacauugauucgguucuuuccuugguaaaauguaguuacuaauaaagacagaauuaugacauccuggaccugguuuaaauuaaggaacccugagaggaagccgaaguccagcaagagcacaauuagcaaauauguuaggaccuggccucuggcucuuuugcccggacaggguuuuagagaggggcagggaagaaaagguguuuucccuucaacaagaauuacagauuguuuucuuccaguuuaguuugguaacagguagauuucacagaaugacaguaguccagccugggagcagguagauuucacagaaugacaguaguucagccugggagcagguagauuucacagaaugacaguaguucagccuggaagcagguagauuucaaagaacugcagcaacagcuuguccauaacagguagagucauucacuccugggaugagccaagcuggaaggaauguguccuaggagacucaagguuucccaauguuucauuugucaacagcucauaagcaagucacuuccacuucacacgaccucacagagaccccacacagaugcauuuuggauuuuggugagcuguuauaauagucagaggcagggacaggcucagccugaauccugcucagaggccaaccaggauugguuagugcgagucagcccacaccuccuucccccaugcuccggaggaacaguggguguguugugaauucacuggaaaagugguuggaaggacgcauuccaaacugcuaagaccuccccuccuggaagugggacugugguguggaugguucuggaagaacgcaaaagauacagggcccugaccuuuaggccuaagcguguuaaugaccauacacgaagcagguguuucucagcgucccccugccaccgccccgacuuguacugugggcuuauuuuuaaagagaaagaugcuucuaaccugcagugucuacaacagcucccauuuaagaacccgggauuggaagcucauagauugcguuucguagccggaccgcucccuuucacacauguagucucucugcccgccacacguagcacacacagugggacccggcgccgcugaacgccugcaccuucaagcccgcaaaugguucucuauccuuuuccagguacuugaucuucagagaaacacgaucucccucuuagaccuuacuuuacaguugcugccacgcaaugacuuaggauuuuaccaagaauuggcuugggucuguugggauaugaauauuaacccaagcaggaaaauagccaaugcugccuguucgaccacgagcgggugcgaagcgcagggaagacuccucaggguccacccgccccuuguccccccugcuccccaggcagcgucuccgcccuuggacccggaggcaaggaggagcgcuucucccagcaccaccaaccuggagggcuccgccggacgguuggggccuccccucggagaccagagcccgcgcuuccaggaggggccaagccugggccccucccgcgcccagcucccguugugauuuccaggacccccagaagcccgguccccucgcaucgcggaagcuuugcucgggguuccugggaccggacccucuucugcgcccgcgacugcagcagcggccagagaugcaugcagccacucgccagcugucaccugguuugcagacgcccgcgcaccucgcaagagccacaccugguaccugugcccagcugcaagagggugaggaggcgcgggacgggauugggcucugcccgcgggcgcggcuggacggcuugggcaccaguggggcggaugggugugugcgcggggucgcggagcgcaagagaaugcggggagcagggggcugaagggagcgggguacgguacuagaggcgcacaggggaauaugaggccaccgaacgcaaggcgauuggaagcgcacggcaaucagggggacgcggggcacucgccugaugagggcuccugcauagucccgggcggccuccauggcgcggauccccuagcgggccuggaggucugucugccugcacagccucuuaaagugcggcggcc

SEQ ID NO: 192907 - RNA, 23510 nt, Homo sapiens
uaacuuaauuuuugcuugaaaacuuuauuaaaauaaggauuaaaccugaaaaaagaacaaucagaaugccagcccuuugcauaaaaucagcaagaaaaaggacagaaagagaaaaaagaagagcaucaguccucuccacuucuucccagagacuuagguggggaggagaauacccgcugcccugcagugccugcagccuguagcggggagagcugugggcagguucucugucucggggcucagugggcuauagagaaguaaguucccaccagagcagaggcccaagagucacagauaccuaagcuagagaauagauuauccugaggggauauaaacuccaggaaguugaucagggaacaggaauuugggaacaaacaauuauucugaaagccuggagagccugaagaggcaggggccaugcacacgagccucuaacugcccuugggugccacgaucugcuggacauaguugacaacauugcuguggagcugggaggcgguggaugcaaaagucuccuuggcgagggucugggccaccucacugccacccaucauugcgugguacagcggaaguguauacuucugcuuccccugcaagaaacacacauacacaugccuaagaagcuugccugguggaucuguccagcccugcugcccccagugccagucuaacagcagccauggcuaggugcuaaaagggaugugggcaucacagcuggaaugaggagcuucucaucagaagugcucuaauucaggcaucuucuugggcgccagagauccauggagauggaucucaauacgcgucccaauccauacuaacauggggacgucuacagucaacaaaaugaaugaguuggguggacacaaugggauuccagacuucuggaaagguguagguggugagccaccacgugaauagcagauaucagcagcugcggcacauaaagcucacagccgcauacgguccagcugcagucaagcaaaggaaaacccacaggucaacccacaggucaaauucacacaaauauaagccagcgacaucacaaguuccuaaaauccagagccuugaggaagccaucaaagggcucagaauauccccgaacaggcaggcagcccugacuuuaugcagagcaaugcuucgucuccgguccagccccucccugcuccggaaucugaugacauucaguucauccugagagcccggggccuuuccccaacagggcaacuuucacauagugacagagggucuggcugcugucccgaucaugcccaagucacagggcagcagggaccuauccuccaagccuuuguuccucuugcuccgccucuggccccuuucccucuuguguuucccacaugacacugucacccucuuucccgccucugcguuggcucuggccagcuuuuuucccuggggucucaccagcugaauugcagaaagcacugcaagccugcaggccuccucuugucccuagggcaaugccuucaaagccacacuaguaaagaggcugagugguaggguccucaggucauuugccccucccucugugccucagaugaguccuagaugagcccugcccacaugauuacuucacauauggccgagugggucccagugugcuuucgggaacagcgaggcaggggucacccaccugguuaugcaggaacuccuucacuuuccagaaaucuuccugguggucguucuuaaggacgauuuggccccaucgcagccggagcucugcauuccgggcauuugagauacuuggguaugugucuccaaguuuuuucacauucccuggagaagagaaagaaaugguuuguggcuggucacggugggucacaccuguaauacuagaauuuugggaggcugaggugggcggaucacuugaggucaggaaugugagaccagccuggccaauauggcgaaaccccaucucuacuaaaaauaccaaacaaaacuggccgggugugguggcgcacgccuguaaucccagcuacuuggaggcugaggugcuagaaucaagaaucacuugaacucagaagguggagguugcugugagccaauagcaccacggcacuccagccuggucgacagagcaagauuaaagcagacauauucccccaauaucugucccauuuuuucuccuaccacucaucugcuaaaagucaucuuggcucuaacuuuuuuuuaaccccuuggugaauauuauguugacugagcagccacaaagcauuagagguugagagcucuggaugacuggguucugugcgaacuguuuguaccucaaguucauucugucaccuggguauuaacaucacaccgccuacuucccagaggaguugugggaauuaaaugacuuaauagacacaaaagccuuacaagagucgccugcaggagcuucggacuugagcaaugccaggcuuugugacuuuguccuugaggugcuuguaaguagaacccauaaccucccgauggcacauuccuuguggagugccagccucccuaguguacguggcaguccccuaacccauaaccucccgguggcacauuccuuguggagugccagccucccuaguguacguggcaguucccuaggggcaagcaucacuacuuuuugugagccucccucuagccccugacauaaagcugugcacacaaggagcccugguucaccauuuuuucuuaccaggagggagaggggauuucuggaggaucuuauccaggaaguagaccagcugguaggucuuccagggagagauggccacggcuucaauggccuucauguccagcuccucggcugcccacaguugggcuagcucuucagcaggcuucaugagugaguccccaggggagagaucagggagguacgggggccagccggggguauucagccaucgaucaaacucaaaaccuguuugggaggagagaagacacuaucagaauucucuggccagguuacggucaacugguuuaagcaacucccagagaccucaaguuucuccucucuccaucccaaacucuuuccccagcauuuaacauuacuuucccauguaacuauucgcuccagcaggguccuaguuauaacgacaucuagagacugugccguuucgaccgugaaagugcuuuucgcuccaaauuagcacuguguugucagagccaaguugguggaugcucuauucacgugcacauucuccuaccgaucacaaccacacuguacuuaagcacccaggcucuaggaccaggcugccuggguuccuaccccugcucugucauuaaccagcugggaggccacgggcauguuacuucaccucucugcaccucaguuuuaucuauaaagugggggugauaggcccugccuccgugaugguuaugaggauuacaugagcaaauaaacauuaaaagcuuagcguaucgccugaugcauaguaaguacucuggaauuauuaacuaccauuagcuccggaguccccgcauuaaaaugcaagccuccaaccgaacaguaggugcugcuaaaguccugaccaauccuacugucagaggacgcggacuucaucaaaccaacaauagagugacucaagguucaggucacagcaagaaguggggguaugucuaauggauugugucuuccaugacaggacauuuuucguuuuuucuuuggaagugguaccucccaggcagaaacuggcggcugggcacagcggcucacgccuguaaucccagcacuuugggaggccgaggcagguggaucaccugaggucaggaguucgagaccagccugaccaacauggagaaaccccgucucuacuaaaaauacaaaauagccgggcgugguggcgcgugccuguaaucccagcuacucgggaggcugaggcaggagaaucgcuugaacccggcaggcggagguugcggugagccgagaucgugccauugcacuccagccugggcaacaagagcgaaacuccaucucaaaaaaaaaaaaaaagaaaagaaaagaaagaaagaaauaaggagggccacugggguugccuucacucagaaggcuguaggaggggugcugccuccgcuccugcccugugaguuuuagcuuggggcaguggugcggcagcaguggcagcucuccaggcaaguuaagggucugacuguguguccaggugagaggagagaguaaggaaacagacugggagaaaaugaggcagagaggagugaaaagaagucauucuuguggaauaaaucccaggauucuggguuugcuucccaaaacgccccuaccuagcugacucugacccaguguuuucccauccaccaccaucuuuccgagugucaaugagaucucauucucuacuauuuuuuagaagccugugggccaguuccucugcuuaccuggaaugauauccacucucuuuuucuuaagcucagggaaauauuccaaguagaaguccagaaagucaucggcuaagaugcuucggaauuugaauucaugcacauaggccugugaggagggaaagcucuuuagacccucucuggccccguggggaguggugucccucuguguccuggguccuccuccaaccccuuacaucuuucgcccccugccucuacccuugaucaggcccaguggcuuuauccgcuccucuuccuucuccccucaugugacuauaccuugagaaaacugucaaacugauccugaucacccaccaagugggccagguaugaaacaaagcagaaaccuuucucguagggggucucauuauaggugucguccgggucaacgccuggcagaggagaaagcagacaagauuugagcuuuuguagccugucacccguaacguucuucucuagcuccacagucaaagacuagcgauggaagagaucagaauucagcuuccccagggacagcaaggccaagaagguguccagauccuggccucucuccagaucuuggacucucucaaggccaagacucucucucuuaagaucucuaucucaaggccaagaucucucuccagauauuggccucucucaagguacuuccaagaucucagagggccauucacuguggaucuaauaugaagacagagaaaccagccuuccagaggagcggacacauuuccuuagucccaggauacacuuuguguggguagguuccaucagcauuucccacugagcaccaagcugugucuuuuccaucccuauuggucaccaccuaaauacucaaccuacccucccagaucaauguuuuuuuuuuuuuuuuuuuaagacggagucuugcucuaucacccaggcuggagugcaguggcacgaucucagcucacugcaaccucugccuccuggggucgagcgauucuccugccucagccuccccaguagcugggauuacaggugugcaucaccacacccagcuaauuuuuguauuuuuaguagagacaggguucuccauauuggcuaggcuggucucgaacucuugaccucaugauccacccgcuuugaccugggauuacaggcgugaaccaccaugcccagccaauguguuguuuuuacagcuguuccaggcuaaaacuaauuacccgucucuaagaaauucaucugcaaacuuaacggcaucaaggaacaugagcuucaauugcauaaaaagguuucagauuagucacacauggaaugaaggaaaauguuaggaaguaaaaagaucugaauuuggagagaggacccggaucucaguugcagucaugcacugauuagguacaugaccuggacaagacacuuaacuugucuggcacucagucccauccucuguaaaauaaggcuaaugcuuuuauucuacagaauccacagaucugcccugaugaucaugaaggaaugcgaaagagccugguaaaacgauauggacuugugcaaaugcaaagcaauggugaagucaucacgaaccgcacagacuggacagaacuccuaucuggcugcaauggcuuggguucagucagcccaggggccagagaauuggcuacaaagagcucuggagugccccucccuccaaauaaaguauucuaagcgugcacugaucaacaugaaguucgcauuaacuuggggcuccaagcucaauugaggggagugggugucagacagaggagccuccuggaccugguucaaucuucacgcggagcuuguugaguggguuuuccucuccagugauguccaugugcugacgcagcagagcccgccccguugcagccuccaagcagguguacgcagcgccuggugcagaaucaaacguaagccucgggaaaacgucugucaccacauccaaguguauuuuccugacagagacacugugcugccuccuuguggccucaagaagaacagcgacagauaccugaagcuuaauaacauuacccuccuggggacccagggcaaauagggacaguuacagagagccugacucagucccuagcucccuguugcugugggcuacaaaggacuugguuaacucaggcuguuggucucucuccuaagugaggacugggggaaucgcaccuuucugacaguuaccuuuccuuaucaaaguacuguauuuuuauuuuaucuuauuucauuuauuuuauuauuuuauuuuuugagacaaagccucacucugucacccaggcuggagugcaauggcgugaucuuggcucacugcaaccuccgucuccuccuggguucaagcgauucuucugcaucagccuccugaguagccgggauuacaggugugcaccaccacgcccagcuaauuuuuguauuuuuaguagagagggggcuuuaccacguuggccaagcucaaacuccugaucucaggugauaugcccgccuuggccucccaaagugcugggauuacaagcgugaaccaccacgcccagcccccggccuuauuuuuagaaaaugauuugauuuuuuuuuuuuuuuugagacagagucucgcucuguugcccaggcuggagugcaguggcacgaucucggcucacugcauccuccaccuccuggauucaagcaauucuccuaucucagcuuaccaaguagcugggacuacaggcacacaccaugaugccuggcuaauuuuuguauuuuuaguagagacggggguuucaccauuuuggucaggcuggucucaaacuccugaccucaggugauccaccugccucaggcgugagccaccaugccuggcaaugacuugaucuucugugaaaacuuagaauuauuuucaucuaacuguuucugucagacaaaagaaauuaucaaccccaaauuuuuaaggaucucuaagucuccuucugcauuaaaaacaaugacugagggaacaguggagggguggggcacaggguuuuggaaccagccagcucugcccuuuccuagauguuuugacucugaguaaguggcuuagccucucucagccucaguuucuucaacuguacaaugggauaaaaauauuugcuugcaggauuccuaauggcugauuaagauauucacaaacaggcucuugcuauauauauucugaaugaaaguacagaauuuguacaaacuuucuggaagauaauggacaauauguacuaaaaagacuauguaauuuaaaacguucagggccgggcgcaguggcucacagcuguugucucagcacuuugggaggcuuagacaggcaggucacuugaggccaggaguucaagaccagucuggccaauaugccgaaauccugucucuacuaaaaacauaaaaacuagcugggcaugguggugcaugccuguaaucccagcuacagggagugggaugugggggagcugaggcaggagaauugcuugaacuacggagguggagguugcaaugagccgagauugcaacgcugcacuccagccuggcaacagaacaagacucugucucaaaaaaaaaaaaaaaaaaaaaguucagacccagaaauuauguuucuaagaauuuaucauuguugaaaucaucugauaugaauagacauuuauguguaaggaaauuugucaacauauuucaauggaaaauuggaaacaaccaguaaauuaaaaaacauccauauaugcagcuauagaagaaaaucuaaugggcugggcaugguggcucacgccuguaauccuggcacuuugagaggccgaggagguuggaucaccugaggucaugaguucgagaccagccugaccaacauggagaaaccucgucucuucuaaaaauacaaaauuagccaggugugguggcgcaugccuguaaucccagcuacucgggaggcugaggcaggagaaucgcuugaagccgggagguggagguugcagugagccgagaucgugccauugcacuccagccugggcaacaagagcaaaacucugucucaaaaaaaaaaaaaacuaaugaccuggggaaauguuuuuuuaaaaaaaagucaguugucaaaccaugugugguuugacaauucauacauacagaaaaauguuggauacacacuacugccucgucucuucacacccacuuguauucugaaaccccauaaggagaucacacuggccccacagguuaagaaugggaggcagacuccuuaggagaggggugggcacuuuaccaaagaggaugguggagauccuccucugggcguacauggugaaaccuucauugagccagaauucaccccaguuggcguuggugaccagguucccaaaccaacugugggagaucucauggaugaugacaucugccaaggagcgguccccagcuagcaggcagggggugacaaaggucagacaaggguucuccauuccuccaaauggaaaggacgguggcaugaagagcaagucauaccugccgagaagcggggaggucaccaagaggcccuggcuucccggagcagacccuaccucgccucccuuuccagccuauuuccaagcccuaacagaugcagucacuaaacaggcagaguacgacuucgggcccagugcggaaaauaaagcccaggcuccucaaugcuucucccacguggcuccccugccuugcugggacuucccucaucgagguggugucugcucuccuggagcucacucuccaggcauuuguuucccucucuccuuccaagcagggguggaggugauaaauguauuaucagcuccaucacauggaguucccuggaggccaacuuggggucauaaagaccaaccuggagccuuuuaucuaaggagccuaaagucugaagaugucaaaguuaaaaacagaguguggggaaacuuccagcaaugggaaaacacaggucaacaaaggaccuugacggugcugccccaucucaaacuuggcaacugcaggucacauuuugaacaccucaagaaccucuucucugccgggccugguggcucacaccuguaaucccagcacuuugggaccaagguggacagaucaccugaggucaggaguucgagaccagccuggccaacauggugaaacccugucucuacuaaaaauacaaaaauuagcugagugugguggagggcgucuguaaucccagcuacucuggaggcugaggcaggagaaucgcuugaaccugggagguggagguugcagugagcugagaucacgccacugcccuccagccugggugacagagcgagacuccaucucaaaacacacacacacacacacacacacacacacacacacacacacaaagaaccucaucuccuaggcccucuccucagcaacagugagaagccuggcucauacccuccucucuuccuccucuccuucacuucugggaucagggaaacuuugcucugggaggcaggagguggaaaagccacacgaagaggaagaauggaagccagugacucaguuuaacaggagacacuagagucaaugugauaccacaccuuccccaaacauaagguccaaaaagcuucucuccuguugccaaaaauucuucuaucaccccguuguacuccuccuuggcagcaucaaucaggcagggcucagcccacacccggcuccuaaagacaagagagcagagaaagcagaaugguguuuagagaccaucgcagugaccugauccugaaagcaccuguaggaaauuggccuccgccaagugaaugugacaaugcagucagccacagugacggagugcaagaucggaucaccacacagauccaagagaccgcucaccacaccugagaaacaagaacccaagacagccucauggagguggaaccgugcuacgcaguuauggcuucacuacugaaugcgaucuugcaaaagugauuuaaccucugugagccucaguuuccucaucuguaaaaugagugaagauuaaauaagacaacacacaaaagcccuucaaacauuuauacaguaaauguuaguuuucuucucccuacuuagaggagagauaagaaagcguucuaauaguagaaucuggaauugaauaaaaccuuaagagacaaaccuuuuuuauuuuuuuuuuaagacagguucuugcucuguugcccaggcuagaguacaguggugugauccaaccuccaccuccuggggcucaagugauccuuccaucucagcuccccaaccccaguagcuaggacuacaguugcacaucaucaugccuggcuaauuuuuuuauuuuuguagagguaggguuucgcuauguugcccuggcuggucuugaacuccugggcucaagugauucaccugccucagccucucaaagugcugggauuauaggcaugagccacuguguccgacccaaaccuacuaauguuaauagaaauuuguuaacugccuuagguacaauaaugggauugugguuauaagggagaaugccucuauucuucagagaggcacacagauuuacuugcuuuuaaauggucuagcaaaaauaaaaacaaauccacucauaaaacuaauaugacaaaguagaugguucuauagguguucaaugcaucauccuuucaauuuucuaaauauuugaaauuuucuuaauaaaaagauagggaaacaaagguggcuuggaggaaacaaaaacaaaaacaaaaacaaaacaagaagauccagucuaauggaaagaugcaauggacucagggauccugcagccaaaggcucugcuugaccaagagccccuggcugcgcuuagaacugcuuuuccacacagacauaugaaugagacuggcugggccugguggcucaugucuguaaucccaguacuucgguaggccgaagugggugguucaccugaggucaagaguaccagaccagccugaccaacauggugaaaggcuguuucuacuaaaaaaaaaaaaaaaaaaaaaaaaaauuagcaggacaugguaguguaugccuguaaucccagcuaccugagaggcugaggcaggagaaucgcuugaaccuggguggcagagguugcggggagccaagauugcaccaucgcacuccagccugggugacagaguaagacucuguuucaaaaaaaaaaaaaaaagagacugauggcaaagugggauggguccaggcccggaugagggaaaacuuccucugcguuugcugaagcauaggaacuauucuaacaggaagaaaagauacagggaaaccaguaucagguacuucccaaauaucaaaagcaaagacguagccauggaacacugcauaugcaugugaggaagcaccgagagucugggauuacuugaggacaggaucagauugcaaugagggaggcaguggcaggaggugggacaugagaugcccaagagggucgggucaugaagagccucaggugcacuguuacagaaccggaccuucagagccaugggagcauuuuaagccaacaagugacauuaucagauuuaguuuuaagauaucauccuggcugcagaacacagaaaauauguuaaacuacaagaaugggugagcucuccaaggaaagcauguagaagaaaagaacaggucaaagacagagccuugggcaacaucgacacacaaggagcugggcagaggagucagggaaggagaugagaaaaggacuaaccaggaggccugaugaccagcauggguggugucacagaagccagaggagggucaaugggggcagaagaaaaacagcagaacaugaaggcaagggcuaaaaagcaucacauauguuauccguauugaggcgaauggccucucuuacuaguuucaacggcauggcaaggguggggggcuggauuccaauggguuguagcaauaaaugauugugggguggggggguuucaagaagugcagccagugcguauacaugccacugaagucaccuggcuacagagggaaggacagugugucgugccagaagagaauauggaguuaaggguuuuuugaguuguuuguuuguuuguugagacggagucuugcucuguugcccaggcuggagugcaguggcgcgaucucggcucacugcaagcuccaccucccggguucacaccauucuccugccucagccucccaaguagcugggacuacaggcgugagccacugcaccuggccgaguuuguuuuuuuuuuuuguuuuggcuuuuuuuugagguggagucucacuuugucacccaggcuggagugcaguagugcaaucucggcucacugcaaccuccaccucccacguucaagugauucuccugccucagccuccugaguagcugggauuauaggugugcaccaccauguccggcugauuuuuguguuuuuaggagagaugggguuucaccacguuggccaggcuagucucaaacuccugaccucuggugauccucccaccuuggccucccaaagugcugggauuacaagcgugagccaccacacccagccuugaguuuguuuuuugcuuugcuauagaucuuagagaaacuggugcuugucuagagggggaggcugcagauuugaagagagagauguaaaugaugaggcaaagucccagaggacauguaagggaagagauuuggcuuuaaacagaaggaaggaccuuuguugcaguccggaaggauaaaagcagaugaagauaacuuuuuaaguggaggacaggaaacugacauaaucauaucugaugaauuuaauauucucaauaaaacaggagacaagaccuucugcuuaaaugaggggaugggauuggauagcaaacuuaaagagaagaguaaagucuuagaacagcuuaaagggagugagauggaaagguaaauaagaggacuguugaacaaccuugaaagcacaccugcaguugaagacuguacaucuguuacauuuuucuggaaaaccccacacaugucuauuucaacuuuccuuuaauuccaacuuuucacgaagaauugagaaagguguagugguuauuacuguguaguuucacuauuuucuacaucucccaaauacccacuuauagaaguagagaaaaggaauuguauaacaagggacugggacauuauagcagcgggaagugggcaaggggcuuugggguguugguaagagguaaccaaccacacacuugggccagggagggaagcccagucaggagggucuugacugcccaggagaaaugaguggcuugccggaagggaggcugccaugagcucaaggaggagacaugguggaauauagugggagagaggccgucagagagcuggaagguuagcagagucaggaugaaugaggacaaggggcucaagggccuuaaaaguucagauaugguacaguucaugacaaugacgaugucuaggcucuagacuccagagcaugggugugaauauggguggcugacagaguggagaaggcucccugaguagaggucaagaaacccugaagguugguguuguggcucaugccugcaaucccaacacuuugggaggccgaggugggaggaucucuugagcccaggaguucaagaucagccuggacaacauagcaagaccuugcuccugcagaaaauaaauaaaauuaacugggcauggugacagaguagcuguggucccagcuacucuggagacugaagugggaggacugcuugagccugguagcuugagguucaaugggcuguuauugugccacugcauuccagccugggcaagagagcgaggcaagaaaagaaagaaagagggagggagggagggagggagaaaggcacaagaaacccugcagccacccucaacccuggguguuaggagagaaaagucgccaaagaugaugugacaggaaaccagacagaaaaagaucaugggacggcagucaguaucuucaaggaauuacuuugugaauuguucuaccaccaccuuggaugucaaaauuaccacaguccuucagcccaguggacuucagcuuguuacaacuagaagguuuaagacagucauccaagauaccuccaccaggacacacauuucugucaaaauaaaucaggaugcucucagucaagcugcaaucucacuaccuguaguauauugcaaagagcacuggauuugcaauggaaauaccugaauuuuaauuccaguuuugccaacuagugguccugcacaagccacucaccacagccuugguuugcuuauuuuuaaaauguagaaaguaucauccucauggagucuguguaaggauuagaagagauuauacauaaaagggccuacugggauauacccauaauuccccucugcccaggauuuuccucuugcaguaacagggacugggauagguggcauaccuugccagaagacccuccgauuuaauaaacccccacggcccggcgugguggcucaugccuguaaucgagcacuuugggaggccgagguggauggaucacgaggucaggaguucaagacuagccuggccaacauagugaaacccugucucuauuaaaaauaugaaaauuagccagaaaugguggcacacaccuguagucccagcuacuugggaggcugaggcaggagaaucacuugaacccaggaggcggagguuguggugagccaagaucgcgccacugcacuccagccugggcaacagagcaagacgccaucucaaaaauaauaaauaaauaaccccccacaagacccuacgaugugacccaggaggcaagaacuguccauuuaaucacggaaggaauaaggcauuaccaccaguuaaguggauucugucaccuaguucgauauaccauguugucauuuuauuacaggcaguauaaaaagaaaucauuaucacucaguaucuuuagaaucuauuguucucucauuucccauuaauaguucauacucuuacaaguagaaccuuaguaaggguauucuuggaaacgacguuccuuuacuuaucuacuugcuugucuauugcaaagaugacauccuuuugguuauuucccgcccugccuauuaggaagacagcccuucguaagaggagggcacuuugucuuuccagacugguauuguuuugaaugugugcgcugggagcagaugccaauggaaucccauuuauuauuccaacugauaaccagaaacuaagacucaugauaccagcagugccacugagcccaguuaugaagucugaggcucguaacuaauguugucaaggacaccacugccucuaggaacugggagcagggccagagauaaagaacagcaacagugccaggaaaaggucacggcuucaccguccagccugugaugcucccacauugggacuaagcuaugguggagguaauaugagagccaggaaaaaccuauacuccuggucaaaccucuuuuaucaggaaaccuuacaaaaucccuuuuuaucuucacaagauccauguaacuucacggaggcauugcucucaccguaggcuuagacucaugcaucugcugcagauaggaaggagaguccacuucccucuucgagggaaaugauaccaaaguuguuauuuccaggaacuacgugcaaaagaaaauggggaagauuugguacaaagauaggaaaguggauauagcugcuagaagggcauuuagaacuuaaagauauuaauaaagauccauuucccaggccgggcaugauggcucaugccuguaaucccagcacuuugggaggccaaggcgggugaaucaccugaggucaggaguucaagagcagccuggccaacauggugaaaccccgucucuacgaaaaauacaaaaauuagccgagcgugguggggcaugccugcagucccaguuacuugggaggcuggggcaggagaaucgcuugaacccaggaggcagagguugcagugagccaagaucgcaccauugcacuccaguccagccugggcaacacagcaagacuccaucucaaaaaaaaaaaaaaauccauuucccaaaacugcagccuaaauuccaacaucccucuguaaggcagcccaggacagcgcuacugcuagcagggaugaugaucucauuccaggcagcaggauuagaacuggagagagggagugagaaaggcagggagaaaaagagcacuuccuccagcugugcucaugcugcaugagcugcagaaaggcucuggacucagacagaggauccaagacugcccaagaacccccccagcagguccacuggucagaguccuccucaccucugaggccaauccaaccuugccuguggggucuuugucuccuaccuggguccaacuucagccgaaaccagaucuccgauggccaaagcuaucagauaggaggggaugggcugacacaucuggaagaagaacuuauuuggaccucucuucucccaggugcuagcacucaucacagcugugaagccaucugggaccugacaacagagaaagcuuaggagauuuuaccuggagagaguuuccuuuugauuaguuugaauaagagcaugaccggccaccugugugugaugauaauggccuggagucuaucuuggagaacacaaagguuucaagaaacuaaaucugugcucaacugaugggauuuagaggaaggcuacauacaacuucaguagguggaagaauuuaaaaguaagcaauuuuucagaaguaccacugaauggauauaauaauuuaccacugaaacgugaccugauugauagaucugaaaucauuucuucaucccaagggcaggugcaccuaaccuuagucuccuuaccucaauaagagcugaauacuuguauuuaacagcaggcgugucgaagcaagggaagaaggcccgguuuaggacagccuggcccuggguguacacgaagggcuucuucuuuccugcugucugcucgggagccaaccagcaaaccuaagcgaaaagaagaacauuucagaacugacaucucccacacgagcucagucuggccagagaagugagcuggcuggaaugagagaauuuuagguaauccuuaaaaccuuuccgccagccagucugguuugaacuagaaagcucucuccucuguguauuuaguucauccuggaauccaugccaaaguaugacauccacuucacagggcagagccaccagaaaggguccauuccucacugcaucccaugggucaucucagagaccuuggaccgagccucugaucuugucaucuguacccuaucuguguccuuuucacuguaguaguuucucaucaaacaaaaaacuacugaagcaacugcauuuggacuugugauaagacacagaaaagcagaacucaacugggagucagugauuaauauguuuuuuuuuuuuuuuuuuuuuuuuuugagacagaguaucgcucugucgcccaggcuggaguacaguggugcaaucucggcucacugcaaccucgaccucccagguucaagcaauucucaugccucagccucccaaguagcugggaccacaggcgcgugcaccaccaaguccagcuaauuuuuguauuguaaagauaggguuucaccauguuggccaggcuggucuccaacuccuggccucaagcaacccgcccaccucagucucccaaagugcugggaauacaggcauaagccaucaugcucagccuaauauacauucucuuuucuuuucuuuuuuuuuuuucgagauagaguuucacucuugucgcccaggcuggagugcaauggugugaucucagcucacugcagucuccgccuccuggguucaagcgagucuccugccucagccucccaaguagcugggauuauaggcaugcaccaccacauccgacuaauuuuguauuuuuaguagagacgggguuucaucauguuggucaggcuggucuugaacuccugaccucaggugaucugcccgccucagcuucccaaagugcugggauuacaggcaugagccacugcaccuggccuaauauguguuuucuguuccuaaaauuuaccuuuucagaagaaagguauuuuauauaauaggcacugguuauaugauucuuuaucuguguucuguuagcucuuaaacaaagggcaaaucuggguugggugcaguggcucacgccuguaaucccagcacuuugggaguccgacgcagguggaucacuugaggucaggcguucgugaccugccuggauaacaugguaaaacccuguugcuacuaaaaauacaaaaauuagccgggugugauggcaugcaccuguaauucuagcuacucaggaggcugaggcaggagaauugcuugaacccaggaggcagauguugcagugagcugagaucaugccacugcacuccagccugggugacagagcgagacucugccucaaaaaaaaaaaaaaaaaaaaaaaaaaaguaaaaucugaaugauuuaucacaaaacccaguuuuugccuauagcaaacagccauucauuuaccuggaagaggggcaggauggagcauaggucaguaacaaauagcauuuagaauuuagaaauggauucgauuacuccaggaugauuucauaggggaagaaaacuuucuggcuggaccuucaaagacacgcaggauugagauggcuggaaaggaagggaggagacauucacaaggagacgagcagcaacaugaggagaggcauaaacagaugcaggcuccagaugcagaguuggggaggcaggccugggcaagucuaaugaaggguucugaacacagcagugucugagaccuauuuuaagaggcauaaggaagcuacguugggaugcuggguuugaguuuuugugugugaaaaauuuaauuagucuccuuauaacagguacagugcaguauagaaagggaugagagaauaacuucacaguggagaaagcugauaaucacugcuucagccaggggaccgagguuaacgcugacagucauaaaucauguggauacuaugcgcccucaauaccugaugaaaauggcacuuuggcugggcgcaguggcucacaccuguaaucccagcacuuugggaggccgaggcugguggaucaccugaggucgggaguucaagaccagccuggccaacacagugaaacccugugucuacuaaaaauacaaaaauuaaccagggugguggcauaugccuauagucccagcuacuucggaggcugagggaggagaaucgcuugaaccagggaggcggagguugcagugagccgagaucacaccacugcaguccagccuggguaacaagagugaaacuccauuucaagaaaaaaaaaaaaaaaaaagaaagaaaauggcacuuuaccucugugaauugccccucaaaacccauaaucccaaucuaaucaugagaaaacaucagauaaauuccaauacagggucauccuacgcuauaccuggccaacacuccucaaaacugucaagguuggcugggcucaguggcucacaccuguaaugccagcacuucgggaggucaaggcaggaggaucgcuugaggccaggaguuugagaccagccugggcaacauagggggacccugucucuacagaaaaaauaaaaauaaaaaaauaaaaaacaaaaaacuggcugggagcaguggcucaugccuguaauucuagcacuuucuuugggaggccaagaugggagaauuguuuguuugagcccaagcguuugagacaagccuggauaacacagugagaccucaucucuacaaauaauaaauucaaaaaauuagcugggcgcaguuguaugcgccuguagucccagcuacuugggcugaggcaggaggaucacuugaaccagggggaucaaggcugcagugagccaugauugugccacucacugcacuacggccuggaugacagagcaagacccugucucaaaaaacaaacaaacugucaaaguuauaucaaaaacaaggaaaguuugagaaacugucacagucccaagaggauacaugacagcuaaauauaauguggaauucuggauggcuuccuggaacagaaaaagacauuaaguaaaaacuaagggaaucugaaaaaacuauggacuccaguaucgguacugguuuauuaauuauaacaaauauauuauuauacuaauguaaaaugauucaaucuugguuaauaauauaucagcauuguuuaauuguaacaaaugugucauacuaaugcaaaaugguagcaagaggggaaucuguguguauauguguauguaggagguacugaacuguauaugggaacucucugaacuggcugcucaauuaagccaggcauguuggcucaugcuuguagucccagcacuuugggaugccaaagcgggcagauggcuugaacccaggaguucaagaccagcgugggcaacauggcaaaaccccaucucuacaaaaaauaacaaaaauuagccaaguguggagguggcaggucugugguuggucccagcuaccccagcuacucaggaggcuaaggugggaggaucacuugagccagggaggucaaggcugcagugagcugagauggugccacuauaccagucaauaagaauugaucaauugacugaucauugaaugccaucagucagugauguuuuuacugaucagcuaggaaaugaguauuuuuuuuuuuuuuuuuuagauggagccucgcugugucacccaggcuggaaugcaauggcaugaucucagcucacugcaaccucugugucccagauucaagcgauccuccugccucaggcucccagguagcuggguuuacaggugugagccaccacaaccagcuaauuuuuguauuuuuaguggagguaggguuucaccauguuggccaggcuggucucaaacuccugaccucaggugaucugccagcccuggccucccaaagugcugggauuacagaugugagccaccacacccagccuggaaacgagauuuuuaaaaagaacaauguagggagcuuuuugaucccuucucaaaaaaaaaaaaaaaaaaaaaaaaaaaaaaaaaaaagaaagaaauacaaaaguuagcaguaagagcuaacacagcuuacuuaccauguaccacgcaccauauuaaccacuuauggaaagacaacucauuuaaccuaugucaagcacuuagacuagugccuggcucaucuuauuaaauauuagccaucauccccccuccaccaaaauugcuuacucaucaucuuugcuuuuuuguuguuguuguuaaaacagggucgcacucuguugcucaggcuggagugcagugguguuaucaggcugugaaaggaaaaucucuugggcccccaaaaucacuaaagaaaacucaaccugggaaccgcuuagggcacaccugccucccauucuauucaaagccacuacucugcucacugagauggaugcauaucugauuugcuuccuuuggaaaggcucaucagaaacucaaaagaauguaaccauuuguguaucaccuaucugugauccggaagccgcuucaagucuuccugccuuugcugcaaguugucccaccuuuucagacccaaccaauguacuucuuacauauacugacugauguaucaugucucccuaauguauaaaaccaagcugugggccgggcgcaguggcucacgccuguaaucccagcacuuugggaggccgccgaggcaggcggaucacgaggucaggaguucgagaccagccugaccaaaauggugaaauuuugucucuacuaaacaauacaaaaauuagccgggugugguggcgcacgccuguagucccagcuacuagggagggugagguacgagaaucgcucgaacccacgacgcagagguugcagugagccgagaucuugccacugcacuccagccuggacgagagugagacucugccucaaauaaauaaauaaaagauuaaacuguaagcaagcaguuuacuaugaaacuugcaaccaacucuaccugagagauaacuggcagccacagccuaaggacucuccaggaaggauuuucugacucuuacagacauaagccacauaacuccauccucuuauuuccaauauuugccccgucccgaaaaaaaauuaaagaguuaaccaacagugagaaggccaaauuauuauaaugcuuauagcacccuaauuccaguucucacuuuuacucaaauucuuucguuaaucaaauccaggacuucacaggaggaaacaaaaacaaagauaagagcuuuaaccguggaacuagaaggcaacacagaacaaagagcuagaucaacaucuggcuaauucuagagccaccauaaagcagagauaagguggcugauaaucagguaccucggcccaaaaguccaagagggcacuaagugaagugcaugaacaacaggucaucuagaaagccacggaaaauguuagaaacggcagugugcgaugagcgggaaugcggcgcaaucuggacaagccuccagggccagggaggagacgcggaaggacggaaagggugaaggaugcaccgcccaguggcuggaggaaguccagaaggaaaccaggcagcccgggaggaaaagaggaagcaaggggaggaggccuagaggcggcgcgcggggaguaggccccucuagggacgcucuggaaggguccucccugucccuccucccgggugggguaggugagggugcagggcggcugggggccggaagggcaggcaggcagcggcgggcgcagucuggggcgcacucaccccgggucccuccccgacgcgguaggugagcagcaccuggaggcgcucggcggcgcggcagggcugcgggaaggacacgcacagggccuggccauagugcgagaagggcugcguguagaagcucacgggcuccgcaggcggcuccuccgagccgggccgcucccgccgcagcgccgccgccgucaccuccaggcacgggugcgaguccagccgcagcucggcggcgcccucgggcuccaggcagcgcagguccaggaccgcggugccgcucagcccccggcucccugcgccgggcccuggaggcccgaacucagcccgcagguccaggugcaagugcagcagcucaaaggcccggaaguuggaggccgaggccacguccacagccugcgcggagugcagcggccgccgggccgcgccgcugccgggggaaugcucgccgcucgccauggccgcagagccguugcucaccggccggg

SEQ ID NO: 192908 - RNA, 17585 nt, Homo sapiens
caacuugccugggcucauacacaguuuuauuuccuguugauuuuacagacacuccauccugcaagcccauucccuuggaaaacccagaaagagugggcacagugcucccuagaggaauagaggggacaagauggcugccagggagagggcaguugaggcacuuagggauuuacuccggcccugauggaagaucuggugcccaggguagggggagagggccugggcugggcuggagccuccuagguauuucccagaagccccuucaggaacugucaccuggacuccaguaccaccccucgucauguugucacuuccugugguggcgggagcgcagggugugagggaaaauuugggugacagggcagugcuguggccggcaguguucaaggccuugcccccuagggaccuggcauggggcuggaaggggggaucaacagcgccuuccagcgucccaguagccuccccugacguccuucuggguccuccucugggugcagagcucgggccuggggaagacacacacucacccuccacccuggcucuuccuucuccucuccucagagccugcccucugauguucuugcucagcccguaagagcccagaauggggcugcauguuaucagacaucagcacugaaggaaccccagagccuccagcccaccucuuccccuuugccucagagaggggcagugauggcuccaaggucacauggccagugacaggcaggacuuuaaguggaguccaaggcuacuguuggcuacugucucccacucccaccugccucuuccuggcacucacaggucuucugggcacacaggagaucuggggggccucccaacgaccguucucuuggcaucggaucagcggcagauugcgcugggccaguccuucccggcaccgguagcgaagcacaguguccaccucauagcgcagccgugggcggccgaacacuugagccaggggcagcuccgguggcggcccacaggacacugcaaaggaagacaguuaggaacugagccuggcucugugggugacaguucccagaaucuccauggggaagagaaaaaugggccacaacaugacaaaaaaagaucagggauuccgaguggacccacguaacuuguuagcucucccauggucuggaacacguucugacuccucuauguugcuuugcacucucugucuacaaacaucagucccucugguccccuagcccaccccuccacuuccuugcugggacccuccuuugccugcccucacccagccccaucuugcagguguaggacaggugguaguugcagggcacgucacuccauugucccugaucaugccacaccaugaccacgcaguucucuccagacaggaaguagcugucaggcugcccaggguuccaguucucauagagcugggggaacggaggagguggugaggagcuccuacaccaggagcaccgggagagggccuagaggaucuggggaggagggcuggugagcggggccccaggagagggaagguuagggcuaggggguaggggaucucccggggaaggggaaaggagagggcagggacuuuaggggagggagaaugggagccagaagggaagaaagaggacacaacgaagggaggagagcccagggagaagaggcacagggcacgagaaagggaaggaggccggaaaaagaaggggacagggucgggaggggugggggugguagggaacagaagugcuuagaggaagugagcuagacggcgggguucgacuggggccucucaccagggggacgccauccgaccacaagaagucgccuucgaugguccugucguugaguccgauccacugguacucccgguaccggucuagggagacgaaggcgugcagugagcgcagccgccagcagauggcggccguuccccgcucccgggcggucugcggugacugccuuggaaacccuuccccgcgauccagcacccgcccuugucggguucuucuaccccagccucugcucaagggccagauggaaagcaggggaaugggggugggagaauaaggaagauaucaacccaggcuagaaaaggggaguuuuggaaaaagagucaaaacuuucaacaagauuggaguuggaguuggaggaggccgacggaggucggagagcagggagguuggagggauuggaggcggcccccugcacggcggcccggcccacacaggcgcacucuacugcgcgaaccuccacucuccguucccgaaggccacugccuaagcguagggugggaagggagagagaaugagaaggggagugaacgaaugagugagggaaugcacgcuugagaaaaccaaggaauaagugcauggguuaaugaggaaggcgguuaggcgagugagagagagugagagcauauggcaggggccccucccgcccugucucccagcccacuguugaugaaguccuguuccucgggugugcugaugcuggccagaugcgcgccguacauccggcacugggucucugccuccucccagcuccuucguguggaaaagugcuuguagcaggcgcccuggaaggcgucccagccgggguugcagaagcggaggccugcggcacauaagggcgggcaucuuagggccccaaaacccagagggccagguccccuggaaggggcuggucuccuuccacuaccgcaggccgagaggggcgggacuaagggggacaggagggcggugcaaaagagcuaguagagaaugaggggguagcaggagccuggaggggcucuugggcaggggcgcuggugccuuuucuaagagacaggaaccagggugagggauggaguuccggccugggucuccauccuaacgagcaguggcucuccucuccaggagaauggagccugucauguauugaccaccgauuaaaugccaggaguaugcuuugcacuggucucaaauggacccccuaugagaggcauugugguuucacuuagauaagaaaauugaggguaggacucaaagaaguuaugcaacuugccuaaaacagggacucauuaaugacaaggccaaaaccaauguucucccuccccccuccagaaguagcacguuguggcaggguccaggcuucaaaccugccccccgucccucaacacucaccaacaucgcacaggucccccccauagccaggcagacauaggcagcggaccccuuccuccuccuccaagcaugucccaccauuguggcaggggcuggggacacagucaccugagagggggaaagaagugaggcggggggagcgaggcagccgcacucugcagccugagcccuccaggagagggugcagagggucccccagcccuggucucucuguccuggaagcuauaacagcacccuaaaaguucucccuagagccugucucuggucacaacccagcccugaguucuggguuucuuuccucuucccgcucccgacuucagcauuggcucagccuuccauuguuauggccaccagugugagcccagcccaaaaggggcuggggagaagaggcuaggagagcccugagaacccagccccacaauggagaaagauacugggcacagaaaguuauagcucuaaacucuuaucuggcuucugugugauauugggcaggucauuuuccuucucuaggcuuggaguuuagugccacacccccuugucuuugugccaggucccagcacaguucuguauaguccagguggaaugaauggaagugaaggaggggacagaaggauuaccgcagcaacaguggagggugguaucccuugacugcuccugagaccugauauuggugugguccaggugaauacuaaccauuccuccugcuguccacugggcagucagccagucccagaagugguuaguggagauccagcccacuuuccucacucuaggcccugccccuucucccccagcuuaggaacuaagucgcagcagcucccauuguccugcagugcugacuggccucacacaugcagcuuucucucaauaucacccaaccucucacuuccccuucuuauauccacagacucuuccacuuaccaggcucccucucccaacuccacuuugggccuucugcagguucuccaaccuagaauccaucucaaucccuccuucuggcucccucuccuccaggcaguccucuuagacuaacacacugcccugaaggucugcaaucuguugccuggaucuagcuccaucuggcuaggccaucugcuuuacuggacuuuuucucucuguauccugggguaggagguggcuguccuuaggaugugcuugggugcuacaggagcugucaguuuccaauccuuucugguucagaugacccaaaggaagauggcuccacagaccaacuguguaggucauggcccucagccaugguaaggucaaggcccucagccaugagaggcaaaaccacuccagggcagaacccuucagacuuuaccauccaccucuagaagccauggccaagguccacagugcuucccgcuggccuggccacaggucccacugccuggugggaaucaguagggguggagagaggagaagcuggaguggauucaaagaauuuugcugggaugaccuagcuguuuugggugaaaugaaucagcuuuuccagcagcacuccuucugucaucuucccuccugccaauaguuucuucccagcuuguggugcugcccaccucccaaccccagaggaagagguauuucauuuaacccauuaagcaccaggccccacagaggguagaauucugaacuccccucccacuccucacacuuuccugucccuccuguuguccuuucugcuccuucccauucaacccuccaacccugggggacagaggcucucaaacuuggucuuugguccccuacccaagccauaggccccucccccuggcugugggcuacagaaccugaacccagcgcaggcagagucgggugaagaacucuucuucuugucauuuucccucucccuuuuuggggacaacuauucuacacaaccagaaaguuuucccuuucuuuccauugaaacagcagccaaggagaccucucacuuacccucccgguggggaaacuaagacacuguagauaccuccaauugugcuccucuucccaccaaacccccucccuaucccccacagggcugaacuccaaggccaguugugcagggaccuaacaguugacauggguaagccugggugggacucaggaugugauccaucuaacauggggguccuagggcuaagggaaucccagccuucuccaggaaccuccacugggaaucuuagccuuccugaguagagagggcuucucucagaccccagaaccugauuccuuccuucacacucuccaucacuugcuuuugaucagugucuucuccagcauuagguacuuugagacccuuugggucuggggagggugaagccauuccuucuggagaguagggaaugaucauuagugcaggaguuaguggagaagacggaaguuguagguagugggaugagaguuagauaccacccccugcugagaugcagggcuaggggaugggggugagggcaacugaaugccagggaacugccucuaugcugagagacccucaguucccucaguuacuaugacccuuggcaccaccaagauggauuggaagugaauauaaaugcacaacacaugcacuccgggcugcagggguuucuccucaucaggagugagggacuacaacucccagcacugccucagacuauggaugaugacuucuccagggguaauguguacagucaaauuuugggaucuuagcagccaggaaggaaaguguagacaggccugagaaggagaggcugggggaacaaugaggggcuguuagacugccaggacagacaaggggagaagccgaaaaugaaaaaggaagagaggccaagacacacacagagacagggagagacauggagccagagaagaagcauccaagugcuccccaugacacagacccauggaaugagagagguggacagcaggagauggagacagaggguaccagagcuugguuacaaagcgguuuaauagagauuuauuuccaaggcuuguuuuccaugaaacagucaaaaaauacuucacagaaguaguugcuuaaggcucuguggggguacggguucuccuggacuccggagguugaggggugagaagggacucccaggcuucccugagaucaauaggaggcagcuaaaggggacggcacacaggcggaugaagggaguaguggaaaauaggccgagcccugaaggcugcaauaggugaugaggacccuuggagaggccugaggaugcucuguggggcuggcgagaugugagccacagguggagggcccaauggcagggaagggucacagauggucaguggcggggcugggaucacaggguaaagacgcggagagcugagauacccacaagguggauauccgagauuggagacccauagguagagguggguaagagaaugaaggcaaaggacaggagaguuugggaugaugguggguuaaaggacuacaggucaggugacccagagcugcagggggaagaaaaggaguaggauagagagggcaguugagccuugggcagaauuaccugaugcggggaccacggccacuccaccucggcuggcgcugucagugggcagcacuggcugggccugcacugaggucccugcuggggcaguucuuccagaauuaucuucagagggggccuccagcucccugguacccucaggggcccguguggcuggaagcagggaaggggcacccucggagcuuccugucuccucgcucucuccucgagggaccccagauagcucaggaccaccaguugccucccccaccucucuugccucaaccagaguggaaggugauggggaugcuagguuccucucccugggagugggcagagucucaguaggugguccauggacccuuggaggccuggaagcuucugacucuccaucaggaaguggugaugcaccaggcugcaggacugcccuugcuggcgccugggagagugacuccuccugggcugcuggcucaguggggagagaggccucagggcccgggcugcugagcucgcugggccaugcccacagagccucauccuccaccuccuccucuucuucuuccuccucuuucucuucuucaucuucauauuucucuucuuccuccaaugccuuaccuuccucuucugagaaccccgugggcgguaccauggauuguguuucaaauucuaggcaaagcacaaacgguucagcaccagggacagcgucuguccaaggaccgaaaggaaaaagggaaggggagaaaaguagggcucaggagggugagcccuggggaauagggaagagaccgcccugaggacaggugguccuugcgccacacuggaagaacuugaccccagccauauuguugaggcaacacuugagaaggcucugugagccaucauuagccccggagaacauggucauuugucucccuccuacucugucaaaacucuagucuguuuugggugugugaggcggaagagggaccaaagaaggcagguuccaccuuuccagggcgcagcuccuuagugcaagcaucucuagcuccauagaguuggggguggaauuuacuggaaaagcaaagguugggagagggacaggaaaggugcccugcaccccugagcuacugagaaaggacagggcagagucaugucauccaucacccuagcaucaaccugggcuugccucuucugcccccaacuucuuucaaucaagacauccuuaggauaagggauccgacuuaccuaggagcguccuaggggccucugcugggucuucuggaguggagcuuccaccuccuccguccuccaugauggggauggaguagauggccccacgggauucacucucuguggcuuccugaggcagcugcaguuccuccagggucucugucacugugacgauagccucuaguccaucagaggcuggguuggaggcuggguuggaggccucagggauggcagaaggcugggccgagucuguggcaggaggaaaguauugaugcgagccugaauagguagcucugcccucccaggucacagcuugcaccauggaauucucucaauucucucacaucuucccuguggagcaccuacuggggcccagggagcaucccagaacuucgucacucauuucucaagcauucaucaagugccuacagugugucaugccaagcauuccccugggcacugaggauacagugcagaacaaaauagcaaaccuccuacccucaagggaaauuauauucuagaacagaugacaaacaaacauauauuauaaucuuacaagauaaagaacacuugagcagaguuagaagauggagugauggaaaauacuacuuuggaguggucaggaaaggcucaggugagagauauucccuagggggaggggcuggagccagcaggauggaugaaauagcuuuaccaccuugugaucuugggcuuggggcaaggugugaggugucccagguauccccaaauucuuuuauuuuuuagacagagucuccuucugucacccaggcuggagugcaguggcacgaucccagcucauugcaaccuucgccuccuggauucaagcgguucucccgucucagccucccaaguagcugggacuacaggcaugugccaccguaacuggcuaauuuuuguauuuuuaguagagacaggguuuccccguguuugccaggcugaucucgaacuccuggccucaaguggucuuggccucccaaagugcugggauuacaggcaugagccacugcaccgagccuccaaaauucuugaaauagaaggggagaggcugucauccccucaggauagcuggagggcagagugcaggaauaacuucaggcaucaccugaggaucucagugguggggcaaguaggcaagggaaaaggccaccuccuucugggaccuacuccuuucaaauaaccagaaguuuagaaugguuuacuuguccucuggggaagggagccaagagcagaaaaccaaugaagugaagguggaauugggcuaagaaaaguccugagggcugucugugcucagccaggcaagacaggacagugagucccugcccucaucaccugcuccagugagccuuacuccucaccagaccuuguguccuugcugccuguguccuccaccaaucguagucccaacuguagucauauucccccuccccugccccuccucaugauccaggccauuucuuuccaaaacagugcuuggcuuggcacacaaucauagccagcacacagaaguuuuagcuauuacuauuauuauuauuacuacuacuacuacuacuacuacuaccccuguuccaggaggucuuuucagauggaccugucuuccuauggacuuuuacuuccccaccccuccccaaccccagccaaauauguccacagaucuguccaaauggaaguaaugcuuuucucucagucucuccucauccugggagugaggcaucuugucuucccuuugcuggggguucccauggcaaaagcugugucuucauccuucagaccaagugcucccugagguucaaggcugugucugcuccuuccauuucugcuuccagcucuuguaacaguauuucaggcuuaaaacuggggaaggaccgagacaccgcauggcaaugccucucuuauugucggucacccuuggccugggccuuuugcaucugagagucccagaaacugccucccgcuccagcucccaacauaagauaugggcagguuugggugcaguggcucacaccuauaaaucccagcacuucgggaguccaagauagguagauugcuugagcucaggaguucaagaccagccugggcauguggugaaaccccaucucuacaaaaauuacaaaaauuugcuagacaugguggcauaagccuguggucccaccuacuccggagguugaaguggaaggauccccugagcccagggagguugaggcuacaaugaaccaugaucacaccacugcacuccagccugggggacggagugagacccugucucaaaaaaagaaacaagccauaagaugugggcagaaagcuaucucuauucccaacuguacuuaaggucuugcucccuuuugggggaauuguauccauccaccaguauuugguaguuaaagaucugacaccuucuuaagcuguaguuucuggaaauccuccagagggcuccugagggcauuugguuguugacuggaagaacuugggcagauuacucauugaauucacagaauguuggucgucuuugcucugccaauaagcugacaggagaugggagcuuauucagcagcccagcuggagcaaacaaggcauggacuacuggugggaaggcagauaaggagaggccaaaaggugacuacuccuugggccaaacagcugacagacaccacaccagagggcaugcccagaauuagaacccuagaugacaagcuggacuucacccacgaccacuucaggcaaauggcaaagcccugagcuaaacugaucagacugggguaggacuuuuaggacucaacucugccuuucugagauuggucucagcuucugcagggaggugggcucaccucggaagcaguagacguugaagcggcugugcuuauuggggaagccagucugguuggggaagaggaagagagucuugacaccaggcaagcccccaccacagcgcuggcugggugugacgaugggguagcgcacacugccaucagcuagccacccugggcugcagugguccaggccaccaucccaggcugcauacaguuggcccgugguggcaaucucugcaccccgcuccuggcaguacgcccgugcuuccuccaaugucagcuucucuggagggucacccaggaacaguucuccuggguggagaagagaaggcuggguuaucaggcagcugguagcuccuuccacucuggucucccaugggaacccugggcaagcuucuccaguucccucaucuguggcagggagucaacuacucuacuucauaggaucauagucugaauagaaccucaagauggauauuagagcucaaagagauggggcccaaacuucuuguucugcagagucaugcacagaguccaccuggcaggugguagaugaguuaaacucgguauccugcugccuggcugagacuuuggucaugagcuugccucugugacaguguuuggagagagggacaccaauugucuccuuacuccugcuugcccccuuaaacucaggagggauaguaagguccugcagaggccccgggaggaccuaugggcagcaugggaguaggaaauuguccccugggaaccucucacuccuaaucaccauuuaggucuucagcauaacaguacacaucauagaggucauccggguccaccacaccauaguuccggaccccggggaagccauccaugucuccguaacaggccucucguggggucuggaugggauaccuagggaggaaggacagaaucacuuaguacagaugcuuucaccagggagccagcccauauugauucuauugaaccccacugccaccacagugcagacacuugcugacagcuggcuguccuucuagcacugcagggaugcacaugcucaggguccucaccuccccuccucagaccagccucaucccccagaggcaaaaagcccugcauguccagccugacacagcaggcagcacccagcagaaggggggccauggccaccucaggggccaauagaagccccaauccacagccccugcccaccucacggucugauccgacagccagccagcaucacauugcucauagcccccaagguaggcggcauagagcugcuccgggguggcgaugugggcuccaaugcgggcacaggccuccugggccccagaaaaggagaaagcauagcgggcagagcccucucgguagagaaagacgaccccuguggggcagagaggaccccugagccaggugagcacccagcacgcuggccuccccucacccuccuugucacuccucuguacacaaggguaaauaaaguucaauugugcucacucuacagcaugagggacuuaaguuagauuguggguagaauguccuccaccugaagagagaaaggagacaacaaaggcccgugucuccucacucuuuuuccaacccaggcugcgccuuccagcuaccuuugcuucccucucacacugugggauccccgaaggcaagaguccucccuucccucccucccucccucccucuggaaccucccugcccucucaccuuugaccuugaccuccacagcgucgcugcugucaucgaugccgugcuggaccucacagcgauagauaccugagucguuggggcgcagcucgcucagcgccagggagacgucggugagcgacgcuggguacgcaggcagugccacgcggaaccgguaggccucguucaccuugacgcgcacuccccgcgccaccagcaccucugccucccggccccgggacaggaaaguccacuugacccgcggagagcccagcacagcccggcggcucggcgguggccgcagguaguggacguggcaagggauggugagggcgccgccgagcacgcccugcaguggcgcgucgcccgcgaugcgcacgcgaaaagcgcgguccucugugaacggguggagccggcuggaacuuaacgcugucgacccucagagucccacccgguggccuccaagccccgcuccaggaucccuccuuccggccccaggauuccccggccccccuaggaccaggggccaggggccaggggccaggguccugcagcccuaccucuagguccuccaggaccaccccgacggucuccagacccaucccccaaagucucccagucaauucagcccccaggauuccuugcccugcucucagagucuuccacuuccucuccaaaauuccuagaccacaccccaggguccuccaaccucgcccccugaguccuccagcccaguuucccagucugcucccuuuagggccuccuucaggguuucucccaguuccaccccuuucccaccuccuagcuucaggauccccuauccuccaccuuaggggcccaaagccuugcacccagugcccuucccuaguccugccccaugauuucuccaacccaccagaugcucacagcucagcccuuauuuccaaguguuccagccuggacgcuuccccacagcccuccaauucucucucuuccuggggccccuaagccuggaagcaguugguuagggcugaacaagacagagacggugaccccaagugggguugcuuaccugagcugucuccuuccagaacaucugcuaaagcugcaggagccugggccaggaccagggcugccagcaggggcaggaacagcugggccaugcugcaggcugacagagggacaugagaaggaaagaugggguuagacuucaggauggacuuccccccugcucccuaccacacccauguggguucacacauauccuggcuccagaaguccccuaccuucacaucaccauggacucucuguuucugauccccaucuucccagcaagugauuucuucucagaaccaaaacccgaguccuagucaacucacugugugaccuaagccaagcuccuuaccuucucugagccuuuauuuucuuacuuauaaaaaagcaucaucauuacuaucucaugaguugagauaggaccaugugcuuugagaguguuuaguaucuuaaaacuccuguacaaaugcauagcaccaggcagacaguaggagcucaguuuacagcaugaauggugggugcucuuauacucagaauuccaucugcuccucccagugccagacuccuuccucgaacccagagccuucucccauaguaucucuuuagccucuucugccuucuagacugucccugccuccagggacaccauacucaccuggccuuuuccaggagggccuccuagaccgaacgcaaguaagcacagcuucuccugagcccacccucuccucuacuuccuccccaccauuauuuguaaggaaacuccucucuuuacuccccaacauucuccaucccccuuccuuggcugccuccucccuucuucuucccagccucuccuuucugccuggcacgggcuuucccaccggaacucuuggcucagaaaucaguugggacaaagccccugucucugccagucuggccucuauccagccccucccuucccccacccuaccuuuugugaaagccuugggcuggaggguggacuaaggggggggagaauaaaugggaggggcuaccccuuccuaccccuggcuaucagaagcucuagaacccagaauauuccuccaaagaucucgaagcacuuacacucucauaaaaaggauguguugugacauugagaaauggagacugaggcucagagaaggauagggcugacccuggaucccuaguaaagccaagucaggcacgagggcaaugugcucccaggagagaagacucagagcuacaucaucuuuaaggguugggcuaaacuuagaagagcauggagauccagguaugccauggaauaggccaaugaugcagcaagagaauugaagguuagacuacaggcaggacuuccuagagaucagguuuauuccacuggcugugcacucccauuccaggcccacuguuuaucccccaucuucccugcccucucagcaucugccuucauaccugucccugcacuuuccuaagccugagaugaugggaaauuuccuacuuuucccagauccucccaccucccugccaucauaacccccaucucccccacugugucuggauaucauucccuagggucagaguugggagaggaguggcacaaccagaugcuuagggccucucucugaccuuucagagggaggagguucuugauggggccagauuagaggugcggagaccagcuccaggcauuggggugcuugggaggacuguucuggggcuggaguggggaccauugggcaggagcagccagugcccaccgggugcugggaagacuguuugccaugcaucugagcugugccagggccugggccuggcccccuucuggugcccucccucccuucucucugggcuggagcuggagcugcucacagaccuggcucccaucucucugacgggcagcccagagacccauauaguuggagucauuuuggggccaacacccuggaccacccuuucaccucugucugacagugggagagugagggaagagggccuaaggccaaugaggaccuaacugcucuggaacauggagggcaaccuacccuugaccccaaaaaugggagucacugaccagugaggccaagaggguagccccgugcaguucugagagagcucugucucuccagucucgggccucagccucccaauugcagcuaggagcccugaggaaacucagacuuccccacauccgguaccagccucagaacccagggguccaggguucuguggccuucucuaucccacacaccacucaucuccacuuccucuucucuuccuccagagcaggccacaccucuccaacucuaacccugagagcucagcagucaugcgguccguucccuugacgccacaacaucccccucucuguuucagcuccagcgucuguaucucugcccuuguuuugaauuucuugagcuguucaggaaacuuuccucuugucacaucauuucugucugacccgggauguccaucucccucacagucuucauagacccaacccagagaguuaagaccaggucucucucucucucucucucucucucucucucuguguguguguguguguguguguguguaggcaugcacguguguacacacaucuaacaacacccaccaccuccaugcugaaugcccaucagccggcagccaaggucugucccauaggaacugagcuccagcacucagcagggucagcagggaggcacaagaagccagagcuuuggcuauagcaggagggaagcucucugcuacccccuuaacggcuucaugaggagcaacaugagccuacacaauauaagcagggccuuagggccuguagaaguaauugcaaucaucauauaaauaguccuuuuuauuggaagcaaaacuaauaauacuauuagcaaugacaccagccgagcaguugcagaucccucucguauagaaucugaaauguggaugaugcuguuauaaauagcaaaguuagccauagcaacauaggcacugguaauacugugggugggucuaaggguaacacuguucccugaucuuacugucaucaucugcaaucuaaguaaugcagauaauaauggugccccuuggacuugacgccaaucucuugguccuauuagaaccauguaggcagagcuauuccaauaggugggggaauaccugacaggauauggaaauaccugggagagggaauucccaggccccuggcagugcuaggaaggaaugcaauagugguaaccgaauuccagcuaauaguuacugaugucuaccugagccaguucuccuaaaugcuuccuguggauaaccucaacugugagaaaaagauuguuuauguuuugcucauuacaccgaugaggaacccgagguucagagaagucaacuaacuaccccaaggucacagagcaaggagccgaguugggauuccagccgaaaugggcacuccgaccacccccuagagcggcucugaucggcuguccugccggacuacaguaagguguccccagaaggguugcuggccgcugcuccuggagcugccugugcgugggggcacggaggcaaggacugauccggaacgcuaccgcccugccugggacaaggucggaaaucucggcggccgcgcugggacaggagcgcgcagcagggaagaugcgaggacccgagggguugcugaucagacugcgagcagcaggggggcugccacuggcagagcuggaagcauguagaucagagauggcagcagcagcugcaggcgcucggggcuguccagcagccuaccccgcugcggugucaggagucgacgaguugggugccccagagccucgaggcaagggcugacaggcggggggcgcagaccaggcaggcacucccuucucccuguccccgaccccacggcgggcggcggggcugcggaggcacucaccuacccagggcugggguugggucgcggcacugcgaaguuugucgccuccuccgggggucuccuccgggugcacggcucaguccugcagcugcagcugagacugcggcggagacugcgcgagcgugaggagaggcuggggccgcaggacauucggaagagggcgccggcccucccggcgcagcacaaaacccccuuucuuccccccgccccugccccgcccuccccggggccgcccccgcccccuggucgggagcgcggggcucucgggacggucacgggacccgcugccuucucugcuucggcuccggcagcagcggcgagagcaagg

SEQ ID NO: 192909 - RNA, 17585 nt, Homo sapiens
ccuugcucucgccgcugcugccggagccgaagcagagaaggcagcgggucccgugaccgucccgagagccccgcgcucccgaccagggggcgggggcggccccggggagggcggggcaggggcggggggaagaaaggggguuuugugcugcgccgggagggccggcgcccucuuccgaauguccugcggccccagccucuccucacgcucgcgcagucuccgccgcagucucagcugcagcugcaggacugagccgugcacccggaggagacccccggaggaggcgacaaacuucgcagugccgcgacccaaccccagcccuggguaggugagugccuccgcagccccgccgcccgccguggggucggggacagggagaagggagugccugccuggucugcgccccccgccugucagcccuugccucgaggcucuggggcacccaacucgucgacuccugacaccgcagcgggguaggcugcuggacagccccgagcgccugcagcugcugcugccaucucugaucuacaugcuuccagcucugccaguggcagccccccugcugcucgcagucugaucagcaaccccucggguccucgcaucuucccugcugcgcgcuccugucccagcgcggccgccgagauuuccgaccuugucccaggcagggcgguagcguuccggaucaguccuugccuccgugcccccacgcacaggcagcuccaggagcagcggccagcaacccuucuggggacaccuuacuguaguccggcaggacagccgaucagagccgcucuaggggguggucggagugcccauuucggcuggaaucccaacucggcuccuugcucugugaccuugggguaguuaguugacuucucugaaccucggguuccucaucgguguaaugagcaaaacauaaacaaucuuuuucucacaguugagguuauccacaggaagcauuuaggagaacuggcucagguagacaucaguaacuauuagcuggaauucgguuaccacuauugcauuccuuccuagcacugccaggggccugggaauucccucucccagguauuuccauauccugucagguauucccccaccuauuggaauagcucugccuacaugguucuaauaggaccaagagauuggcgucaaguccaaggggcaccauuauuaucugcauuacuuagauugcagaugaugacaguaagaucagggaacaguguuacccuuagacccacccacaguauuaccagugccuauguugcuauggcuaacuuugcuauuuauaacagcaucauccacauuucagauucuauacgagagggaucugcaacugcucggcuggugucauugcuaauaguauuauuaguuuugcuuccaauaaaaaggacuauuuauaugaugauugcaauuacuucuacaggcccuaaggcccugcuuauauuguguaggcucauguugcuccucaugaagccguuaaggggguagcagagagcuucccuccugcuauagccaaagcucuggcuucuugugccucccugcugacccugcugagugcuggagcucaguuccuaugggacagaccuuggcugccggcugaugggcauucagcauggaggugguggguguuguuagauguguguacacacgugcaugccuacacacacacacacacacacacacacagagagagagagagagagagagagagagagagaccuggucuuaacucucuggguugggucuaugaagacugugagggagauggacaucccgggucagacagaaaugaugugacaagaggaaaguuuccugaacagcucaagaaauucaaaacaagggcagagauacagacgcuggagcugaaacagagagggggauguuguggcgucaagggaacggaccgcaugacugcugagcucucaggguuagaguuggagagguguggccugcucuggaggaagagaagaggaaguggagaugaguggugugugggauagagaaggccacagaacccuggaccccuggguucugaggcugguaccggauguggggaagucugaguuuccucagggcuccuagcugcaauugggaggcugaggcccgagacuggagagacagagcucucucagaacugcacggggcuacccucuuggccucacuggucagugacucccauuuuuggggucaaggguagguugcccuccauguuccagagcaguuagguccucauuggccuuaggcccucuucccucacucucccacugucagacagaggugaaagggugguccaggguguuggccccaaaaugacuccaacuauaugggucucugggcugcccgucagagagaugggagccaggucugugagcagcuccagcuccagcccagagagaagggagggagggcaccagaagggggccaggcccaggcccuggcacagcucagaugcauggcaaacagucuucccagcacccggugggcacuggcugcuccugcccaaugguccccacuccagccccagaacaguccucccaagcaccccaaugccuggagcuggucuccgcaccucuaaucuggccccaucaagaaccuccucccucugaaaggucagagagaggcccuaagcaucugguugugccacuccucucccaacucugacccuagggaaugauauccagacacagugggggagauggggguuaugauggcagggaggugggaggaucugggaaaaguaggaaauuucccaucaucucaggcuuaggaaagugcagggacagguaugaaggcagaugcugagagggcagggaagaugggggauaaacagugggccuggaaugggagugcacagccaguggaauaaaccugaucucuaggaaguccugccuguagucuaaccuucaauucucuugcugcaucauuggccuauuccauggcauaccuggaucuccaugcucuucuaaguuuagcccaacccuuaaagaugauguagcucugagucuucucuccugggagcacauugcccucgugccugacuuggcuuuacuagggauccagggucagcccuauccuucucugagccucagucuccauuucucaaugucacaacacauccuuuuuaugagaguguaagugcuucgagaucuuuggaggaauauucuggguucuagagcuucugauagccagggguaggaagggguagccccucccauuuauucuccccccccuuaguccacccuccagcccaaggcuuucacaaaagguagggugggggaagggaggggcuggauagaggccagacuggcagagacaggggcuuugucccaacugauuucugagccaagaguuccggugggaaagcccgugccaggcagaaaggagaggcugggaagaagaagggaggaggcagccaaggaagggggauggagaauguuggggaguaaagagaggaguuuccuuacaaauaaugguggggaggaaguagaggagagggugggcucaggagaagcugugcuuacuugcguucggucuaggaggcccuccuggaaaaggccaggugaguauggugucccuggaggcagggacagucuagaaggcagaagaggcuaaagagauacuaugggagaaggcucuggguucgaggaaggagucuggcacugggaggagcagauggaauucugaguauaagagcacccaccauucaugcuguaaacugagcuccuacugucugccuggugcuaugcauuuguacaggaguuuuaagauacuaaacacucucaaagcacaugguccuaucucaacucaugagauaguaaugaugaugcuuuuuuauaaguaagaaaauaaaggcucagagaagguaaggagcuuggcuuaggucacacagugaguugacuaggacucggguuuugguucugagaagaaaucacuugcugggaagauggggaucagaaacagagaguccauggugaugugaagguaggggacuucuggagccaggauaugugugaacccacaugggugugguagggagcaggggggaaguccauccugaagucuaaccccaucuuuccuucucaugucccucugucagccugcagcauggcccagcuguuccugccccugcuggcagcccugguccuggcccaggcuccugcagcuuuagcagauguucuggaaggagacagcucagguaagcaaccccacuuggggucaccgucucugucuuguucagcccuaaccaacugcuuccaggcuuaggggccccaggaagagagagaauuggagggcuguggggaagcguccaggcuggaacacuuggaaauaagggcugagcugugagcaucugguggguuggagaaaucauggggcaggacuagggaagggcacugggugcaaggcuuugggccccuaagguggaggauaggggauccugaagcuaggaggugggaaagggguggaacugggagaaacccugaaggaggcccuaaagggagcagacugggaaacugggcuggaggacucagggggcgagguuggaggacccugggguguggucuaggaauuuuggagaggaaguggaagacucugagagcagggcaaggaauccugggggcugaauugacugggagacuuugggggaugggucuggagaccgucggggugguccuggaggaccuagagguagggcugcaggacccuggccccuggccccuggccccugguccuaggggggccggggaauccuggggccggaaggagggauccuggagcggggcuuggaggccaccgggugggacucugagggucgacagcguuaaguuccagccggcuccacccguucacagaggaccgcgcuuuucgcgugcgcaucgcgggcgacgcgccacugcagggcgugcucggcggcgcccucaccaucccuugccacguccacuaccugcggccaccgccgagccgccgggcugugcugggcucuccgcgggucaaguggacuuuccugucccggggccgggaggcagaggugcugguggcgcggggagugcgcgucaaggugaacgaggccuaccgguuccgcguggcacugccugcguacccagcgucgcucaccgacgucucccuggcgcugagcgagcugcgccccaacgacucagguaucuaucgcugugagguccagcacggcaucgaugacagcagcgacgcuguggaggucaaggucaaaggugagagggcagggagguuccagagggagggagggagggagggaagggaggacucuugccuucggggaucccacagugugagagggaagcaaagguagcuggaaggcgcagccuggguuggaaaaagagugaggagacacgggccuuuguugucuccuuucucucuucagguggaggacauucuacccacaaucuaacuuaagucccucaugcuguagagugagcacaauugaacuuuauuuacccuuguguacagaggagugacaaggagggugaggggaggccagcgugcugggugcucaccuggcucagggguccucucugccccacaggggucgucuuucucuaccgagagggcucugcccgcuaugcuuucuccuuuucuggggcccaggaggccugugcccgcauuggagcccacaucgccaccccggagcagcucuaugccgccuaccuugggggcuaugagcaaugugaugcuggcuggcugucggaucagaccgugaggugggcaggggcuguggauuggggcuucuauuggccccugagguggccauggccccccuucugcugggugcugccugcugugucaggcuggacaugcagggcuuuuugccucugggggaugaggcuggucugaggaggggaggugaggacccugagcaugugcaucccugcagugcuagaaggacagccagcugucagcaagugucugcacugugguggcagugggguucaauagaaucaauaugggcuggcucccuggugaaagcaucuguacuaagugauucuguccuuccucccuagguaucccauccagaccccacgagaggccuguuacggagacauggauggcuuccccgggguccggaacuauggugugguggacccggaugaccucuaugauguguacuguuaugcugaagaccuaaauggugauuaggagugagagguucccaggggacaauuuccuacucccaugcugcccauagguccucccggggccucugcaggaccuuacuaucccuccugaguuuaagggggcaagcaggaguaaggagacaauuggugucccucucuccaaacacugucacagaggcaagcucaugaccaaagucucagccaggcagcaggauaccgaguuuaacucaucuaccaccugccagguggacucugugcaugacucugcagaacaagaaguuugggccccaucucuuugagcucuaauauccaucuugagguucuauucagacuaugauccuaugaaguagaguaguugacucccugccacagaugagggaacuggagaagcuugcccaggguucccaugggagaccagaguggaaggagcuaccagcugccugauaacccagccuucucuucuccacccaggagaacuguuccugggugacccuccagagaagcugacauuggaggaagcacgggcguacugccaggagcggggugcagagauugccaccacgggccaacuguaugcagccugggaugguggccuggaccacugcagcccaggguggcuagcugauggcagugugcgcuaccccaucgucacacccagccagcgcuguggugggggcuugccuggugucaagacucucuuccucuuccccaaccagacuggcuuccccaauaagcacagccgcuucaacgucuacugcuuccgaggugagcccaccucccugcagaagcugagaccaaucucagaaaggcagaguugaguccuaaaaguccuaccccagucugaucaguuuagcucagggcuuugccauuugccugaaguggucgugggugaaguccagcuugucaucuaggguucuaauucugggcaugcccucugguguggugucugucagcuguuuggcccaaggaguagucaccuuuuggccucuccuuaucugccuucccaccaguaguccaugccuuguuugcuccagcugggcugcugaauaagcucccaucuccugucagcuuauuggcagagcaaagacgaccaacauucugugaauucaaugaguaaucugcccaaguucuuccagucaacaaccaaaugcccucaggagcccucuggaggauuuccagaaacuacagcuuaagaaggugucagaucuuuaacuaccaaauacugguggauggauacaauucccccaaaagggagcaagaccuuaaguacaguugggaauagagauagcuuucugcccacaucuuauggcuuguuucuuuuuuugagacagggucucacuccgucccccaggcuggagugcaguggugugaucaugguucauuguagccucaaccucccugggcucaggggauccuuccacuucaaccuccggaguaggugggaccacaggcuuaugccaccaugucuagcaaauuuuuguaauuuuuguagagaugggguuucaccacaugcccaggcuggucuugaacuccugagcucaagcaaucuaccuaucuuggacucccgaagugcugggauuuauaggugugagccacugcacccaaaccugcccauaucuuauguugggagcuggagcgggaggcaguuucugggacucucagaugcaaaaggcccaggccaagggugaccgacaauaagagaggcauugccaugcggugucucgguccuuccccaguuuuaagccugaaauacuguuacaagagcuggaagcagaaauggaaggagcagacacagccuugaaccucagggagcacuuggucugaaggaugaagacacagcuuuugccaugggaacccccagcaaagggaagacaagaugccucacucccaggaugaggagagacugagagaaaagcauuacuuccauuuggacagaucuguggacauauuuggcugggguuggggagggguggggaaguaaaaguccauaggaagacagguccaucugaaaagaccuccuggaacagggguaguaguaguaguaguaguaguaguaauaauaauaauaguaauagcuaaaacuucugugugcuggcuaugauugugugccaagccaagcacuguuuuggaaagaaauggccuggaucaugaggaggggcaggggagggggaauaugacuacaguugggacuacgauugguggaggacacaggcagcaaggacacaaggucuggugaggaguaaggcucacuggagcaggugaugagggcagggacucacuguccugucuugccuggcugagcacagacagcccucaggacuuuucuuagcccaauuccaccuucacuucauugguuuucugcucuuggcucccuuccccagaggacaaguaaaccauucuaaacuucugguuauuugaaaggaguaggucccagaaggagguggccuuuucccuugccuacuugccccaccacugagauccucaggugaugccugaaguuauuccugcacucugcccuccagcuauccugaggggaugacagccucuccccuucuauuucaagaauuuuggaggcucggugcaguggcucaugccuguaaucccagcacuuugggaggccaagaccacuugaggccaggaguucgagaucagccuggcaaacacggggaaacccugucucuacuaaaaauacaaaaauuagccaguuacgguggcacaugccuguagucccagcuacuugggaggcugagacgggagaaccgcuugaauccaggaggcgaagguugcaaugagcugggaucgugccacugcacuccagccugggugacagaaggagacucugucuaaaaaauaaaagaauuuggggauaccugggacaccucacaccuugccccaagcccaagaucacaaggugguaaagcuauuucauccauccugcuggcuccagccccucccccuagggaauaucucucaccugagccuuuccugaccacuccaaaguaguauuuuccaucacuccaucuucuaacucugcucaaguguucuuuaucuuguaagauuauaauauauguuuguuugucaucuguucuagaauauaauuucccuugaggguaggagguuugcuauuuuguucugcacuguauccucagugcccaggggaaugcuuggcaugacacacuguaggcacuugaugaaugcuugagaaaugagugacgaaguucugggaugcucccugggccccaguaggugcuccacagggaagaugugagagaauugagagaauuccauggugcaagcugugaccugggagggcagagcuaccuauucaggcucgcaucaauacuuuccuccugccacagacucggcccagccuucugccaucccugaggccuccaacccagccuccaacccagccucugauggacuagaggcuaucgucacagugacagagacccuggaggaacugcagcugccucaggaagccacagagagugaaucccguggggccaucuacuccauccccaucauggaggacggaggagguggaagcuccacuccagaagacccagcagaggccccuaggacgcuccuagguaagucggaucccuuauccuaaggaugucuugauugaaagaaguugggggcagaagaggcaagcccagguugaugcuagggugauggaugacaugacucugcccuguccuuucucaguagcucaggggugcagggcaccuuuccugucccucucccaaccuuugcuuuuccaguaaauuccacccccaacucuauggagcuagagaugcuugcacuaaggagcugcgcccuggaaagguggaaccugccuucuuuggucccucuuccgccucacacacccaaaacagacuagaguuuugacagaguaggagggagacaaaugaccauguucuccggggcuaaugauggcucacagagccuucucaaguguugccucaacaauauggcuggggucaaguucuuccaguguggcgcaaggaccaccuguccucagggcggucucuucccuauuccccagggcucacccuccugagcccuacuuuucuccccuucccuuuuuccuuucgguccuuggacagacgcugucccuggugcugaaccguuugugcuuugccuagaauuugaaacacaauccaugguaccgcccacgggguucucagaagaggaagguaaggcauuggaggaagaagagaaauaugaagaugaagaagagaaagaggaggaagaagaagaggaggagguggaggaugaggcucugugggcauggcccagcgagcucagcagcccgggcccugaggccucucuccccacugagccagcagcccaggaggagucacucucccaggcgccagcaagggcaguccugcagccuggugcaucaccacuuccugauggagagucagaagcuuccaggccuccaaggguccauggaccaccuacugagacucugcccacucccagggagaggaaccuagcauccccaucaccuuccacucugguugaggcaagagaggugggggaggcaacuggugguccugagcuaucuggggucccucgaggagagagcgaggagacaggaagcuccgagggugccccuucccugcuuccagccacacgggccccugaggguaccagggagcuggaggcccccucugaagauaauucuggaagaacugccccagcagggaccucagugcaggcccagccagugcugcccacugacagcgccagccgagguggaguggccgugguccccgcaucagguaauucugcccaaggcucaacugcccucucuauccuacuccuuuucuucccccugcagcucugggucaccugaccuguaguccuuuaacccaccaucaucccaaacucuccuguccuuugccuucauucucuuacccaccucuaccuaugggucuccaaucucggauauccaccuuguggguaucucagcucuccgcgucuuuacccugugaucccagccccgccacugaccaucugugacccuucccugccauugggcccuccaccuguggcucacaucucgccagccccacagagcauccucaggccucuccaaggguccucaucaccuauugcagccuucagggcucggccuauuuuccacuacucccuucauccgccugugugccguccccuuuagcugccuccuauugaucucagggaagccugggagucccuucucaccccucaaccuccggaguccaggagaacccguacccccacagagccuuaagcaacuacuucugugaaguauuuuuugacuguuucauggaaaacaagccuuggaaauaaaucucuauuaaaccgcuuuguaaccaagcucugguacccucugucuccaucuccugcuguccaccucucucauuccaugggucugugucauggggagcacuuggaugcuucuucucuggcuccaugucucucccugucucugugugugucuuggccucucuuccuuuuucauuuucggcuucuccccuugucuguccuggcagucuaacagccccucauuguucccccagccucuccuucucaggccugucuacacuuuccuuccuggcugcuaagaucccaaaauuugacuguacacauuaccccuggagaagucaucauccauagucugaggcagugcugggaguuguagucccucacuccugaugaggagaaaccccugcagcccggagugcauguguugugcauuuauauucacuuccaauccaucuugguggugccaagggucauaguaacugagggaacugagggucucucagcauagaggcaguucccuggcauucaguugcccucacccccauccccuagcccugcaucucagcagggggugguaucuaacucucaucccacuaccuacaacuuccgucuucuccacuaacuccugcacuaaugaucauucccuacucuccagaaggaauggcuucacccuccccagacccaaagggucucaaaguaccuaaugcuggagaagacacugaucaaaagcaagugauggagagugugaaggaaggaaucagguucuggggucugagagaagcccucucuacucaggaaggcuaagauucccaguggagguuccuggagaaggcugggauucccuuagcccuaggacccccauguuagauggaucacauccugagucccacccaggcuuacccaugucaacuguuaggucccugcacaacuggccuuggaguucagcccugugggggauagggaggggguuuggugggaagaggagcacaauuggagguaucuacagugucuuaguuuccccaccgggaggguaagugagaggucuccuuggcugcuguuucaauggaaagaaagggaaaacuuucugguuguguagaauaguuguccccaaaaagggagagggaaaaugacaagaagaagaguucuucacccgacucugccugcgcuggguucagguucuguagcccacagccagggggaggggccuauggcuuggguaggggaccaaagaccaaguuugagagccucugucccccaggguuggaggguugaaugggaaggagcagaaaggacaacaggagggacaggaaagugugaggagugggaggggaguucagaauucuacccucuguggggccuggugcuuaauggguuaaaugaaauaccucuuccucugggguugggaggugggcagcaccacaagcugggaagaaacuauuggcaggagggaagaugacagaaggagugcugcuggaaaagcugauucauuucacccaaaacagcuaggucaucccagcaaaauucuuugaauccacuccagcuucuccucucuccaccccuacugauucccaccaggcagugggaccuguggccaggccagcgggaagcacuguggaccuuggccauggcuucuagagguggaugguaaagucugaaggguucugcccuggagugguuuugccucucauggcugagggccuugaccuuaccauggcugagggccaugaccuacacaguuggucuguggagccaucuuccuuugggucaucugaaccagaaaggauuggaaacugacagcuccuguagcacccaagcacauccuaaggacagccaccuccuaccccaggauacagagagaaaaaguccaguaaagcagauggccuagccagauggagcuagauccaggcaacagauugcagaccuucagggcaguguguuagucuaagaggacugccuggaggagagggagccagaaggagggauugagauggauucuagguuggagaaccugcagaaggcccaaaguggaguugggagagggagccugguaaguggaagagucuguggauauaagaaggggaagugagagguugggugauauugagagaaagcugcaugugugaggccagucagcacugcaggacaaugggagcugcugcgacuuaguuccuaagcugggggagaaggggcagggccuagagugaggaaagugggcuggaucuccacuaaccacuucugggacuggcugacugcccaguggacagcaggaggaaugguuaguauucaccuggaccacaccaauaucaggucucaggagcagucaagggauaccacccuccacuguugcugcgguaauccuucuguccccuccuucacuuccauucauuccaccuggacuauacagaacugugcugggaccuggcacaaagacaaggggguguggcacuaaacuccaagccuagagaaggaaaaugaccugcccaauaucacacagaagccagauaagaguuuagagcuauaacuuucugugcccaguaucuuucuccauuguggggcuggguucucagggcucuccuagccucuucuccccagccccuuuugggcugggcucacacugguggccauaacaauggaaggcugagccaaugcugaagucgggagcgggaagaggaaagaaacccagaacucagggcuggguugugaccagagacaggcucuagggagaacuuuuagggugcuguuauagcuuccaggacagagagaccagggcugggggacccucugcacccucuccuggagggcucaggcugcagagugcggcugccucgcuccccccgccucacuucuuucccccucucaggugacuguguccccagccccugccacaauggugggacaugcuuggaggaggaggaagggguccgcugccuaugucugccuggcuaugggggggaccugugcgauguuggugaguguugagggacggggggcagguuugaagccuggacccugccacaacgugcuacuucuggaggggggagggagaacauugguuuuggccuugucauuaaugagucccuguuuuaggcaaguugcauaacuucuuugaguccuacccucaauuuucuuaucuaagugaaaccacaaugccucucauaggggguccauuugagaccagugcaaagcauacuccuggcauuuaaucgguggucaauacaugacaggcuccauucuccuggagaggagagccacugcucguuaggauggagacccaggccggaacuccaucccucacccugguuccugucucuuagaaaaggcaccagcgccccugcccaagagccccuccaggcuccugcuacccccucauucucuacuagcucuuuugcaccgcccuccugucccccuuagucccgccccucucggccugcgguaguggaaggagaccagccccuuccaggggaccuggcccucuggguuuuggggcccuaagaugcccgcccuuaugugccgcaggccuccgcuucugcaaccccggcugggacgccuuccagggcgccugcuacaagcacuuuuccacacgaaggagcugggaggaggcagagacccagugccggauguacggcgcgcaucuggccagcaucagcacacccgaggaacaggacuucaucaacagugggcugggagacagggcgggaggggccccugccauaugcucucacucucucucacucgccuaaccgccuuccucauuaacccaugcacuuauuccuugguuuucucaagcgugcauucccucacucauucguucacuccccuucucauucucucucccuucccacccuacgcuuaggcaguggccuucgggaacggagaguggagguucgcgcaguagagugcgccugugugggccgggccgccgugcagggggccgccuccaaucccuccaaccucccugcucuccgaccuccgucggccuccuccaacuccaacuccaaucuuguugaaaguuuugacucuuuuuccaaaacuccccuuuucuagccuggguugauaucuuccuuauucucccacccccauuccccugcuuuccaucuggcccuugagcagaggcugggguagaagaacccgacaagggcgggugcuggaucgcggggaaggguuuccaaggcagucaccgcagaccgcccgggagcggggaacggccgccaucugcuggcggcugcgcucacugcacgccuucgucucccuagaccgguaccgggaguaccaguggaucggacucaacgacaggaccaucgaaggcgacuucuuguggucggauggcgucccccuggugagaggccccagucgaaccccgccgucuagcucacuuccucuaagcacuucuguucccuaccacccccaccccucccgacccuguccccuucuuuuuccggccuccuucccuuucucgugcccugugccucuucucccugggcucuccucccuucguuguguccucuuucuucccuucuggcucccauucucccuccccuaaagucccugcccucuccuuuccccuuccccgggagauccccuacccccuagcccuaaccuucccucuccuggggccccgcucaccagcccuccuccccagauccucuaggcccucucccggugcuccugguguaggagcuccucaccaccuccuccguucccccagcucuaugagaacuggaacccugggcagccugacagcuacuuccugucuggagagaacugcguggucaugguguggcaugaucagggacaauggagugacgugcccugcaacuaccaccuguccuacaccugcaagauggggcugggugagggcaggcaaaggagggucccagcaaggaaguggaggggugggcuaggggaccagagggacugauguuuguagacagagagugcaaagcaacauagaggagucagaacguguuccagaccaugggagagcuaacaaguuacguggguccacucggaaucccugaucuuuuuuugucauguuguggcccauuuuucucuuccccauggagauucugggaacugucacccacagagccaggcucaguuccuaacugucuuccuuugcaguguccugugggccgccaccggagcugccccuggcucaaguguucggccgcccacggcugcgcuaugagguggacacugugcuucgcuaccggugccgggaaggacuggcccagcgcaaucugccgcugauccgaugccaagagaacggucguugggaggccccccagaucuccugugugcccagaagaccugugagugccaggaagaggcaggugggagugggagacaguagccaacaguagccuuggacuccacuuaaaguccugccugucacuggccaugugaccuuggagccaucacugccccucucugaggcaaaggggaagaggugggcuggaggcucugggguuccuucagugcugaugucugauaacaugcagccccauucugggcucuuacgggcugagcaagaacaucagagggcaggcucugaggagaggagaaggaagagccaggguggagggugagugugugucuuccccaggcccgagcucugcacccagaggaggacccagaaggacgucaggggaggcuacugggacgcuggaaggcgcuguugauccccccuuccagccccaugccaggucccuagggggcaaggccuugaacacugccggccacagcacugcccugucacccaaauuuucccucacacccugcgcucccgccaccacaggaagugacaacaugacgaggggugguacuggaguccaggugacaguuccugaaggggcuucugggaaauaccuaggaggcuccagcccagcccaggcccucucccccuacccugggcaccagaucuuccaucagggccggaguaaaucccuaagugccucaacugcccucucccuggcagccaucuuguccccucuauuccucuagggagcacugugcccacucuuucuggguuuuccaagggaaugggcuugcaggauggagugucuguaaaaucaacaggaaauaaaacuguguaugagcccaggcaaguug

SEQ ID NO: 192910 - RNA, 7107 nt, Homo sapiens
gguugguucugagaaggcuucaaggaauaggcagacauuucagcaaggcugcugaggaaggauaggcuguggaaauuaggaugcagguaggaggaucacagagcaaacacuccaaggugggaaaugcaaguguguguagaaggaacagcaaguauuguuggguugggcuggcuuaugaaguugugacgggcugagggagagacaggacuggaaaagcacguuggggucagguugcagagguccuugacugacagagaggggagcuuggucuguggggaaucuucugcucuguguggucagaggcuggucugacucuccggccuugccccagucuuccuauccuucauccagccccggcuggcucgguaaaaacggcgcgaaucucgcucucccuggguaacuaggguccccacugccuggcuaguggugcuuuucgcgucuucacuggcaccauuaaugaaugaagucuggcucccacccgcggggaagggaggagccucaaccucggguccuuugcucuccugcagcacuccugcccgggucccgccucggggucgccaggcccugaaccccaacgccggcauuagucgcgccugcgcacggcccuguggagccgcggaggcaagggacggagaacggggcggaggcggagucagggcgcccgcgcgugggccccgcccccuuaugucggguauaaagccccucccgcucacaguuucccuaguccucgaaggcucggaagcccgucaccaugucgugcgagucgucuaugguucucggguacugggauauucguggggugagugccgucucaacgguagagccgcucggucaaagagacugacgcggagagggcgggucucuggguccgcgaucuccagcaggagcagcucuacgcgggagccuuuucgagcugccgagccacggaugucgaccccugcccagccucugggaucgcgggcccuguggggaggggcggaggagaccacgccggagccgggccuaggggccgcuuaaccaccgccccggcaggacgcagggacucggcagccccgggccggggaacguuagcgggcggggguugggaaugggugggagcugcgcagucgcugaaccgcugucuuccccagcuggcgcacgccauccgccugcuccuggaguucacggauaccucuuaugaggagaaacgguacacgugcggggaagguaaugccgcuccgcgugcccgugcagccaagcuggcccuccaccugcccuggucuucuuacgcccagagggugguggcgucgcgccaaggccgggugggacguuugccccaaucugggugaauagagacacauccuuuaucuggaacuggggguucucuuuuuaacauagcccaaacccgucuuaaugcuuaaccaaauagggcucagaggcucaaugguuaugcuuuuggggccugggaauuugagguauugggaccaagucauuucuuuagaucuuuugcucuugucaggugggguauuaaggagguugggucccacuuaauuccgucucuuacagcuccugacuaugaucgaagccaauggcuggaugugaaauucaagcuagaccuggacuuuccuaauguaaguggcuuuaguagagguggcgggcagaagggaaagccuucaaguauauccauccuugccucucuccugccugguacagaaggaugcaaaauaggggaucuuaacccggauagaauaaauagaauucagggguccuugaacuggauggauauguauuuucauucccauuaaccacuagcaaaaguuauuuccuuuuauugugaagagagacaauaagugacauugguuauuagccaugucugucacuuugucacuaguagaaaucagguauuuucuuuuuuguguguuucuuguucuuuuguuuugagacagugucucacucugucgcucaggcuggagugcaguggcgcaaucacagcucacugcagccucaaccucccaggcucaagcaguccucccaccucagccucccaaggagcugggacuacaggcacacaccacuaugcccagcuaauuuuuguauuuuuguaagagacgggguuuugccauguuacccaggcugauccugaacuucugggcucaaacaguccucccaccucggccuuccaaaguguugggauuacaggcaugagccacugugcccagccugaaaucagguaguuucauauucuauaacaugcguugcagauauuuuaagugauauuuauauacauguaaguaaauauauacauauaauguuauuuacuuugagauuauguuagucauuacaucugcuugcuauuuaaugcacuaauaggcacauguuacucuuauuugaauuuuuaaaaauauuuuuugauuguguaaauuaucuauuuugcuucaugcauuuaacaacuuuauucugagaaaagguccauggcaugcacauacacucacacauacacacaccaauuuaagaaccccugucuagaaucuuguggacccaguugcuaccuucuacuuauuuucuuuuuucuccuaacacagcaucuucucacucuuguucacugcccugcaaguguucuuuuccccuggagagagagguagggaaucaagagagaggcagguuguucauuuguccuguccuuuuccuuucagcugcccuaccuccuggaugggaagaacaagaucacccagagcaaugccaucuugcgcuacaucgcucgcaagcacaacaugugugagugggguagggcuggugagggaccccaggcugguaguuugucugagaguggaugaugccaagggugauuuguugucauuuggccuacagguggugagacugaagaagaaaagauucgaguggacaucauagagaaccaaguaauggauuuccgcacacaacugauaaggcucuguuacagcucugaccacgugaguuuccuuagcacacaucugcugaauggaguaucagaaaaagggguauuuaggaacccaaggguuaucucuguuccauucugcugcugcuaccuucccaccaauccagauuguuagaauaagaaacagaacuuauauuuuuugguuuguuuugucauguaauucuggugcuggugccucuucuuucuaaacuccucuuuccccacccugccauccucaagugaaggcaaugagaacccaccuagagaaggggcuacuaaguguccaucacuggccugugcccugauuaacuacaaagaugaucaccacuauucucauucuguuuuuuccucucaggaaaaacugaagccucaguacuuggaagagcuaccuggacaacugaaacaauucuccauguuucuggggaaauucucaugguuugccggggaaaagguaggaagaagggaaaagaagaggauacuucucuaucucugcaggcuacuacuccucagaccuaagcaucuuauugcuuuucuucuagcucaccuuuguggauuuucucaccuaugauaucuuggaucagaaccguauauuugaccccaagugccuggaugaguucccaaaccugaaggcuuucaugugccguuuugaggugacguuuccugcaccuuucucuuauaaaaacacucacaggcuccccugggaccugcaggaucccauaguggaggauucuuccccggcuuuugccuaaugggaucaaugguuggacaccucuagaccuuuaagucuugggaagagccuaacuucuauaccuuggaggcacugucuacaaaaaaauggaggagguagacgcaggcaacacgugaauguugcuguucugguaugcaucuguuggacuggguuggggucguuauaagauuugguguauuuuccuuucaggcuuuggagaaaaucgcugccuacuuacagucugaucaguucugcaagaugcccaucaacaacaagauggcccaguggggcaacaagccuguaugcugagcaggaggcagacuugcagagcuuguuuuguuucauccuguccguaaggggucagcgcucuugcuuugcucuuuucaaugaauagcacuuauguuacugguguccagcugaguuucucuuggguauaaaggcuaaaagggaaaaaggauauguggagaaucaucaagauaugaauugaaucgcugcgauacuggcauuucccuacuccccaacugaguucaagggcuguagguucaugcccaagcccugagaguggguacuagaaaaaacgagauugcacaguuggagagagcagguguguuaaaugggacuggagucccugugaagacugggugaggauaacacaaguaaaacugugguacugauggacuuaaccggaguucggaaaccguccuguguacacaugggaguuuagugugauaaaggcaguauuucagacuggugggcuagccaauagaguugggacaauugcuuacucauuaaaaauaauagagccccacuugacacuauucacuaaaauuaaucuggaauuuaaggcccaacauuaaacacaaagcuguugaaauauugaugaaaauguaagaauuuuugugaccacgggguaggagaaguuucuuuaaagacguaaaaagaaaaaaaccauaggcugcucugccuguggaguagccauucuuuauucuuuuacuuuuuaaaauaauaacaaucacaaaggaaagauuugccaauugaauaggaucaaauucuacaacuuuuccuaaggcacccacaaauaaaugacaagugagacaaaaagcacuaguauaaagauuauauaaagaccuauaaaucauuaagacaacugaguuuuuaaaaauggacaaaauccaugaacaauuuauaaaauagaaauauagccaaaaaugucuaaaagauguuuaugauguaaggaauuaucaauuacaacagugagaaaccauauuuccuucuauccgaugaguaaaaaguuucuaaaguguuggcaaggcuuaggaaagugauaugcauuuccugcuggucaaguuguaaauuaguauagcuacuuuggaggacaauuguaaaauuuaaaucauauccuaugacccagcaauuccaugcuauaaaaacucauccauggccgggcuugguggcucacgccuguaaucccagcacuuugggaggcugaggugggcagaucacgaggucaagagaucgagaccauccuggccaacaugaugaaaccccguuucuacuaaaaauacaaaaauuagcugggcaugguggcaugugccuauagucccagcuacucaggaggcugaggcaggagaauugcuugaaccugggaggcagagguugcagugagccgagaucacgccacugcacuccagccuggcuacagggcgagacucugucucaaaaaaaaaaaaaaaaaaaaaaaaaaaacauucaaagagacauauacuaagauguucacuguggcauugucuguaaugacaaauaaguggaaaccguguaaauaccugucaauacuauggaguaccauguggcaacggaagaaugagacugaacugugugaacuaacaugcaaagauccccaaaacaggccaggugugguugcucacagcuguaauaacaacaccuucagaggcugaggugagaggaucaguugaggccaggaguuuaagaccagccugggcaacauagugagaccccugucucccaaaaauuuuuuuuaauuagcugugcgcaauugcucaugcauagucccagcuacccaggaggcugaggugggaggaucacuugagcccaggaauuugaagcugcagugagcuguguucuugccacugcacuccaaucugggugacugagcaagacccugucucuuaaaaaaauaaaaaagaucuccaagcauagagaagagucuggagggaaacaccaaacucauaacagucuuacugcaggcaagugggauaaaggcccagacuccaugguggaaguuaaagggcauuuccaaguuaaggcuaagacuugcuuuucuaacuaagagaaugugcucaugcauugcuuguguaguagaaacuaguuuuuagaaaagaaagcaaacuuaagaaacacugacuccuguggagaugacuuggcaccacucuccuuucacagagcagagucugaauagucuucagagauaggccugugggccagauugccauccccuauggaccagaagccaaggaucucucuagugauggucagagggcccaaauggcagggauacccagugaugucaggaggaauaguacagacagaaggugcuaagcagacaauucaacugccauguuuugccacccccugugagcagggauuagguguucaggccaguaucuugggcaugggggagccuuuggccagaagagguauaaagcucagaaguuuuucagucugauaacuauugauauaauuuccauagugugagggagcgguaugcucuacccuuguguauuuaaggcaggacagagaaauugaggaugccccuggggcuagaucgaugauaugaccagaaaucaaaaagggaaugcauuauuuauugcuguguaacacuguuaagagaggagguaguuaagggauggauaggcacauagagagggaaggucucaggagaagggauagaaaggaacuauguucacaagaacaacggcaagacagugccuauacugccucuacaguuaauaggaaaaacggaagaaguuacccuuaagcuaggauguugcucagaagugaccaucccaacuuuggugcgggcacaauaaaucagccuaaaugucccuaauuuaacccagcucauuauaaugucauuaaacaugacauuagcauugugguuuuagcacccccauggguuuugcuuaggcacucauggguaauaaccaagauggagucccuuuggcaaaacuuaggcaugcacagcuguaguaccccaagaagaaaauguuacuucucucaucugggcaaaacccacagaagacuucccagcuucugccacauaaaagacacagaacacagacgccuuacuggcaaccugcuuucaagaccccugucuuugcugagagcuuuccuuuuucccaauaaauucuacucugcccuacucacucuc

SEQ ID NO: 192911 - RNA, 7107 nt, Homo sapiens
gagagugaguagggcagaguagaauuuauugggaaaaaggaaagcucucagcaaagacaggggucuugaaagcagguugccaguaaggcgucuguguucugugucuuuuauguggcagaagcugggaagucuucuguggguuuugcccagaugagagaaguaacauuuucuucuugggguacuacagcugugcaugccuaaguuuugccaaagggacuccaucuugguuauuacccaugagugccuaagcaaaacccaugggggugcuaaaaccacaaugcuaaugucauguuuaaugacauuauaaugagcuggguuaaauuagggacauuuaggcugauuuauugugcccgcaccaaaguugggauggucacuucugagcaacauccuagcuuaaggguaacuucuuccguuuuuccuauuaacuguagaggcaguauaggcacugucuugccguuguucuugugaacauaguuccuuucuaucccuucuccugagaccuucccucucuaugugccuauccaucccuuaacuaccuccucucuuaacaguguuacacagcaauaaauaaugcauucccuuuuugauuucuggucauaucaucgaucuagccccaggggcauccucaauuucucuguccugccuuaaauacacaaggguagagcauaccgcucccucacacuauggaaauuauaucaauaguuaucagacugaaaaacuucugagcuuuauaccucuucuggccaaaggcucccccaugcccaagauacuggccugaacaccuaaucccugcucacaggggguggcaaaacauggcaguugaauugucugcuuagcaccuucugucuguacuauuccuccugacaucacuggguaucccugccauuugggcccucugaccaucacuagagagauccuuggcuucugguccauaggggauggcaaucuggcccacaggccuaucucugaagacuauucagacucugcucugugaaaggagaguggugccaagucaucuccacaggagucaguguuucuuaaguuugcuuucuuuucuaaaaacuaguuucuacuacacaagcaaugcaugagcacauucucuuaguuagaaaagcaagucuuagccuuaacuuggaaaugcccuuuaacuuccaccauggagucugggccuuuaucccacuugccugcaguaagacuguuaugaguuugguguuucccuccagacucuucucuaugcuuggagaucuuuuuuauuuuuuuaagagacagggucuugcucagucacccagauuggagugcaguggcaagaacacagcucacugcagcuucaaauuccugggcucaagugauccucccaccucagccuccuggguagcugggacuaugcaugagcaauugcgcacagcuaauuaaaaaaaauuuuugggagacaggggucucacuauguugcccaggcuggucuuaaacuccuggccucaacugauccucucaccucagccucugaagguguuguuauuacagcugugagcaaccacaccuggccuguuuuggggaucuuugcauguuaguucacacaguucagucucauucuuccguugccacaugguacuccauaguauugacagguauuuacacgguuuccacuuauuugucauuacagacaaugccacagugaacaucuuaguauaugucucuuugaauguuuuuuuuuuuuuuuuuuuuuuuuuuuugagacagagucucgcccuguagccaggcuggagugcaguggcgugaucucggcucacugcaaccucugccucccagguucaagcaauucuccugccucagccuccugaguagcugggacuauaggcacaugccaccaugcccagcuaauuuuuguauuuuuaguagaaacgggguuucaucauguuggccaggauggucucgaucucuugaccucgugaucugcccaccucagccucccaaagugcugggauuacaggcgugagccaccaagcccggccauggaugaguuuuuauagcauggaauugcugggucauaggauaugauuuaaauuuuacaauuguccuccaaaguagcuauacuaauuuacaacuugaccagcaggaaaugcauaucacuuuccuaagccuugccaacacuuuagaaacuuuuuacucaucggauagaaggaaauaugguuucucacuguuguaauugauaauuccuuacaucauaaacaucuuuuagacauuuuuggcuauauuucuauuuuauaaauuguucauggauuuuguccauuuuuaaaaacucaguugucuuaaugauuuauaggucuuuauauaaucuuuauacuagugcuuuuugucucacuugucauuuauuugugggugccuuaggaaaaguuguagaauuugauccuauucaauuggcaaaucuuuccuuugugauuguuauuauuuuaaaaaguaaaagaauaaagaauggcuacuccacaggcagagcagccuaugguuuuuuucuuuuuacgucuuuaaagaaacuucuccuaccccguggucacaaaaauucuuacauuuucaucaauauuucaacagcuuuguguuuaauguugggccuuaaauuccagauuaauuuuagugaauagugucaaguggggcucuauuauuuuuaaugaguaagcaauugucccaacucuauuggcuagcccaccagucugaaauacugccuuuaucacacuaaacucccauguguacacaggacgguuuccgaacuccgguuaaguccaucaguaccacaguuuuacuuguguuauccucacccagucuucacagggacuccagucccauuuaacacaccugcucucuccaacugugcaaucucguuuuuucuaguacccacucucagggcuugggcaugaaccuacagcccuugaacucaguuggggaguagggaaaugccaguaucgcagcgauucaauucauaucuugaugauucuccacauauccuuuuucccuuuuagccuuuauacccaagagaaacucagcuggacaccaguaacauaagugcuauucauugaaaagagcaaagcaagagcgcugaccccuuacggacaggaugaaacaaaacaagcucugcaagucugccuccugcucagcauacaggcuuguugccccacugggccaucuuguuguugaugggcaucuugcagaacugaucagacuguaaguaggcagcgauuuucuccaaagccugaaaggaaaauacaccaaaucuuauaacgaccccaacccaguccaacagaugcauaccagaacagcaacauucacguguugccugcgucuaccuccuccauuuuuuuguagacagugccuccaagguauagaaguuaggcucuucccaagacuuaaaggucuagagguguccaaccauugaucccauuaggcaaaagccggggaagaauccuccacuaugggauccugcaggucccaggggagccugugaguguuuuuauaagagaaaggugcaggaaacgucaccucaaaacggcacaugaaagccuucagguuugggaacucauccaggcacuuggggucaaauauacgguucugauccaagauaucauaggugagaaaauccacaaaggugagcuagaagaaaagcaauaagaugcuuaggucugaggaguaguagccugcagagauagagaaguauccucuucuuuucccuucuuccuaccuuuuccccggcaaaccaugagaauuuccccagaaacauggagaauuguuucaguuguccagguagcucuuccaaguacugaggcuucaguuuuuccugagaggaaaaaacagaaugagaauaguggugaucaucuuuguaguuaaucagggcacaggccagugauggacacuuaguagccccuucucuagguggguucucauugccuucacuugaggauggcaggguggggaaagaggaguuuagaaagaagaggcaccagcaccagaauuacaugacaaaacaaaccaaaaaauauaaguucuguuucuuauucuaacaaucuggauuggugggaagguagcagcagcagaauggaacagagauaacccuuggguuccuaaauaccccuuuuucugauacuccauucagcagaugugugcuaaggaaacucacguggucagagcuguaacagagccuuaucaguugugugcggaaauccauuacuugguucucuaugauguccacucgaaucuuuucuucuucagucucaccaccuguaggccaaaugacaacaaaucacccuuggcaucauccacucucagacaaacuaccagccuggggucccucaccagcccuaccccacucacacauguugugcuugcgagcgauguagcgcaagauggcauugcucugggugaucuuguucuucccauccaggagguagggcagcugaaaggaaaaggacaggacaaaugaacaaccugccucucucuugauucccuaccucucucuccaggggaaaagaacacuugcagggcagugaacaagagugagaagaugcuguguuaggagaaaaaagaaaauaaguagaagguagcaacuggguccacaagauucuagacagggguucuuaaauugguguguguaugugugaguguaugugcaugccauggaccuuuucucagaauaaaguuguuaaaugcaugaagcaaaauagauaauuuacacaaucaaaaaauauuuuuaaaaauucaaauaagaguaacaugugccuauuagugcauuaaauagcaagcagauguaaugacuaacauaaucucaaaguaaauaacauuauauguauauauuuacuuacauguauauaaauaucacuuaaaauaucugcaacgcauguuauagaauaugaaacuaccugauuucaggcugggcacaguggcucaugccuguaaucccaacacuuuggaaggccgaggugggaggacuguuugagcccagaaguucaggaucagccuggguaacauggcaaaaccccgucucuuacaaaaauacaaaaauuagcugggcauaguggugugugccuguagucccagcuccuugggaggcugaggugggaggacugcuugagccugggagguugaggcugcagugagcugugauugcgccacugcacuccagccugagcgacagagugagacacugucucaaaacaaaagaacaagaaacacacaaaaaagaaaauaccugauuucuacuagugacaaagugacagacauggcuaauaaccaaugucacuuauugucucucuucacaauaaaaggaaauaacuuuugcuagugguuaaugggaaugaaaauacauauccauccaguucaaggaccccugaauucuauuuauucuauccggguuaagauccccuauuuugcauccuucuguaccaggcaggagagaggcaaggauggauauacuugaaggcuuucccuucugcccgccaccucuacuaaagccacuuacauuaggaaaguccaggucuagcuugaauuucacauccagccauuggcuucgaucauagucaggagcuguaagagacggaauuaagugggacccaaccuccuuaauaccccaccugacaagagcaaaagaucuaaagaaaugacuuggucccaauaccucaaauucccaggccccaaaagcauaaccauugagccucugagcccuauuugguuaagcauuaagacggguuugggcuauguuaaaaagagaacccccaguuccagauaaaggaugugucucuauucacccagauuggggcaaacgucccacccggccuuggcgcgacgccaccacccucugggcguaagaagaccagggcagguggagggccagcuuggcugcacgggcacgcggagcggcauuaccuuccccgcacguguaccguuucuccucauaagagguauccgugaacuccaggagcaggcggauggcgugcgccagcuggggaagacagcgguucagcgacugcgcagcucccacccauucccaacccccgcccgcuaacguuccccggcccggggcugccgagucccugcguccugccggggcggugguuaagcggccccuaggcccggcuccggcguggucuccuccgccccuccccacagggcccgcgaucccagaggcugggcaggggucgacauccguggcucggcagcucgaaaaggcucccgcguagagcugcuccugcuggagaucgcggacccagagacccgcccucuccgcgucagucucuuugaccgagcggcucuaccguugagacggcacucaccccacgaauaucccaguacccgagaaccauagacgacucgcacgacauggugacgggcuuccgagccuucgaggacuagggaaacugugagcgggaggggcuuuauacccgacauaagggggcggggcccacgcgcgggcgcccugacuccgccuccgccccguucuccgucccuugccuccgcggcuccacagggccgugcgcaggcgcgacuaaugccggcguugggguucagggccuggcgaccccgaggcgggacccgggcaggagugcugcaggagagcaaaggacccgagguugaggcuccucccuuccccgcgggugggagccagacuucauucauuaauggugccagugaagacgcgaaaagcaccacuagccaggcaguggggacccuaguuacccagggagagcgagauucgcgccguuuuuaccgagccagccggggcuggaugaaggauaggaagacuggggcaaggccggagagucagaccagccucugaccacacagagcagaagauuccccacagaccaagcuccccucucugucagucaaggaccucugcaaccugaccccaacgugcuuuuccaguccugucucucccucagcccgucacaacuucauaagccagcccaacccaacaauacuugcuguuccuucuacacacacuugcauuucccaccuuggaguguuugcucugugauccuccuaccugcauccuaauuuccacagccuauccuuccucagcagccuugcugaaaugucugccuauuccuugaagccuucucagaaccaacc

SEQ ID NO: 192912 - RNA, 73189 nt, Homo sapiens
uugagaccaaguuucauaaaguuuuuacuuggaaaaaaaaguuuuacaaaauaucuuuccaaagaaauuuucccauagaguacaauuaauucauguagcuuucuuccuuaaagauuacaguaugacauucagaggggcgagguuucuugaauagccaacuagccgcaaaaccuacaagagaaguagauuuuuuuaaagugccuuuaaaaugugaaagcaaguaauguaauuguugaaucuauuugaaauuuuaaaauuuucuuuaaaaugguccauaugguaugcacaauaucacagcuggcacaaaacugccuguauuuaguuugaaacacaaaaacaaugcauaugaacaguauucuuugaaaaguaauucaaaaugcugccacugcaucauaaaggcaaacuuagauaagaguguugacaguauucagagaauucacaaaacaagcugauauuaaaguauucagacaguuaccuugauuuuuuucaaauaccacggguaaggguaaaagaacuuguugccaaaguaacucaggauaccuuauuucaaacuacauguaaccuauuuugcuauagauacucuaaacaaaugaacaacuagguuuuaggauguaaauucccauuuccuagacagggccuagucuuucuguugcaaucuggcagcuuuaaacuuugaaacccucuuuccaguuucuucagaugcuuccaacagaacuuccuuucguucuggaauaguggguagugcgggaugagcaauggcugggggugguguuaaggaaggugauacaaauucuuuuucuauaacaguuccagaaaaagccuagaaaacaaaagucagguuaugguaauaaaaugcaaauaagacacccacaaaaucuucccauucacucauuuggcaauucuuuucauuaaaaguaaauucacgagauuuuuggcuagacaacacuacuacaccaaaauacuaauuguucagagaaaccaacaccauuaaguuuuaauuucaccaccaaacagaaguaauuuuuacaguauacaugcaagaaaacaaaauguaaaauguaaauuuuaucugggaaaaaaaagaaauggauaaauaaaaggucuucaaacuuucauacauuccauucauguccagcccaugcugugaaaaauaauguauuaaaauaaaaaugcuauuagggugucaaacucugacuuuuguacaucaguugaugaaugagcuauccuaugauggccuugcugccugcuagccaauagcuuaguuucaccaguacugacauuucuaacugauaucucuuuggugguguuuaugcaauuauuuaaauauuuuacugcauauugccucaauuuuaaaagaucaguggaaguugaaaaauaaaagugcugauacuaguaggaauaaguacagguuucaaaauuuuaauauaauuaacucaaugacagaaaucagaaguuccacaaaaaaagaaaugacucaauuucaccuggauguuugcugcauuuaaucuggucaacuauauguucaacuggaacagaauuaaagaaugugcauaaauugcuggaaauaucuguacaugucguuuuauacaaaaauagguaagacacaaggaguuaauuuuuuuuuuuuuuuuaagauugcugguauuuagaaccuccauccuucccucuacaaaugaaaauuugacaggugaacuuuaauguacauuuuguucuccucugucuaccaagugcucaaaauuaguuaaaacaacguaacaccuaaauaauuuaaaaagccaccuucuucuaccuugccccaccacugaaacaaaaacaaagaaagccaucucucuccuacauuauuuuuggaguucaacugguaaaagcagcuuaaagcuuacuuuccuaaaaacuccacuuuaucacgaugagcauagagccuucuucuccuucuucuauuuaaaaugccuuugaaaaagagguauuuuagcauuuaaaaagauacugaaaaggauaucuuccaaaguacuuaccauaaucaugaacuauuucuuugauguuaaaaaauguauagcaacuacuauuaaacauuuccauacaaaaugcaaagcuacuaagggugaaauaaaaaauagguuccacacucuagcuguaccaugauacacuaaguccuuacaaaaaacuaauuuucaaacauuuaucagcaauuaccugauaacauccauuaccuguuuucuaacaguauggaagacuaucaaauaagguaagauacuuuccaggucaccuaagaucauuauacuaagaagaggggaagaaaacauucuagucauauguacugucccuaaaugcuaccaaucuccauccccaauuaccauuuaauacacugaguauaauaccauuuaguaaaagcaauggaauuuuuagauaagguuauauauaugcauguaucuuauuguauauacaaauguguacacugguuugauccaggcauggguuccccaaucuuccuaaauacuuuuuaaauugaaaacuucaaauacgcaccaaaacacaagaaugaagaaaucaauagccuuauauuucacagacauccuuauuuggggauuuccuaaccuccccugcaccaccaccaaaaacuguaagaaguguggugggugaaaguguauugagugugcacuauuuuuucuauggacagggucuacagcuuucaucagauuauaaaacaauuccauaaucccccaagaguuaaguuucacugguacaagguaaaauauuagacuuuagguaauuaucugcuaugcaugcauuauuuuucuuuaacuuagccaagguauuuaaaagagaauaauguaaucugcuccuuacacuaucagaaaaugaccuacugguaauuuauuuaaaauaaacugcgaaauaauuuccuagcuacaaauguaauacauaaugccaaguaagacauuuuaaauuucccauuuugcugaaauagaacguuaagacaaguaauguguuuaucaaaaaauaaacuauuugauuaucacaauauuuguacuguuugugacuauuaauuuuuuauuaauuaguaccaagaaaguauaaaaccuagaauuaauuuaaucuuaugacuuuucagauuaaauagcuaaaacuggucaaagauacuauaugaaauaaagaauuaaaagauacacacacacaccucagguguuacugauaagggcaaaaguuucuuuugauuuucuugugguuccucuuccaaaaugcucucacuggugucacugcaaguggcuucuucgcagcugauacuccucaaaacuccccgccuaucaucaaauucagcagcacugcuuucacuagugucgcuacacacacuauucucucuacuucgagacuucaggauggauuugcgagggacauauucuccauucacaacaucaacaaaggcucugugauauucaaaacacauaugcauucacuauacguaacucauaaaacugagaacaacuuuuugaaaauuuccuugaaucuauucuagaaauuaaucugaaaauuuuuauuacaaucuuauaucuaaaauagucacaaucacaauaauuuuauagccucaaaugguaucuucauacuauuuugaaagcuauuucucuggccuaauaauaaaacacagcauguuauuuauuuauuuuauuauacuuuaaguucuaggguacaugugcacaacgugcagguuuguuacauauguauacaugugccauguuggugugcugcacccauuaacucaucauuuacauuagguguaucuccuaaugcuauccuuccccccuccccccaccccaugacagaccccggugugugguguuccccacccuguguccaaguguucucauuguucaauucccaccuaugagugagaacaaaaacacagcauguuauuuuuaagcauguccuagguggcaauagcaugguuugccaaaauucuacauaaaguuuuagacccacguauacauuuagcaauuuucacugauuuauaaauaagggucauaaaaacaguagguauuuucaagugauaguuuucucaacaaacaauuccaaaaaaaaggaaaaaaaaaaaaaaccugcaacaguauaauuucuacucugaaaagguaaacugcaugccaagcauguuacggcugugguagaaacguagggaccuagcccacuggaaacaaaaaugcuuucugaagauacaagauuuucugacuagaccauuuggaaauguuucaaaagcacuggugaagaggagaaagugaaaaaaaaaaaaaauccuccauucccacugcucuggacugggaagcuacagccggucagccuaucagauccuaaguuaacuccucagaacacuucacuuuucagugagggucuucuguguuacagucaacuuucuccaguaaagguucaguggcagaaagagaggcaagcccagcagacugcccugcagcugugagcgccucccaccuguaaaugucugcaggcguccugauggucggcagcuccugggcagaguggccacugccagugcuguucuuucguuuacguuuggcuucuucuuucuuuucacugaauuuuaaagugguauucuuuccaguauuuauucggaccuaaaauuucagagcaagaaauuaagaaucuuuugacaaauuaaaucaaagugaaaccaaaacaaauaaacucuauaacuaaaaaaauaauaguaagagaggcagcugaaauuuucugaugcugaaaugaugugcauuaucagauggaauuuuuuaaaaaguccuuaucucauagaucuaugacaucuaaagaaaaucuucuuuauuaacaaauccuagucuucagugucuuuauuauuguagagaaagcaaaauacauuugaacuaaaugcuagauuucuuauaaacuucccaucaccccauuccuuugauauaaguguuuggcuugaauuauguauuucaaaagaaagaguauaaacaaaaauucaguaagaauacaaccuuuaagucauaaaaguacuauuaaauaaugccuauuuagaauuuuuaaaacaucucuaauuuuuagaaauugaaggaguaaaaaaauaaaaaccaagccuguucaggguucacaugggguuaacauguuauuuuucuaucccuagucagcacuuagagcauacuuuccacaauaaugaccacuauuaccuguaacguuccugcaaauaauauuuguucuuucuguuuuaucuaaaugaaaacaggaaaaaaguaaaagccuggcaaaagauuaaaaagcgaccuuuuuuucuggcuaaucaucucagucaacuuuucccgaagaaucaggggaagaccccuucagucugacauauuagaauauaaaaacacaaacaauuauuucacuucauauaggagcaggaauaacuuuaggaagcuaagaaauaucaaauauguuuuaaacauauuucacuaaauaauaaucacacacacuuaagaaugauaccacagacccuuaacugauacaggcaaucgggauauuguguagaaagggcacucagaggcgaaagaguuccuguuuuguuaccaaccagaucuaugucuucuaggccuuaaauuucccugagaaagacgaauuagacgaauucccaguguccccuuagagcaguacauggagcagagagagggcaaagauggacuuaaggcagccuauccuuccuucaaucagagccaagcugcuuugaucuauuuuaaauacugggauucuacaguaaguauggagggaacaaaaggcuuuucauacuagagaaaagcuuuaaaacucuguauuagaaaaucuccagucacccccagcucuaaaaugccaaaauucuaagucaugauuauccacagauguuuauauuuacuuugucagaaaagaaacuaauuuuuacuuccuccuacauuuucccuuugugccuaugaaguauucauuuuauguccauagaaaacaaccuggcauaauuaaaaauuuaacuaaugcagucacuuucaacauccuaagcacaccaaaauguccacaauauaauuaacuccaggauucuuaagaaaacucucugaaugaaggacaggugaaguuacaguaguugccacucaaaucugauccccuuccagaccccaaacaaugcauuguuucagagaacaauggaccaauaccagcuaacuaaauuuuuuuucccuuuuucuucuuaaauuggucagaacaagaggcaaaagaugauuuuccugucuggcacuauccacaaugauaaugauuguuaauauugcucuucuaaaaaauaucauaaugcuuaauguucaaauuauaugcaaaauuaguaaaguuaaaaguauacaaacccucuuaggcucaacaguaugugaaaaauauauuguugguauagaauuaucuccaaccccuaaagccucauggucguuaucaccaucaucgucgucaauguugucgucgucgucgucaucaucaucaucaucaucaucaucacugugguaagaacuggaaccauucacugaacaguucaacugacuauucacuugaccacugaaugguucugaacuugcaacauccuuaugacaaggaguaugagagucuguuacuugaugcaucgcauucacauuuguguuacgaucuuccuuuuccucuucagaagaugucguaucuucuccauuugcaaucacaguaucaggcuuacuagcaaggaagaaaauuaacaagaucaaacaaacauacuagaauuuuacauuauuuaaauuuccaguuaguuuccauggguaaauacuaagaucuugaauaaaguauuuuuaaaacuagaauucuaaguucaaaaacaaaaaaauguuuugaaauaaauuaacaaaaaacaguuccuaugcugcuucuauauauugagguuauucagacauaaguagaauauagaagauaauuuuuuuaucuuugcaagaaagauauuggccauaugcaauauaaauauaguaucaauaauaauaaaguuguaagaaauucagagaacauuuaucucuaaagaccagaaauugaaaccacauaauacacacuuauuuucuacuccuauacucagaauauuuuacaaugagcauguauuauuguaauuuuuaaaaauaaaggauuuauacauaugcacacgaauauaucuauaugcaugagugaacauuuaucauacuugauucuauaaaagaugugaggaccuuacaaaaauaacaaaauugaaaaugcaacagaacugaaauaacaucauacaaaaaauagaaagagaaucaugaccaagaaaaaucacaagauccaaaacugguuuuaaaaaaugaauaguauuaguuaaucaaaaagaccuaagaauuuauaggugaaacacuaggaaaaagaaacuuuuaugcuuccugcccuauuuuucacagaaacuaauuauugcauaugguacaucauuuaagcaaaauaauauagaacuucucgaguagcagauuucauuuagcauuuuaacaauucuaagugugugcuaauguguauuucaaacagcaauuucguaaaguuucucauacauauagcuaucugaccagauuacaaauuaccugcuccaaaguuuauaaaaggaaagcaagaauaaacauuuuacuguaucaaauuuaaauucaaaguguauuuuuguuuuucacaacacauucaaagauagagcacuauccuggguguggcauaaaaauacuucauuuaaaauuuaacauuauauauauuaaauccaugauuauuaaaagucaacuaucugguauaauuaauuauauaaaauaggccauaauaaaaaaugaagauguugaucuuaaguauuuaaguacauguacaugcaugggaauaugcacaaacacacaauccuauaagaaaauauuccagagaauuaauguucaucuugaggugaaaggauuauugauaauauauuaugcuucccugcauuuucuucaaugaacacauauuauuuuauuaaugaagaaaaagauuaaugaggaaauguguauagaaacaaauuaucuuggaaagauaauuugucaucaaguaccuaucaaguucacccagcaauucuuccugucucucuaguucuucaagucgagcccacaguucuuuaucagcuagcaaauccuuggauuucacaucauuugcaauaucugcuucaaaaauaucugaaguuuuugguuuggaaugcgguuuaugagcaauucgguguuuugcuauuuagaaaaaggaaaagacguggcuguuaauagccaacauaaaaaaggcacaaacccagacuuaaugagacuuucuuuuggggcaagggaaauauugaaacagaggggucacaauuuuuaagccaaacagaacuccaaggaugaaugucucuuacagccuugcuacucaaagugugguccauggaucaacagcacuggcguccuuggggaacacuucagaaguguaagcucuaaggacacccuagacccacugaaucagaaucuguauuucaacaagagccccagagaaccugcauacacauucaagguugugagaagagcuucaaaaaugcauaagaaauggccacaaugcacccugguuauaaggcgaaaugcaacacauaaaugauaaauuuccauuuaccauccuuacucaaggaaaucuaguuacuacaguaacgugcaaaagccuugugacaggauacuuuaaacuccagggcacugccaaggaaugaguacccuacaaggaaacaacggcggcucaucucuguaaaguucuauuaucauuuuacauaugaacaucucuacuuuuuaaacugcuucauuuguaaucuucaugugaggaaaaaagaugggucaaaucugaacucagagguaucugcuuuucauuuuaaaaaauagauuauuuuuuaauaaagcaaauuaaggcuuuauuugcuuuauuaaagcaaaguaaugggaaaguaaugggaagaagucuaagaugcguccuguuaugagauauggcacuaccagaugaccucgaguccaucauauauucaaauuugcugcauuguugcauacaucugaaaauaucaaauuauguuucacagccuuauucucuguaacuauuauugauaagacaguaguuaacaauuuuuauuucagaccuguagcgcucauaauuugucacuggucaccacaaacaaaaaucuugucuuucuguucaacuuuaauauacauauccuuuauuucaccuucuaaagccacuuccuguuacuugugauguggcuucuuucaaccaguaaguuaucuuaagaguucaucaccaaaauaugagugcugaaagucaaaacgaaugcucaguacauuuguuuaagacacuguacagucuucuacaguagcaaauaauaagccaucuguaauacuuuuuacaauuucacuaccguuaacacuuuacaacugacgaaggaaccauuggcuuuacagaaguaaacccaaacacauaagccagccuuggcaaaagaaaucuacuggguggagaugggaacaaccugcgcagggaaagccacugcaggcaccauaagaggaauggcugaaauacacccacauucauucauucuuccaaaaacagcuuacaaagcugcaguuuuaaaagaagaaaaacuagcaaaagauaucuuaggacuucaccauggucagagaacaaauuaggagcagauccaugucuagaauauacaucuucugaguuuuagagguuuggagcacuggagaacuuugggagaaaaaagccauguaaucccaccacuaaaacagaccagucaggaaucacauuuuuaaccaaaaguuauuuauccauuaauguuucacauaaaaaaaaaucaaugaguagaaaaauguuggcauccuaugaauuuaaaaguguauucuaaaucccaaauaucucacagaaagcccacugaaaaucaacaaaaaucaaaauaucuaaacagcuacacauaaaacaaucuuacugcuuaccuuuaaauucgaagucacauuuaauuucuucucguaugucaacaauaucaccugcagccugguuuuuaaacaaaaaaaaagcguauuaacaacacaaaucuccagcauacuaaaauuauccaaagagcaacuauucaaccuaagaugucugaaagcauuuuaaacuucaauuaauuuguuccuuggcuguaagauagcuucauauuucuuugaaaauauuuucuaaaaauauagaagacuaaaaacaaauacucacaucgcucauuuucugcaaaucuucugugaauucaacucuggauucaaaauuuuucaucacuuuuuuuaagucaucuauuguuuuucuuacaucugaaacaaugaacacaaccauuauguaaagcauggcauauauacgaccuguaggaauauuuuaacuguaguccuaucacacuacaaguaugauuuaacaguaaugcuuuucaaaaaucuuacacuauuuuccuuuuaaauggacuuuuaauaaguuauacuguguauuuuugugcuauauauauagcacauuacuuuguucguaauaaaaugucuaacauauuuucucucuauuacagaguacagaacuagauuguagaugcugccuggugcuaccagguuucuauaggauaaauaucuaguuggaucaucacauaaaaugcaguauuucauaacaguuuuguugcacagguaauuuuuguccagcuggauaaugcauagauaacauagauuaagacaaguuauucuguuccugaacagaaaauauuccuaaauuagaugacugaaaauacaacacauuuuuuacgguauauaaucaaccauuuccaaguuaaacugcauaacaacacaacacacagccuuucaacaucuccuaaauaccacccucuauuaaccuauuugaggaaaaauuuuaauuugagaauagacacaaacauuucucuacccaauacuggacaaaugcaacaaguaauucauguuucuguaaucagaguagaaaucucugcuaagcaguaaauggcaccaucuaaaaaauacaugggguuucuaacuauaauuauaugcugaacaauauccuacuuuucuccaaauacagaauuuuuauggccaagcgcugauaaagaauaauagacagugauaugauaccuccucccccagaugcucugugauuuccuacuguuuuacaacaggcacucaaucaguaagcagaucagaagaggauggaggagaaaaguacauaguucuuucucuaccaaugaugaaugcaggucuggcaaaggucuaagcaguuaaaauaucuuuuaaaagaaugaaaauaaggaagggaguuaaaagugaaauaucaccacauaugaagggcuucucgagaguggcacauguucuccgauacggcucucaugcuaugcaaugcuauuuuaaauaaaacacaaucacuuaugcucuagccaugaauggguuacaaaaaaaagacugcauuaacaaaaugaaaauuacgguguaaacaguucauaaaaucucacagcccugaugucgcucuagaucauuaaauuucugcaacaauuagaccuuuucucacggcagcaaauuggaccgguugccauggcaaaucugagcccuuaagucauauaucuuugauugcagaaaggucagacucagacagccuaauaacucaaggagcuguuugacagauuucauccgagcauggucacauaacagcauaaaacuaugucggcaguuguuaaaagcagggggucagggaaaagguuaagguuauggaauguuuuugcuucaguaaacucagucagauaaugugucuaaccagcuuuagaucuaaagaacauuauuuuagguaggaggucaaaucaauaacuuuuuucaagaagacuggaaaauauuaaaaauggcagguagguaagcuaaguacauuuuuaaaagucuauccacauauaaauacugugcaacuaagcuaaagguaucagugaaagccuuggguugucaauguguaaagaauugauuguucacugauguuauaggaguuacuuucaaucaacuauuguugacuuuaaaaaaaauucaucauaacucacgcauguaagaaaaaguugugugaauauuccauuuaagaaacaaaguguuuuggaaauaggguaauuaugaaaaacugaaauacgauugcacaguuccauuuuuaaauucaagaaagcuuucugaaucauacauuaauauaaaccacuaucacaagguuaagaaaucagaucucaaaagcauauacuuuauaucagaaucucagaaauaccacaaacugauaagcaccaacaccgucacauacacauuauauaugcagauauauaucucuauuaaauuaucauaaguccuauguccuagagcaacaaaaaauuagauagcuauacagaaaauuuaagacaagacaaaagaaagcugggcaaccgcaaggcaaacgaaccuggugcucacaauaacauaaaauacagcagaaugguaagcaccuauuucgauuuuguacaaaguaaauaacaagucuaaauucguaucuacagguuguuucaaaagaacaacaguuaaaaaagcagaaugagaauuuaauuccauuucuuucuauaacucugagauuuaacauuagaaaccaugcuauuacauuuuucacuaaagcuuuuguacucuauucuccaaaaauuuauuuuaagaggugaaauauacaugucacuaaaaauggaucauuuaaacagacucaaucaauuuuaacgcuccaaacauggcuaaguugaaaucuaauuaagcaaaauuucaaaccacacugaaauuauagcaaauaacacuacugagagaaaaagaaauauacuuugugauauagacaauaucuguauucauuuuaaucucaaacauuuuaguuaccaauuauuauagaaaaaagaaaacaaauucaaugggaucaaagaaauagcugugaaaauguacaaaagacaguucuccacagauacuuccccccaccccaaaaaauaaaaacuaaaauugaagaaaaaaauuaguaauuugaaggacagaagauuguuuucaaacacagguuauuuuaacuaaaaaucagaaguuaaauuuucuaggauuucagaaguauagaaugagguauaguuuuuauuuauuuagcugacaaaaccaggcugcagguuaaaugugcagcaagcauaagcuaauauuuuaaagucuucacuaauucagaaucuuuguccagaacuggcugaaauccuuugaguuagcuaugaaaaaggagacuuaaagcaaauuaacagugcaaauuccaaagacauguuuaaaccaaaaaagaaaauuuaaaaccucauaagaacuuaagcagucauuuucaccuaaagauaaacgauaugccuacucacuaaguaagaccaaauauuuagaaacauuuaguuaacaguuuguagaauuguauauauuugaaaggaacagaaaugcagauguaauaaaaauuauuugcaaaacacuaauaaaaguuaugaacaucauucgugaaaggagucuuuuuuacuuagccauauauucauauguacugaauaguaugaagccuguaaauaugcaauucucuacugaauccuuugugaccacucuauucucaaccucguuucuuuugugugcuggaauuuuuaaauauucuuucgacagcuucaacaggacgugcccccugguggaaauacucacaaaccucuggacaggauguacuccuucuuaaaccaguacaaagguuuggacuucugcuuuaaaauagcacauugaauacauguacuuaguauuugccuuuccccuauaccuuagguaaaguaacaacuaagaaauuuuuaaaggcauaaacccauaaagacaaauacauuugaagagaaaauagacaagaaaugucaaccaaauuuuggaaacugcacaacugauaauggacuuugcacaacagaaaaaaauggaaccuaacuguggcugggaaaagcuacuacaagucgaucugggauaucggaccuggaaaaggcaauucacuugagaguauuuccaaaagaagagugaacuuuaaccaaagaucuagauaaaaguuugaaaagaacagguccccaaacccuaaucucacaagaaagguuucuccuuucuugcuuaaacaaaagauucacagcuuagagugguuuguagagaugguagggaauagggaaguggaaagagaauagaaaaugucuuagugaaaccaggaggauuaauuccaagugaacauacugaaccuugaaacgcccagccugguucucagaacacuagaugaagaagaucagaagacucuuuuguagaaucugcugauacuuaaagauugcucaauuuaaaaaaaauaaauaaaucagcuugcuaccuuaaaucccuacaaaaaauaccuaucagucaacaaaccuugccuaugcacacagagcuuccugacaguacucaacgcaaguauaaaugguuagccaaggaucaccagacauuugaagaaauucuugaacauuaaugcuagagaccaaaaaaagagagcaagagagaaaagagggagaagaaaaaagaaacauggaggaaauguuuaaagaugaaaacuuuaaaagaaaaaacaaauacuccuuaaaaaaagacccuccauccaugaaacaagaacaggaugcuguaacaaagaaacagccaaagaacaaaaaaaaagugcuuccagaaaugaaacuauguacaggaaaauuuuaaagucaauacaugauuuaaaagaguaugcagaagaaaucacuucaaaaauuacaacaaggacaaacaaauaggcaacaagaaaaggaaauuuucaaauuacuaauauaaauuucccacggcuggaggacuuaagccuccacucaaaaaaggccuacuaagcacuagcaaacaaauuuuaaaggauccauagcacggcuucaagguguaccacuguuguauuccagaucauggggaauaaggaccaaaaaggaaucucaaagcuuuaaaaacaaaaaaacaaguuauauacaaagaaaacgaaaauagcaucaagauuuucaauagcaacacuuaaagacaggagguaacagaauaauguauccaaaauucugagggcaacaguuacuuaagaccuagaauucuaaacagucuacuuaacaauaagaagcaggaguauaaggaauauaagaguuauucagauacauaaaaauucaaagaaguaccuccgagcagguucccaaaaguuacuuaaagcaauauuccaacaaacuaaauagaaccugaaaaaagggugcuuugggaaacagaaaacaggaaauaaauaaaaggcaaaaacaggguaagaagacaccaggaagacggcucuccuuugaucaggagagaagccaguccaaauugaagcaagacaaugaaagacuccagcaguaaaauuuuuaacaacaaaaaaaguaucugacugaauuaaugacagacacauagaaaacuaugcaacaaaaaaagcaguuaaauucaacuaaaagccuguacaagaacaaaauggaauuacauaauaucuaagcaugaauacugauucaacaaaaauugugauacaacaauagcaaaaagauuagagaagcagagacagggaggacauguaaaaaugcuacaugguccucuuaaauuauagacagguaguuaauaauacauaaaauuaaaaaaaaaagaaguaaacaaaaacaggauaugccaaccacuggaaaauaugaauaaaaagagcagaguaaaaauagccaaaaacagaaaguaauuacaucugaggaaugggaacugugagccaaaagggauaagugaaugcugcucuuuuuuuuaaauaacgucuuaagaugguuugugguuauuuaaagcuauauacaucuaucauaaacuaaaaucauaaauuuguauuuugaaaugccuuauuggagauacucaagagcauacacauugcuugauaagguacgaaucuacaaauccaagaagcucaacgaaauccaaguaggauaaacccagacccacaccaagacacacuauaaucaaacuguugaacaacaacaaagagagaaucuugaaagcaucaagagaaaaaccacucaucacaaacaagaaaucuucaacaagauuaucagauuucucagcagaaacccugaagcacagaagguuaugggaugacauauauuuaaaaagugcugagagagaaacaaaauacuucauccaagaauucuauguuuagcaaaacaacagucuuuuaaaaaugaggggaaauuuaagauauucccagauaaacaagaguugagggcauuccucaccacuagaccugcaauccaagaaaugcuaaaggaaguucuucggguagaaaugaaaagacaguaacucaaagcuauaugaaaacacagaucucugauaaagguaaacacauaggcaaaaauaaguauuacugucauuuugguuuguaacuccacuuuuuucuuuucuaugugauaaagaaaaaugaauacacaucacuggacaucuauauuaauggagacacaauauauaaagauauaauuugugacacaaauaauauaaagaggugaaggagcugaacaggaauaaagccucuguaugugauugaaguuaaguugguauaaauucaaaauacauuuuauaaccuuaggauguucuauguaaucgccaugguaaccacaaagaaaauaccuauauuuuaaaaagaagugaaaaggagaucaaaaccauucaccauaaaaaaaaaucaaacacaaaggaaggcaguaauauagaaaugagucaaaaaaaagcuauaaaacaugcagaaaauaacaaaacagcgaaagucuuucccccaucaguaauuacuauacauguaaacagauuaaacuucccaaucaaaaagcauaaauuggcagaaucaauuguuuuaaaaaaaggauccaacuauauacugucuauaagagacucacuuguagaucuaagggcacaaauagguugaaagugaaggaaugaaaaagauauuccauaccaauaguaaccaaaaaagaaaugaaguagcuauaguaguaucagacaaaauagacuuuaaauuaaaaaagucacaagagacaaaggauauuucacacugauaaaagguucaaucuaucaagauacaacaauuauaaauacauacauaccuaacagagcucaaauguacaaagcaaaaauguacagaacagaagggagaaauuauuucaccauaauagcuggaggagacaugaauauccccuuuucaauaaaggacagaacagccagaaggaaauaaagaacaugaacaccacuaaagaccaauuagaccuaauagacauauauagaaaccuccacccaacaacaggaaaaauacacaccuucuaagggaaacauggaacagucaccaggauaggucauaugagaggccacaaaauaagucucgaaaaauuuaacaagauugaaaucauauaaaguaucuuuucuaacuggaaugcucaauaacauuaaaaaucauuaauagaaggaaaauuggaaaaagucauaaauauaugaaaauuuuacaaaauaaucugucaaugggucaaagaagaaaucauaggcauaauuaaaaaauauggcugggcacaguggcucccagcacuuuaggaggccgaggcaggcagauugcuugaggccaggaauucaagacuagccuggacaacauggugaaaccccgacucuacuaaaaauacaaaaauuagccaggcaugguagcccucaccuguagucccaacuacuagggaggcugaggcagaagaaucccuucaacgcgggagauggaaguuacagugagccgauauugcaccacugcacuccagccagggcaacagagugagugagacucugucucaaaagaaaagagaaaauacccugagaccaacaaaaaugaaaacucaacgaaaauuuaugggaugcagcaaagcaaugcuaagaaagauauuuauagcuguaaauaccuacaucaaaaaaaaagaaauacuucaaaucaguaacuucacuguacacuuuaagaaacuggaaaaaaaagaaagaguaaacugaacccaaagcuaacagaagaaaggaauaacaaagauuagagaaugauaaacaaaacagaauuuuuauaaaaugcugaaaaauuaaugcaaccaaaaguugguuuuuuacaagaucaacaaaauugacaaaucuuuauuagacugucuaagaaaaaaagagaagauucaaaucacuaaaaucacaaacaaaaguggaacaauaaaaacuauuacagaaauuaaugggauuauacagaaauaguacaaacaacugacugccaacaaguuugauaauuuagauaaaauagacaaauuccuagaaaaacacaaacuaccaaaacugaaaucugaauagacuuguaacaaguagcauauugaaucaguaaucaaaaaccucccaacaaagaaaggaccaagaagagaugcuuucacagaugaauucuaccaaacauucaaagaauuaacaccaauccucucaaacucuucuaaacaaugaaaagggagggaacacauucugugagccagccagauaaaaauaugaaaacuacaggcuaauuucucuuaugaauauacauauaaaaauccucaacaaaaugcuggcaaacuaaauacgguagcacauuaaaagaaugauacaucaugaccaagaaugaucucugccacacccuggaaugcaaggauggguucaacauauaaaaaucaauguaauauacuacauuagcagaaugaagaggaaaaaacaugguaaucucgauugaauccaaaaaagccuuugacaaaauccaacaaccuuucaugauuaaaaaaaaaaacucaauaaauuagaaacagaagggaacuuccauaacauaauaaaggccauauaugaaaaccccacacugacaucacacucuaugaugaaagacugcgagucucuccccuaagauugggaauaagacaaggaugcucacuaugaacaugucuauucaacaacauacuagaaguucuagcuagagcaauuaagcaagaaaaacaaauaaaaagccuccaaauuggaaagaagucaaguucucucuacuaccaacauaugauacaaucuuauauguaauaugcagaaaacccuaaagaauacacacacacacacacacacaaaacacccuuguaaagcuaauaaaaaaaauucagcaaaguugcaggaugcaaaaucaacacacaaaaaucaacugcauuucuaugcacuaacaaugagcaaucuaaaaaggaaauuuguaagcaauucauuuaaacuagaaccaaaaggacuaaacucuuaagaaggugcaagacuugcacacuaaaaacuauaaaguguugcuaaaacaaauaagacacaaauaaauagauauccuauguucacggagugaauauauuuaauaauuaggaugucaauacuacccauggcaaccaacagacucagugcaacucccaguaaaauccaguaauuuuuuuuuugcaaaaacagaaaagcccauucuaaaauucacauggagucucaaggguuccccaauaaccaaaacaauauuuaaaaagaaaaacuaaguuguaagucucaucuuucuguuuucaaaacuuacuauaaagcuacccucaucaaaauaaugugguaccaacauaaauacagacuuacggaccaaaaaauagaauacaaagcucagacauaagaccucauaaauguaugaccaaaugauuuuugacaagaguguaaaaaccauucaaaaagguaaggacaguguuuucagcaaaucguguugagaaaacuggaaccacaugcaaaagaauaaaguuggacccuuaccuuacaagcauauauaaaauggauacagcaaccuaaaugaaagcuaaaucuaggaaacucaaaaaaaaaaacacagggaagcugcuucaugacauuuggcaacaauuucuuagauaugacaugaaaagcauaggcaaaaacaaaaaaacacuaacuggacagugaaaauuaaaaauuuuugugcaucaaacaacauuaucaagaaaguaaaagggcacucuaccuggcagcuauuuuuuuuuuuaaguaagacaaaauaaaagaagaaaguaaaagggcaaccaacagaccaggagaaaauauuugcaaauuacacuucugauaagggacuaauauccagaauauauaaagaacuacaacugaacaagaaaaacaaacaacccaaauaaaaaaugggcaaaagacuugaauagacauuucuccaaagaugauauacauguggccaauaaacacaugaaaagaugcucaacauaauuaaucacugaagaaauacaaaucaaaacccugcugauacuucacuucaaauccacuucaaacuauauuccuugaugauaugccacuucaaaauauauuuauuuuauauauaaaaaauauaguaacaaguguugacaagaaugugggaaaacuggauuccuuguauuuugguguugagaauauaaaaugguacagcugcugugaaagacagaauggagguuccuuaaaaaauacaacauagggccgggcgugguggcucacaccuguaaucccagcacuuugggagacugaggcagaugcaucaccugaggucaggaguucaagaucagccuggccaacauggugaaacccugucucuacuaaaaauacaaaaaauuagucgggcaugguggugcacaccuguagucccagcuacucaggaggcugaggcaggaaggcucuugaaccugggaggcggaggcugcagugagccaagauugcaccacugcacucccagccugggcaacagagugagacccugccucaaaaaaaaaaaaaaaaauccacagaauuuccauaugauccagcaauuccacuuucagauauacaccccaaauaauuuaaagcagggaacuaaauaaauauuuguauaccuauauucauagcagcacuauucacaauagcgaacagaauaauucacauuauucacaaaauaaaauauuguucauccuuaaaaaaaaggaaauucugacacgugcuacaacacagaugaaccuagaaaacauuaugcuaugugaaauaauccagacacaaaaggacaaaugcuguaggauuccacuuauguaagguaucuagaauagccaaauucauauggaaaguagaauagugguuaccaggggauggggggaggaaggaaaaaauggggaguuaucaccuaacugguacaguuuuaauuugagaagaugaaaaauaucuggagauggauggugguuauagcugaccaaccaugugaaugaggggaagggaagggaggggaggggaggaaaaggaggaaaagacaguaaguuagcuaguuagcagugccagggggccuacaauaagguaucaguuucaaaacaaguuugcaaacacauuggguuggcaaagguguagucagucuguuaaagccagcacugucaaaguuaaaaaucuacuucacuucaugccagcaauuguaucuuaagucauuuauacuacagauacacacaaguacaaaugauacacacacacacacacacacauacacacagagguuauucacugcagcauugauuuuaacagcaaaaaaaaaggaagacgaucuaaaggccuaucaguaaaggacuggcuaaauagaguacaauauaauacuauauagccaugaaaagaauaagacagcaagcugccaaaacaaaaaaauaaaagugugccuacaauuugaguggagguguauagggugggguaggaaugcauaagucuauggcuguaaaugcacagaauaucccuggaauaaugaguaagauacugauaacagcgaugccuccagggagguaaacuggauguuaaagaacaagaaaaggaagcauaguuguuuuuuaauaaauauccuuuagauuuuguaucauguccauauauaaccuacuaaaaaaauaauuuuuaaaaaagcccaucuugugaaugaccugaugcaccucauacaaucuuucuucuccuaucacuuaaaaaaaaaagcuguauucggugcuaacgucuuaucacccacuuucuucugaaaucugccuaaaaauguauuccuaaaucaagauuuucuuuagaaugcucuguaagauaacagacauuacauuuuaaaaguuucucaaaaucaaguaaguuugggaaccacaacauuaaacaagacuaaagggauauuuuucauuacagggcuucuaaguaacgugccuaugugcauuuuacucucugguagagggaaaguagugugcagugaucuacaaacuuacuugauuaugucaacaacauugccucuaggucaccacucauccaaugcuuccccucaaccuucacauucaaucaguugccaaguccuaucaggcucagaaauucuuccugcuucugaucucuucucuaagccuauagccauuaccccuaguucaugcucuuaucccuucauguccacucuuccauuuaauaaaaauaacuuuauuguaaaaaugaagacuaaguaugcauuuuuaagacaaaaguaaaaauaagauaaaauaaaugugucagauacaauucugaacaaaagacacacgguaaaauaauucuccccauauuaucuuugaaaggaaaaucuauuaagaucauccuauaaguaaaacuguuuaacauuaaucacuggacuaaugacuagaaauguggccaaaugccuguugucacagccaaaaauucuaagacauggugccuagauacuagaauuucaagucauucuauauaccgguguucaaaaguagauuacagagacaugcagaaacaaaauuaccaaaaacuugucuauacuguagaaaccucugauuaaauccuggucuuuucacuuagucucauugaagauguacuccuuucuaagccaaaaauugcucucuaacguaaaaaagaauucagcaaaucucaaagcaaguauuuagaguaaaacuuuuaaguucacgugaaauacauuaaucccuaauuuguaacauuaaaaauacuuuaagaaguuccuauuucagcaacaacagaguaauaagauacuaaaaauauuaaauaaucuaaaagaggacaagaaaggguaacaagaggaacaaaaacgggggaaugccaaaccugaauccaaacauauuacauuaaauguaaauggucuaaguacaucaauuaaaagacugaaauuaucagaaucaauuaaaaaggaaagauccaugcugccuauaagaaacucacuuuaggccaggcacaguggcucacgccuguaaaccuagcacuuugggaggccaagguaggcagaucacuugaggucaaggguucgagaucagccuagccaacauggugaaaccccaucucuauaaaaaauacaaagauuagcugggcaugguggcacucgccuguaauccccacuacucgggaggcugaggcgggagaaccacuugaacuugggagguggagguugcagugagucaagaucaggccacugcacuccagccugggcaauagagcaagacucugucucaaaagaacaaaaaaaagaaacccacuuuaaauaugauauaguuagcauaaaaguaaaagaaauggaaaaauauacgccaugcaaauauuaaacaaaaaaagcucaauguaucaaauccaguaauacaugaaagaauacaccaugaucaaaugcgguucauccagggaagaaaaaucaaucaauauaauccaccacauuaacagauacagaagaaaaacuacaagaucauaucaauagaugcagaaaauacacuggacaaaauucaacauauuuucauuuaaaaaauccgcaaauuagaaccagguagaaaguucccuaaacuuauagggaguauuaauuuuuuuaaaaaaccuacagcuaacacacacuuaacaauaaaaugccaaauuuuuccccagaagaucaguuucaagacaaagacaccuaccuacucuuaccacuccuauucaauauuauacugcaaguccuagccaaggaaguaaggcaagaaaaagaaaugaaguguauacaccuuggaaaggaauaaaaaaaaauaggagcuauuuacaaaaggcaugauugucuacauagaaaaucccauggaaucuaccccaaaaaaguucagagaacaaauguggucagcaugaauggaggauacaauguuaauucuuuuuuaaaaagaguuauuucuauauacuagaacacuugaaaaacaagauuuuaaaaugccaucauuuacaacagcuccacaaaaggugaaacacuuagauauaaaccuaacaaaacgcauaugaccuguaugcucaaaaacuacaaaacugauuaaagaaguccuaaauacagagauacacuguauuuacaggcuguaaguauuuacacacuggaagauuuaauaguuaagaggucaauucuccccaaauuaauguguugauuuagugcgauuccaaucaaaaucccacuaggaguuuuuguaaacauaagcgagugguuucuaaaauguauauggaaaggcaaaggagguagaacagccaaaacaauuuggaaagaauaaacuuagagcacccguacuaccaacuuuaaggaacacuguaaggaacacuauaaugcuacaguaaucaaaacagaguggcaucagcaaagagacagacacauagauaaagaaacagaacagaugguccaaaaacacaauuacacaaaauggcucauucauuuguuuuuuaacaauuuaaguuauaauucacauaacauacaauucacccauuuaaaauguacaauuugaugguuuucguauauucaaaggguugugcaaccauuaccaaaaucuguauuuuuguauuuucauugccccuaaaaaucuccauacucuuuagcagucacucuccauucucucucacaccuuccuggcccuaagcagccacuacucuccuuucuuuuauaaauuuaccuuuucugaauauuucauguaaauggaaucauacaauauauggucuuuugugacugguuucuuuaauuuauucuaauguuuucaagguacacaucuuuuuauugccaaacaacauuccacugcauggauguacgacacuuauucaccuguuauuaguugauagacauuuagguuguuuccauguuucggcuacuauaagcagugcugcucuuaauauucauguacaaguauuuguggacauacauuuuuauuucccuuggguagaauacuaucuagguguggaacugcuagaucacaguaaaacacaauguuuaacuugcugaaaaauuccaaacuguucuccaaaguggcuuccccaguuuacagucccaccagcaaugaaugaggguuccaauuuuuucacauccucaccaacaaguguuacugucuuuuuuauuauaaccauccuagugugguaucuaagauggucuuguugccaauucauuuugacaaaggugcaaagucauuucaauggagacagaacaguauuuucaacauaguauuggagcaacuggacauccauaugcaagaaaaaugaaccgugaccuaaaccccacaccucaaacaaaaauuaacuuaaaaucaaucacagaucuaauuguaaaauaucaaaguauaaaacuuucagaagaaaacacagaagaaaaucuucaacaacuaagguuagguaaagcguucuuagauaugacaccacacauaugauccauuaaaaaaagcuaaaagcugaacuucauaauuaaaaacuugcucuggaaagacacuguuaagagaaugaaaagacaagaugcaaagugggagaaaauauuugcacaucaccuauuuaacauaaauccagaauauauuaaaaaaaaaaaaacucucaaaacgacaguaagaaaauauacaaugcagcggggugcgguggcucauaccuguaaucucagcacuuugggaggccaagguggguggaccacaaggcggacagaucaugaggucaggaguucaagaccagccugaccaacauggugaaacccugucucuacuaaaaauacaaaaauuagccgggcguggugguacgcaccuguaaucucagcuacucaggaggcugagcaggagaaucacuugaacccgggaggcggagguugcgaugaacugacaucgcgccacugcacuccagccugggcgacagagugagacuccaucucaaaaaaaaagaaagaaaauauauaacccaggccaggugcaauggcacacgccuguaaucgcagcacuuucagaggcugaggcggguggaucaccugaggucaggaguucaagaccagccugaccaacauggugaaaccccaucucuacuaaaaguacaaaaaaauuagccgggcaugguggcgcaugucuguaaucccagcuacucaggaggcugaggcaggagaauugcucgaaccucggaggcuaagguugcagugagccaagaucgccccacugcacuccagccuaggcgacagagugagacuccaucucaaaaaauaaaaaaaaaaaagcauauauaacccaauauuuuaaaaugggcaaaagaguucaacagguaaaagaggacacaaagauaaaauaagugcaugaaucaaugcucaacaucauuaggcaaugaugcaaacuaaaaucacuauacaccuauucaaauggcuacacuucuuaaacugacaauauugagggcugguagagacgcaaagauaccacuaucacacacugcugaaagagauguaaaucauacagccacuuuggaaaacagcuugguagucucuuaaaaauugaacauacauuuaucauaugaucuaacaaucucacuuguagguauuuaccaacagcaauaaaaauguauguucgcacaaaaaccuguacacaaaggcuuacagcagcucuguuccuaaccgccaaaaaauggaagcacccaaaugucccucaaaaggugaauggaaaaacugcuguacgugcauuuaauagauaugcauguaacggaacacuccucagcaauaaaagaaaugaacuuugaauacacagaaccaccuggaugaggcguuacagcaagugaagaagcuaaucucaaaagacacagacgugaagucgucaauccuucagcaguaggcagccguagggugugaccaccaaggggcagugugagggagguuuugauaggagcugaguccugagagcaguaucuuguauccuauuccguguccugacuguggugcuggcuaaacaaaucaugacccguguuguaacucagaccuuccccaauuaccccaaucaaccaugacauagaugacuauguguuuaacugguuauauuuccucugccuuaagaaaaauaaaguaccuuuucuuaauaaaugugaaguacaacaauauaccuaaguauuuucuucagguauaaauuauaaaaccaugugaauaaaagagcuuuacguaauuuuuuuuuuuuuuuugagacaaaauuucgcuuuguugcccaggcuggagugcaguggcacaaucucagcucacugcaaccuccaccuccuggguucaagugauucuccugucucagccucccaaguagcugggacuacaggcacacaccaccacgcccggcuaauuuuuguauuuuuaguagagacgagguuuuaccacguuggucgggcuggucucggacuccugaccucaggugauccaccugccuuguccucccaaagugcugggauuacaggcaugagccccugcgcccggcccagaauuuauuguaacaggaaauauguacuuugaaaauuauuuuagauaaauauugaucccaaaagucaucuauguuuggucacuuuccaaaaccauauuuaacuacuagaaagugauuuacaaaaacauguuucucuacucuagagcucuauucuauuguaguauaaguauucccauuaauauuuuaaguuauaacuaauuauaaagauuuuuuucacugaaauaugaaaaucaaugugaacaaacuucaacaggcuauggauucauuucauaacaucagagcuacuucaguauauaaagagaggcuucgucuucaguaaggucuuuaagaaaaaaguaugcccauucucuuucgcuaauauacaugacaaaaauaaugcagcaaagccaaaagauuuaucauugccagaaauuacauacaggccuaacaauaagauucugauuagugucacaaaagaucaaaauauauaucaauuauaaacuuauaggaguugauuugcaauuagagucuccaaauauaguucccagaauuucacugaguaaaugaguucucuaguacucauucauguauaagugaaaucaaguucagcuuuagaaaacucagcuguuuucuguuuaguaugaccuuauuuauaaaaaaggaucuucccaucauuuauuuucaaauacacauuuaacuaaaagguuaaaaagcagguagggcggauauuauacucucaaucuaaauacguauuacagaaauaacaacagauuauaaacugaaccuaauuuuaaaauauaacuaagcuagaacccaagcuagcucauccaacugcaaaauguguaguguguguuguguguguguauguaggcuucuauacaccuacagauaauagcacggauaaacaaaacucaagagcugcccuaauaaagggaugcagagaacucaaacaacugaaaaaggauaagggugcuguuuuagguagcaccuuuucacaccuggucuccucuaucaaaugaaaauaugguuuuuuuuccaaaccaaaaagcauuuuuaagaauugucuacuuauguaaacagguauuucucuuaguucacuaaggagaaaacacauuauuucuguguacuaaaguauuaagugcaaaaauaagucuauaauagcaacuaaaaaaaaauuauaagguauaaaaugacuccaauuuuuaugucuucccaacuucuaacuacaaaaucacauaaugacuuugaaacuuuguaacuucugaaaacaugccaauguaggugacauuuccaacccggaugcuccauucuccagcucauucucaaauguugguucuacucaaacuaccuacaauucaacagaaucacaaacagccuggauucauagaucacggaagguacuuuugguaagaaacagcccuucagcuuggcaaucugugaauggauacauauacaacaaagaaacaucauuuaaaauggguaccuacguucuuuccggugcucaacuaaaccuacagccugcuuugcugagcacuuugcaaaccaguugucccccaguaaaacagugacuucauuaguauggacaaguuuuccuggcaugaaggcaaaagggccaaaugguaccuauuguuuaaaaaaaaagaaaaaagggaaaaaacauaaaacacugaaaaguacauuuuauaaaacacuucgcauuaaaagccuuacauaacugaauuuuuuuauuuauacauugggaaaaauaaaaugccagcuucacagaaauucaacacuauauuaaaauuuuacuaggaaaaucuaaagaaaauugcuuuauguucauaaaucaauguuaaaacaggaaaauaaauccacaccauauuuacauauagcucuuaaagaaaguaguacugucucggcauguuuauacuuuucauucacuugcaaaucuaagugaaagcaacuaguagugaaacauugucaaugcaaaauacuuuugauaaagaaaacuaaaaauuauuuucaauaaaguagacacuuuugcaaagcaggaauuaguaaacaaauagcuuuaauggaucuaucuagcuauauauacaaaauacuuggacuaguauaaaagaacaaagucuucauaagaaagaacauucaugcaaugaaaggcucuaauccagggcucaugaacagaucacuaugucgaugugaagaucauuaaaacaaaaauuagcagcacguuuuuauauaaaaaucaauguccuaagguuuaauucugugaauuacaaaacauuauggccuauuccugcucuggcuaacaagaaacgacuuaguaccauauuucugucauaauuacauuuuuuauauaguaaguuuccauuugaaauauguccaauuuugugcuaauauuuaugucauuugugucaccauauauauucugaaaaaaaaagguaaauaccaacaauuacuacaauuacuguguucuuauaaaguaaaacaaaacaaaucuuccuugcuacauaguuaccuuggacacaguccaucagccugacauucugugaaccgacacauaguuaauauguuuacaagaaacaacuauuacuuuaaaagaaacacaccaaacauaccauuauauuauaagacaauuuaucaggcaaggugcugagucuuucucgaagggcauuauagucauuaucuaccuucuuccuguugacagaaaacaccaaauacacacauuauuaacgauuuuucuuuuuuuuuuuuuuuuuuuuuuuuuuuuuuuuuuuuuuuuuuuuuuuuuuuuuuuuuugagacagagugucgcuccgucgcccaggcuaaagugcaguggcgugaucucggcucacugcacccuccaccucccggguucaagcaauucuccugccucagccuccugaguagcugggauuacaagugugcgccaccaugcaaggcuaguuuuuguauuuucaguagagaggagguuucaccauguuggucaggcuggucuugaacuccugaccucaugauccucccacuucagccuccugaagugcuagaguuacaggcgugagccacugcaccuggccucacucaaaagcuuuauuaaaucucuucuuucagucgugugugguggcucacgccuguaaucccagcaauuugggaggcccaguaggccagguaucauaaaacaagcuaaucaaaaacauaauuuuagcaaauucaagauuaaugugguuuuauuuuuaguuuuaaaauccuguuuuuauacaguuuagcaauggcauuauucuaccauacauuuauugaagaauuaagacucuucagggacucuggcauuuagaagcagaauacucaaauuuugagaauuacuguuuuuuaagauacaagacuaucuggaccaaauaaaaugugaaaauuaagggagacaguaaaagagggccugauauuuggagagaagaagggacucaagaugaaaaaagaagagauuuauuuauuuuaagacagagucucucucuguugcccaggcuggagugcaguggcacaaucucagcucacugcaaccuccaccuccuggguucaagugauuccccugccuuagccuccugaguagcugagacuacagacgcaugacaccacgcccagcuaauuuuuguaucuuccauagagauuagguuucuucgccacguuggccaggcuggucucgaacuccuggcuucaagcgauccccccaccgcagccucccaaagugcugggauuacaggcaugagccaccacacccggccgaaagaagagauuuaauaaagcuuuugagugaauagauacuggcugugaaguugaaaucaugaacaugaaauuugaucagaugcuuuaguccucaucagaaaaccuuaggcugaaaaaugcaucaucagcucuucaauuauucauaauaaugugauuaagguaagagagaaucaacuggggguagaagaaauuaaguagagauaauacaaaaggcguuucaauuuggccuaggagucuguuucuuguuacaucaaacagagcuaccaaauaaguaauuucaaacaaccaaaagguauauguaacucuguaggggcagagaugaucguauuuccaugcuaugggccuuacucagcucuuaacaccugcuggaaaugaacagcccuucuuuuugaguaauaccaggcagcagccuaugccaagaugcccgucaaacuuucucuggagacuggguuuccaaaggguucccugcuaagauacaggcugcaagcaaaacuacagcacugaauuuuuuuuaagcagaaggauguugucaguuuuuaaaaauaacagaaacaaaaauucaccaacucagcaaguaauuuaaaagaacauguagacauugucaaauugaaaucaggauaaacugcaauguagguaacaacucuccagauaauauaaaugacaaacaucacagaauugguuucagcuuacugcuuaguucccugaagcaacaguagcauaauuaauaaaaaaaaauuagcucagucuuaagaucuuaaggaauuucacauauauauuauuuuacauaaccuauaauaaaugucacuuaucaguauuuuucucuuacagaagacaaaguagaaggaagauggaaaaaccacauagcaagaagccagaucuccucuaucaagaugagguaagcaaugaguuuaaccuagcuaggucuucugaccugcauuccuucaugaaagcuuucucauuuucuagugugcaacugcuuuauaacuuuccccaaaaaaaauccuuuucuauaaauaaauacgaaacauguuuuauucuuuuguuuaaggcaaaaauccuccuccuggaaaauuuuuauauggauaaaauggcaaaaaaacuucaugcacaaggcuauguaccagaaagaacauggcuuugaagucagaccagagagugaaucccaagcucuacaugcaauuuacacaaauucaccuuagucuuaguaacuucaauggcaaaauuggacuaauacuuaucucacagguucaacagaauuaaauauaaaaggucuaacacacugcccagcauggagcaacuacuauuuugguuccaaaacucaaaacucauuuuuuucaugaagcaucaaaaaacaucaauuccaaaacuuucaagaaagacuauuaccuacaagauuucacuaaccaauuugauacaaauaguauaacuugcugaaagacaguacagcugaauguaaccauucaggggcuuuggaaacaggacuggugugagcaaucaaugggagaaugucuccauaggacugacugguacagugccuagacagucaacacucacuauuaauaacauaacacuaacagcuuauuuauguuucagauaaguaauucugcaaaugcucaaggacuaaauacaccagccuagauaucuaaauauuucuaugaauauuaagaagcuaguauuaaagucaccauucaauaagucuuauuuugguaacaaugcuuaggagaaaaaaaaacaacuuccucacaaaaaacaucuauuuuguacauuaaaagaacaguacguucaaaaacaggcaauaccagagaucaaugucaauauuucaagucaaauauaaucaguuuucaacuuauuaauaauucucucuggaauaaaaaugcggacauacuggagagcaguuuaagauuagaguugcuauuuauaaauuuugaauuauuuucuaaaaauacaaaaguagaagaucacuuaaaaugcagcccauguagaaauccuuuaugaagggaggccaggaggagucaagcaaugucucuggaagaaacuacagcuugaggaacccucucucucuaaaggcuacauucguggaaauguucagggcuuagucaaacagugaucuccaaauaguaucucuauuauuucaggcuuaaauaauccuguuaaagaucacaaagccuaugcaacagaaaaugcaaaaguuaugcuaagaacuaaugcauuacugagguuaagucuggggucuuuauuuauaacaaaauuugaacagauuuuuuuuucuauuuuaauaauuagaaacguaauuaauuuuuggacacaggagucauuacaguaaucaaaaaugguaauugcuuaaaauaauuuuucuucaaauggaaaacaaaacccagauagaguuaagaaacaccucuccagccuacuuacuuagaauagcuagaccugcuucuuuggcuucaacauaauggauccuuauagaucagguuccgccuucaacucuuaauuuuaaauuuuuuuccaauauccucaugcaacauuccuuauacaaaacaagaacuaaaagcauagguauaaggcauguaagaaacuuuaaccacuuccuucugaaucuugcuaaucaugugcaauaugccuuuugagaguaccuuuuguuuuaaggaaauuaaaaaaaaaaaauaggcagcagcgaugaagaccauuaacacaaccacaaguuagcccuuacccuuaaaggauuaagaucaagacagaaccuaugggaaacagcucauuugcauaaaauuguagaaaguaagagagaaaucaaguuaaaugagggauaugcucaaguauuuaggggugaaauacacagauguccacaacuuaauuugaaauucaucagaaaaaaauggauuaacggauuaggguacagacagauaggugaucaagauucacucuuccauauguuugaaauuugucauaauagaauauuuuuaaagggacgaggaaauaugaaagggaucaacauuuuuaauccucuuaaaagugacugacaaaaauaaaaaucucuauuaaaaaaaaaaagucuacauccuuugaggccagugauaaagacuccaaccuuuaaauaauaaaaaagggagauaaaauuuaaaucagguugaaacaauaagacuuugcuaauuuuacuuuaaaguaagaaguuaaaauagacagcaaauacuaacauugaacuuuuuuuuuuuuuuuuuuuuuuggagauggagucucacucuuucacccagccuggagugccguggcgugaucucggcucacugcaaccuccaccucccagguucaagcgauucuccugccucagccuccugaguagcugagauuauaggcacgcgccaccgcacccggcuaauuuuuguauuuuuaguagagacgggguuucaccauguuggucaggcuggucucgaacccugaccuugugaucuacccgcuucggccucccagagugcugggauuacaggugugagccaccaugccuggcccaguuuuuuuuuuuuuuuuuuuuuuuuuuuaagaaaaaaaaucuucuaucacucucuuuuccucuaccuaacauccuaaacagacaagcagaaaauacugugagaugccuaacggggaaagaggaaaaaaauuucuauauaaguguuaacaucugaguuaaccugggacagaguuaaauuuuuauuuuuuaauuuaagaaacgauaaaaacggaagauucuggaauauauacaauauauaaccuucuuuagaaauaauuuuuaguccaucauacccacccuacaacuucccauuaagcauccaaaaaagacuuguuucaauugaauccaccauuuacugagcagcuccucuacaacaagccuauggcauaugcugcagggaucaucacucacacauagcaugccuuucugauuguuuguugauuguuuugcaaugcaucuuugucaaagauccacuagcuugaaggaugccuggcuuuucaccucuaaaaucaagaaaauagaggaauauuaaguuugggcauggauucuauauagauaaagagauguccuccaguuacuaaagcaagaaauaaugauuuuuuucaaaguauccuuuuaaacaaucuaaacaaauugauaaaaguuacauuuuauuuaaaaauucuugaaaaagggaucuauacuguuaugcuuuaugcaauuuggugggaaaaggaacacuccucauggaaaauuuaaauguacuugaauuaaaucaauagcauuacacuuuuuuucuaaauggucauggcaaaauauucaguaauuucaauugauauaaguaacugaaauguaccacaaaauucaggcagaauggugguauauuccuuuuuuauaacucuauuauaccaaggaauuuaugucaucagaagaugcugaugaaauaaucuauguucuuuauauuuuaugaguccaucagaaaacuuuacuauuagacauagauaccaagauuaacccgcauauaaaaacauaauuuuucaagucaaugaaacaaaauuaucuaaagagagaugcagcuaacauucuacuagauuucuucaauuuaacuuuucaacaaugagaaaacagugcaauggauauauauauauaguaagccuggacagaaaaaucuguucuacuguucucucuacaacaaccauacacauguguuugaagacuugucaguuaucacaggugccuguuucuucacucauuacuaaucuuuugcucuaagaaaaugagaugugaauucaaagcaaaaaaccuuuaaaauuauguaaaaacacauucaucuacguuugaaagaaauauccuaaagugccuaguuaauuuuuacugaugaguuuauauguaauuuuuguucuuuuuauuuuccaaauuuucuauaacuaauauaaauuccuauuacaaaucaaaggaaaggaccuuuuagaaaaggugugaugaguuuauagcugacuuaagcuuugaaaguuugugcaaauuucuacuuaaaucuuaccguaauucauagguuuugcuacuuuacacuuucuauauuuucuuucuaaagcauauuuuagaaaaaaguaauuuuguggguuuucuuaauuacaguagcaauuaaaaaacccuuuuaggucacugaucccuaugagaaacuagaaaaacucuaggcucuucccugagaaaagaacucauauuuuacauauaguuucagcagaggcccaaucauagauaccuccggguuaaaguuucucaagagguuuuacaacagugaaaaauggcaauccugguuuugaaccuaccaaauauuuaaaaaccucaaaauuaucaacugacuuaaaaauaaaagaaaaaugugaaaacccucaccaauuugaucaugaguucaauaugaauuaguaaaaaguaaauuauaggcaugccuccauuuuucacagccuacauuucucucaggucuuacacugauacccaccccaaucugucuuugguauaguggaaucuggacuuauauuucucaaaauaagaacaagcacucaggauuaucaccaagugaugcacuucucagacaagcacugugguuguugcaauauucacaucuucauccucaaacaggacucugugcuuaagaguuuuauuggauguuacucuucauaaaaaaaaauggaaaaugaaaaaaaaguacaaagaaguacaguuuucaaaccuaauacaguugagacaaagauaaaaaaucaugaggugugcccaaagcaguaagcccuaagcccuuugccucagucagauacuggacuugagcuggucaugggaaacugaaccaaaccauauugacacuggaaacacgucgucaucaaggacuauucuaggugaugaaaugugauuagggauuuuuuuuaauaauaguuuaaaacucuucaggggaaaaaaacucuccuauaacauguaaguuuuccuuucauuuucagaagugcguuaaacuagcugguugcuuccaaaaacaugauauaaaagcuugaggacuccuacaaguaauaaauucuaauuacaaguuaaaaaucauuuaacucuuuaaaaagagaaggaaaagaaaaaugcauuuacaguuugaccuuagucacauaaauacacauacagaauuaagaagcuagagggaauaaaagggaauguuuuaaaaacagggagagaauuagcuucucuuuacaauuaugaguaaauuuaucuuuauuccuuucuuauuucaacuuuuccauaacuaagcaugcauucauuuuauauucagaauaaacauuuaaaaaccuaacucagauuuaaaaaaaauucuuuaaacauucaacuugaaucuuuuuuuuugccucuuaauuugcuuugaaacauuacacacgaguuccaaacucacuuaaucacuagcgcauguacuaacucacaccauuuuuuaaaacugugcagaaacuuaaugacaagauuugacauauaugauucuucccccuuaucccuaagacuuucauaaacaacuacagaaacuccaacaacaaaaacaugcaaaauuuccagaaaguuuggcaguugcucucugcucaagaggagggaaaaaaaaaaaaaaaaagaaaaaauaacauaaagaaaaagcccaaacagaaggcccucuacaaaacagugacugaaaacuuuguagucaguaaaauacagacucugaaaaacacaguuuacaaaucuaccuaacacuguagaaaaaagucauuggcuuuuacaaguuuuaaagguaugcagaucaauauuucacauauuauacauaauaaaauaaauuuuauauagcaugugaaggcaacucaagaaaacaguuucagguauucauaugaaauauacuguaaaccauggcauuguuacaaugauauaguucagugcuucugugcacaaggaaugccucaaaaacaugagacauauagacagauauacaaugugugcauaaagcagguaucuccaucccgacugauaggaaagaguagcuccaacaggaaaaaaaaaaaagagagagagaaaaucaaaucuucaccugagauuuuuagcuauacagguaugcuuucuugguuauuuccuacuauauacuuuaacuauaaauucuaauggaagcuaguuacucuuuuccucugaacaauuauuuuuguccaguuuccuuugaaaaauaaaaaaauguugaguauuugcuuuagacucucucaaaacucacaugccaaaguguuuuagaacuuuuaugucuaaauuuaaaguauucuuuccaaaauuaaacaccugaacaaaguaucuucuucuauauuuaagucuguuucauguaauuucaaagauaccuuuaccaaaaauccuuuuaaaauaaaggaagcaaggcaauaaauuuuuuacaacucacaugcauacgauuuacgauuguaaguaaugccuaacauaaagaugaacugccaggcaucacauguacuauuucauuucauucucaccagucaacauaaaggacggagacuuccuuuuuguguguguaggaccuauucaauaaagucauugcagugcauuaaaaaugaccauuaauucuuuuucacgccuccucucaacagguggguguuaucuucccaccuugugaaucugcgcuggcccuuccuuugaccaacauaacguggccuugcagcuuccauucuugcugcugagaugcccauagaaaguaagcuggacaaaagagcacauggaggcagaggcucaaccaacagcacuaaccaccagacuugagggugaggucauucuggacaacaaagcugacccagccaccaacuggcugcaaccaaagcagugagcccacacaagacuagcagaagaaccacacaggugagcccagcuuaauaugcacacccacugaaucaugugcaaguaaauggugguuguuucaagccacuaaguuuugcaguaauuuuacuaaggagcaguaaaauaacagauauaucaucuuagcaaggauauauuuugaguucagagcuauacucucagucauguagcaauuauuuauuuaaaaaaaaauaguuccaggucucauuuaguaauccuaaaaguuaaaugucugacauacagcaaaauguauggaaugagguaaagaggaacuguuaguuaaugauacaggguagguauaguauuaaaugaacagguacaaucugauuucauuuuuguccaaaaggaugggagccguauauaaacauguagaugaauacacacacacaacacacacacauacauacacaaacacuuacauuaugcaaaccauuucugaaaagauuuaugagaaauugguaaaaaacugcuguuuccagaaaacagaacugaggggccgggugcgguggcucacaccuguaauccuagcacuuuaggaggcggaggagggugcauugccugagcucaggaguucgagaccagccugggcaacacggugaaaccccgucuuuacuaaaauacuaaaaaaauuagcugggcauggcggcacgcgccuguaaucucagcuacuucggaggcugagucaggagaauagcuugaacccgcgaggcagaaguugcagugagccgaaaccaugccauugcacucuagccuggaugacagagugagacuccaucucaaaaaaaaaaaaaaaaaaaaaguaaacagaacugagaauuaggggacaaaguuaggaggaaccuauacaucauuuacauccuuucauaccuccuaaauuuugaaacauguaaauguauugucucauuaaauauuuuuuauuuaaaucuuaaaaaguuaauauauagucuuucuugucucuuaaagauauauacugaaauauuuccagauggaaugauacggcuuagauucauuucaaaacuggagaugggauaggcaaaauaguuuuuauuaaaaagucaaaaaagaacagauguuggcaggacugcaaagaaaaggaaugcuuuuacacuguuagugggaauguccagccacuguggacagcaguuuggagauuucugaaagaacuaaacugaacaaccauucaacccagcaauccauuacugaauacagaccacccaaaaaaaaaaagcauucugccaaaaagauacaugcaccuguauguucacuaccacaaugaucacaauagcaaagccauggaaucaauccaagugcccaucaacagugaacuggauaacaaaaaugugauacauauauacuauggacuacuacacacccauaaaaaagaagaaauauuugcaguaacauggaugcagcaggaggccacuauccuaagcgaacuaaugcagaaacagaaaaccaaauacuguauauucucacuuauaagugggagcuaaccacuggggacacauggacauaaagaugggaacaaauaaacacuggggaauacaagagcggugagaaagggcaggggcaagggcugaauaacugccuacuggguacuaugcuaucugggugauggguucaauuguaccucaaaucucagcaucaugcaaugcaccuuugcaacaaaccucuacauguaccucccaaaucuaaaauaaaaguuaaaaaaaaauuggagguaggaguagauggcaagauaagauguugaaaugaacaguuuagagaaaaucaugaguugaugauuaucaaagccgacugaugaguacaugaggauucacuauacuacucuaucaccuuucauuugaaauucuucauaccaaaaagugauuuaaaaauauuaauguaaagcuguaacaguaauucacagaaacccaacucucucuccaucaugacaaaaaaacagaaugaacacuaaauauucacgaauauuuacaaagcacuggcuuuuuuuuuuauuugucugacaauuaaaauuuucaaaagagguauauggguuccuauuaauacuuauugagugccgggcaggguguucuacagacaugaucucauuugaucuucacuacaacccugugaguuaaguaguaucaucaucacuuuacaagaaaaaacugagacucugagcauaauuguucaaggucaaaacgcuaguaaaugacaggauucaaauauaggucugugacuccaaaugccaugcucuuuaaggaagaauuaaaaagaaaauuacaaauaauccacaaacaaaauaaucagccacuaguggaccaaacagugggaaguauccucauacuuuaaggagguaacaguguguggauuucauaauaccuuauuuccugaguuaguuaaaaaggauuauaaagaaaaaaaguuugauucaaaaacauuuuuuaaauccucacuaaacugaaaaccauuauuauuagcucuaaaauaauguacaaauucucauccaauaggcuugaaucuuuccuuuuuaucuguuauuaacuaaacaaauauuauaaauuucuucguucaccaaaguucuaggauuuaaauuaauuuucucaaagauuuuuuuggguagauccuguggucccagaccauuuucacuccuauuuuucuauaaauauuuuuacucccuguccuacauuuuuuuuuaaacaaaaaccaauuuagauuauuucugagccuagaauacauauacuuguuccuuaaagaaucccuuaaaaauuauacaaacaagcauaaacaucaccagcauaagaaugcauuuuucaaaccauauauuuuguucuucuuuacuauacuggugcguacucauaaagaauaggggcuuaacagaaauuauauuuuagacuaggcuaauaccaaggguuaaguaggaauuaaagcaacaugcuuuuaaaaguagugugugagacacccuaagaacggcuccagccucugaacuccuguaguugcuucauaucuccgcaaauagcacaaaauuaucgugauuucccuguuauaugucuggcuaugaauucuucuauggcagggucuuucaauuccaaacagcagcacaauacuggcauaugguagaaacucaacuauuguuugaggaauuaagagaaugcaaaaauaucacaagaauuccacgacucucccaaacagcaauuuccuugcuuucagggaaauggugacacuuugguuucaauuuuuugauauaaugaauugauuaauuuacuggccauucagauuugagcaauauaccauguauagaucuucauuaaaagcaaagagaaaagucuguuuccugaaccaaaccagaaaugauucagaggaaaaugcaaauuuuaacuggaaaaaaauaauuuuuuaaauguauaaaguacuauauuacuucaagauauguguaggcaaauaugcuaagcuucuacaguuuagaggguuuuacaaaacugaaaagugaaauugagggucacaugaaccugccaugaaguaaaugucacauuucugucacugcucacuagacuugugcacuacuagaguauuuguaaacuaaaauguuauauagaaaauaaccacauauuuggucauuuacucaaacauuuaucaagugccuauuuugugccaaacauagcaguaggggcugugaauaaaaggaugaaaacgugcccuuauccuuaaagaacucuaauaagaaucuuauaaaacaaaccagaagcaaguuaccauucacccauuuauguaaacuagcaucuauuuccagugaauaccuuucuaauuuccugaacuucuuaccaaaaccaauagacagaaguccacguuaauaaacuuccucuggaaauuauuuguaaaaugggccacucugacuaaaugugcaggggaaaaaauucuuuggccaacgacuuguauuucaaguuuuaaccugaacugaauguauaaugaaaggcgaaugguccauuauggaaaugcuaacacacuuacaccaccaguggaagcaacuacaacgaugcauuuauugaaaauuaaugaaguccugaauuuuuacuuauaaaguggauauuauuaguuuuagauuauuuucugcaagccaauagucaaaauuuaauaagaugauguguacagauugcaccaauuuucacucuuauccacugccugcagccuaugugcauuuaaaccaaaaaacauuugauauacacuaacuauaaauuauuuccuuggagaucucucaggcaugaagaaaaagccucuuaaaauaaauuuaaaauauuauaugcuugaugguguauaaccgaagguuuaaucucaccacuaaaggggcaguuaccaugauuuuugcaauaacccugcagacaauaaucaagacagcuccuguuguucucucaguaaaaccuucguaagcacagcauggauauauuguaauuugauaucuguaagaucaacagcuauacuucaugacaacucauaauauaagauuuuauucaccauuaaaucgagcauuuuccucagaagccaaaggaaaguguguuauuuaccaaacaugguccuauuaacuauagauuagcacauuaaaauagauaugcucucucuuaaaaaaaaaaaaaguacagucaauaaaacaagcucugaaaaguagaaaauuagauuuuuuuuucaaacuuugggaaaacauuucugugcccuauuuccaucauuauuuuaaaguaacugauucccauuauuuuucuacuaaaauguaagaaauauccccaaaauagagcuaagucacauucaaaaaugucucagucuccaauucauaaugauauuaauauuauucuuagaaaagaaaaggcacuuagaauaaauacaagugguaacacaacgucaggaaaucagaaauguguaauucagaaaagggucaaagacaauauaaauuaguauuaaaggcauucaaaauggagacuacuagaagaauucaauuacuagucauacauacacacacacgcaaacaguaaacacauuauuugaacacaaguagguuaccccaucaguauuucagaaguguaauaaaaccaucuuucacucaccaaugcuggauucucucuuggcaguuagugaccaccugucaugaaaacagauaacuacucaugaaaaaacagagcuaugcacagagcuacaaaaaucaguguaucugaaaacuagaacauuggcuuuacagauuuaauagcaucucaguauacauuuuuauuugucaaaugcacagagaugugaacguuaguuuuuaagcagcacacuuuaucauaacccucuaaugcaggcugauaacugcagaacaaauuacagcuuucugauucauacuuugguacaaaacccgcuucauaacuauuaggugacauaugauauaagauaacuaguauuuuguacaaucuacagaccuguuuucaauauuacauauuuuguagaauacauaaauguuauaaauaacaagaaaccaauguaacauccacguuucgucaguuaaaaaaaaugacuguagugacaauauuuuauuuugucaguauaucuccaaacauuuucaccuguaauuuuuauucugacgcauuaaaaaaugaauucagugauauuuuucuacuacauuuucaagaagaaauacuugggauaaggagaugcucugaacagcucauuuguuccccagugaauuaugaucaagacuguaagcacuucacagccaguuuaaacuauguuuauaauacuaaaacaaugaauuuaaguacaaaaguuauuuguuuuccuuggagauaugucaguagauucucaaaaugcucagaaaauaagaagacuagacaauaaagaaaaaugcaauuuaaaaaaauaacacuauuuuugaaugacaauuuaagaauuaacacuguuuucaaggauugcuaauuaucuacuuuuaaauuaccuauuaauaaaaauuuuaaacagcagucuagaauaccauauaccauuuuagagacagagaaacuaggggaugaaagccaaaaugcuuaagacuaggccaugagaaaaagagagcagcauuaucugguuugcaaaacgcugcucuaguucacugcucuaaauaccaauauugucucuuguauaugcucaauguuucaccaucccgucccagcaaaaaaaaaaaaaaaaaaaaaaaaaaaauacacacgauuuuuuuuagaccugucacuaaauuccucuauuguaacauuuaauuccugaaauaaauguccucuuuugggacauuuuaaauacuaagacagaaauucuguaccaaaauacaugcuauaaucagaaacccaaccauacuacacauuaacucagcauaaaaaguccauuuuagaaugaagaucucucaguaaguaucaaucacauagcaacacuuaauaacaguggcaauauauaauagaguacugacuuuacaucuggaagagccaagcuaaaacuacaucaauccauuucacuguuucugauuuggcaguaauuacaaaauagacaaauagaauuaaauguaaauugaaaaaggaaaaaaaugcucaugaaauccuuuucauaaaguuccuauuuaacaaccccauuaaaagaugagacccaagaacagucaggauguuuuccaaucccaaugcauguguuuccaagcaugaagagagccaaaagcacagaaagcaaagcccugcaaaccauaagagcagaauguucauuaaccucuacaugauaauccuuucguagcugcauauuaacuaguuacacauucauaaucauuuacauuauuuaaaggaccuucgaggaaaucuucuaagcuauauccauuagugacgguguuaaagguuauagaagauagucuaccuaauguuuccaggaagccuuuuuaauuaguaaauaugcaaauuuggcacauaugcuuuuuauguuuaagaaacaagucacugguagaauggcauguguucuugccaucacuccccauagucuacccuccacuucguuccggccauucuugcccuguuccuuuuacuucccuuaaacagucucccuaggaagauagacgaacaacaaaauccauuucacaauguacaagagaaauuuucacuaccaaaaugcugccuuacauuuuaaagucuuuauuaguuacauauaguguguagaauaucagagacuucaaauaagcacuauccaaauguaaacuaaagaagugacauuugggaaaucagaaauaaggggaaagaugaaagagguagauauaaaaauauauagacuagccuucugauggcaugucuagguuaucuuuguuuauaugauuuaugguccaccuacuugcagaaaagauuuaagcccaagcaguucuauuauauuuagaggguuuuuuuuuuaguugucuucuauuucacagcaaguuauucaaaagaaaaaauuaguaaauuuuggucagacgcgguggcucacgccuguaaucccagcacuuugggaggcugagguggguggaucacgaggucaggagaucgagaccauccuggcuaacacagugaaaccccaucucuacuaaaaauacaaaaaaauggccgggcaugguggcaggugccuguaguccuggcuacucgggaggcugagguaggagaauggcaugaaccugggaggcagagcuugcagugagccgagaucgcgccacugcacuccagccuggacaacagaaggagacuccaucucaaaaaaaaaaaaaaaaaaaaaaaagaaaaaauuaguaaauuucuacaacuuagaaauuuuagaagguguuauaaaaacaaauauuuuucccuuaaguuaaauuauucuaaauaaucuuauuucuccugaaaggggacucagauuaauuacuuuaaguauuaaauuuuaaaaguaaccauaaggcagcgagccuuguucuacaagcaacacuugaaaaacacagcaaaagaaacaaaaacauuucauuacuuuguuguccuccacaaaaguaagaccacaauggaagaacaaaacuaguuuuuguuuauuuuuuaaaccugccaaaacaugcaaauagugccccuaaagaaaaaaaacuuauuguauuauuuucauuuuucuuaaaaauaguuacuaggcuucaacuuuaaaauaccugaacuaguaaauucuuuaacauaaugaccucguuuacacucaagaauuuauaauaaaguauguaccuacauagaaguacagcaguaaguccacaguaaagaaaaagaacuaugagcugauuuaccacuauuuaggagucuuuaccaacaacccaguggcuacaaagucauaugguauccauucuuugcaacacaaaacugucuuuaaccuaugagcaauaacaacaggaguauaugccaacacugcaugugacaaaacgaacugcaaagaguucaauggaggcgguuuaaaucuuuauuuggagaggaaaccuguauucagagaugaaguaacuuacuuaauauuacacaacuguccaggaacugguaagagaugagaccaguuuuaaaaccaagucuuucuaucagggauucuaucuaauccuaaagugcacagucccuauacuggccugcuuccaaccaucaugcggcuuacuggauaacagcagaaaaacacugguuacagcugcagucuuaaaacacugacugcuauugcuguuucuccuccacuaguuaguuccucagucccacacucacaaauaagaccuugccaaucaugucaguaaaagcaaauucuguaagcuuaaguucaccaauucacuaacauuauaauccuuauuucuuccaaugccuccuacagcuccugacccuuucagaugaaacaaguauaaacacauuucccaagcaucauuuacuaguauaucuguguauguuuaggugaagguagaaggguaaugugcuagcccuacaauuacuaucacaccucaucauauuuuuaagacacuuauaaauuaauaggguuagacaccuagaaggacaaugauggacagcccauccaaaaauauuuuucuguucauuaguguccaccuaacauacacauacauuuuguuaccaaggguuaaaauaacauuugguaacuuuuaagcuccacacauuauauggaagacaggaauaauaauuucuuagcuguuguuccucagaagcugcuuuuuaaaaauuauuuuauaaaggagagcaguaacaugcaguaagaucuccaguacuuaaaauuuucauuugugcuauuuauauuggugacagaccacaagagggcauaaaccuaugaguuucuaaggcaaguuaaauacaaugccacacuaaaacuagacuggaacagaaagccuaaaaggucaagaguacuucuucaucuuugauacuuuucucaaaaaugcuucacuucuaaaacuugucucaccauacugcaauuuuaaauucuuccuguauggguuaaugcauaauauaacaguuugggaacugugcuaaucagagcugucuaaauuuauauaguuugcuucuccugcuagacuguggcuucaagacagaucuuacuauuuugguuuuaaagcugcugagucaaaaagaaaauaguaucagugggagcugaagccaauggauacuggacauacauguuaugugacaguuacuuaaaagcugaaaauaauuucuuaaaagauagauuugucaaguagauguauaaauaucauuaccaaaguauacaaauaguguacuuucaacaaaauuuacaaaaauuacaaaucuuuuaaguaaaccccuuugcaaauaagggaggaauugacuacagguuccuaacagaaaaaaaugcaauaagcacugggauaaacuguaauaaacugaguguugcuguauaaaaaccaccauagccugagcagaguggcucacgccuguaaucuuagcacuuugaggcccaggccaguagaucacaugaugccaggaguucagaccagccuagccaacauggugaaaccccgucucuaccaaaaauacaaaaauuagccaggugugguggugcaugccuguaauuccagcuacucagguagcuugaauugcuugaaccaaggagguggagguugcagugagccgagaucacaccacugcacuccagccugggagacagacagagacccuguccccaaaaauaaauaaauaaauaaauaaaucaaccaccauaaaaguaaagaaaaccauuucaauuuuaaacaaauuauguuccaaauaugcugcaaagcaaaacugcuaaugaaagcuaaguccaauuauauggagccacuucugaaaacacuuacauguucuuauuuaaaauguuagcuaagauggaaucaaaagucuccuuaaucuuuaccuuuauguuuuagccagauuccuccuacacaggcuucuaagcauuuuuuccuguaugccaaucuagucucguuuuacacaaauaucggacuaugucuaacgugcucuggcacuauacaucucccucccuuguuggcuuuaccuacaaacugggcucuuuuuuucuuucaguaaucauuacucacuaucuuaaguauucuauuacaguuuucuccuauuggaaauauuuuaagaguggugacacauacauucaguaauacuucuaagaaugaagacguuuacauguuuggaggguuuugggggugacuugaacuagagauccaggaacucuaacuguucuggcugaaagcuccaugagguagggccauguaguaaacauaacauuugcaaugaaacauaugaauauucaaaauguaauaaaugccucacccauauaaguuccaguuuugucaacaaugaauaugccauaaacuuaagaauaacuguguuuucagugcuuuucaggcuuccgaacugcagauaagaaauugugaccuacauuucugaaucugaaauacugccugaauuccaccuugcaugcccacuguuuuaucagagauuaucaaucauuucuucuccauucacaugccuuccucguagaaacccugcccuucucccauaaagaauggguaaagaaucccauuucuccgucuguagccacaauaaagggagaggauagauaccugcugcuaacuggaccaaccucauuuacuuuggacaucagagccugaggugauuacagauucugguccuaaaagaaagaccacuauaggaucugcacaagcuaaccaaccaucuaaagcagcugguacaggaaacaacauaaauguacaagaaaacaaaacacagagacccaaaaaacuccuacccuugacucccuccugacuucuuacaguaaauuauuucauaauuuccuaagcaucuguaugauuugcaacuaagaaaacuuuagaguagcaaacuugccacacagguuaggaggagaaugugccugugaaaggcucaaaggaaacaaacaguccacugaagaguaaauacaaguagaagaaaaaaaaaaaaaaacaggaaaauauacucccagguaacaaaaaagucaaauuaaagcaaucuuauuuagcauuaauuaaagaaguacauuuuuauuuuaaacaccacuggccgggugugguggcucacaccuguaaucccagcacuuugggaggccgagacagguggaucaccuaagaucaggaguuugagaucagccuggccaagauggugaagcccuaucucuacgaaaaauacaaaaaauuggccaggcguuguggcaggcgccuguaaucccagcuacucaggaggcugaggcaggaaaaucaaacccggaaagcagagguugcagugagccaaggucacgccauugcacuccagccugggcaacgagagcaaaacuccgucucaaaaaaaaaaaaaaaaacaaaacaaaaaacaaaaacaaaagaaaccaccacugucagugagacuguaguaaaaaucucaaaucacacuaaaucacugcaaguagcuauguaaauucaaaacucagucuagacuugcguaauaccuccaaguaggacaaaaaaagcuuguaacucucagaaaguagaagagacagacagauaaauacaaaaauuaucucuuuaaaggcacccaagagcugccaaagcagugaggacaagagggaccaaggauucagagaggggagaacuguggagaagugagcugaucaucugaagccacuuuuuucucagacaacaggaggcacaggcaagaggcugagaauuauguugggcccugaggagacagccauggcuagcagaaagaaacaagcagaacuugcgcagucugacaaggcuauaugguaguaaaaugagagcacaagagaggucuuaagcauacaacugcuuucccucccaugguaucugucaaauucugagcugcgaaggccaaaaagauaaacuaaaacucugaaaagcagagcucaggaucaaacaaaaauuaguucagaagccuccaaggaaauaugguguagugagcaaaaucaagcuuccagaugaaagccugaagaaaccagaagcagcagauggcuuacuaaaacaacaaccuggccuucacuccacccagcaccugcccggaguaaggugaccagcucccacugcaucugcuucaguagaagaaaggacgcgccuuuuccagaggaaguuaucaccuucaggaauaucuacaaucuuuaaagacacaaucccaggauuuagucaaaaauaacuaggaugccaagaaacaggaucauaugaccaaaagucaaaagaaaaaauauauaaaacagaaccaaacacacaugcaaucuagauacugguguuaacaaacauaaugauuaauauguucaaggaaauagaggaaaagauaaaaggaauauauuuuaaaaauagcaauuuucacuagagaacugaaaucuacaggaagaaaccaaugaaaauuguacaacugaagaaccaaaaauuaaaauaaauggcauuaaaagaagauuaaacagcagaaaucaggauuuuugaacuugacaggucaaaagaaaacaccaaauuaaagcccagagauucaaaaauaaaacauggaaaauacagaaaagaccaauaagagacaugugaaacacaguguaagugcaagauccagaaagggaagagagaaugcagcagaagcaauauugaaaagaucuugaauucuggauuuucuaaaacugauaucaaaguaucagccgauagacugaagaaacuccaagaaucccaagcaagagaagcacaaagaaaauuucaaggcacaacauaguuaacagugaugaaaaccaaagaaaaagggaaaacuuuaugugcagcuggggguaggcggaggaggcacaggggagauucacagccuucaaaggagugacaagacuuagagcuagagcuaacuucaacaucaaugacagaaagugaaagauaacagaguaucuugaaaugcuggaaaaaauaacugaaaaucuauagugacauacacagcaaauagauccuccaacaugaaggaaaaaauaacauuuucaacagaaacagaauucugcaccagcagacuuucauuaaaagaaauacgguuuauuaaacuagacauguuguuaauaaaaugucuuaucaaaaaaauuauuaaacuagauauuguuauuaaauaagugugaucgguuaaaaaaaagacagcaacaacaacaaaaaggacucuucagaguaauauaaaugcagaaagaauugaagaguaaagguacaggauaaaaaaaaaaaaagauggguaaagauaaaucaauauugaccacacagaacaauuaaauacaguguugugguguuuaaaauacguagaauuaaaaugcaugggagcaaucaugcaagaggugggcuggauaaaugaaugaaugcuaugaucucuagagacaccagagacuuacuuagugaaaaggaauuguaaaaaaaaaaaaaaaaaaagauacuauaaauacauauuauauuuaguacuaaaccauaaguacaguauaaaaguaguaaaaaauaauguaucacaaacaaguuaauaggaggaaauaacaauacaaaauguuugauccaaaggaaggaaaaaaaaaaagcagagaaaaaagaacauaaaaguacaucaauuagaacuauaauggggaaccauuugacacuccaguaaugaggaugguccuuacagaaaacaaaaacagccaaugcaaaugccaaaaguugcccaguauguggacuggaacccuugugaauuuguccgggaauguaaaaugguacagucaccggagaaagcaguguggcaguuccuuaaaaauuaaacacagaauuaccauaugauccagaaauuccaccucugagcauacccagaagaaucgaaagcagccgggcgcaguggcacacgccuguaaucccagcacuuugggaggccgagguggguggaucacccgaggucaggaguucgagaccagccugaccaacauggugaaaccccaacucuacuaaacacaaaaaauuagccaggggugguggugcaugccuguaaucucagcuacuugggaggcugaggcaggagaaucacuugaacccaggagauagagguugcagugagccgagauugugccauugcacuccagccugggcaacaagagugaaacuccaucucaaaacaaacaacaaaaaaaaaaaaaaacaaaaaaaaaagaaucaaaagcagauacuuaaaccaaacacccauguucacagcagcauuacucaaaaucaccauaagguagaggcaacccaaguauccauggaugcuaaaauaaacaaaaacguauaauacacugcauaauacauucuauaauacaauggaauauuauucagccuuaaaaaggaagaaauucugauaugugccacaacguggacgaaccuugagacauuaugguaagugaaauaacccaaucacaaaaggacaaauacucuaugauuccacuuaaagguacuuagaguaaucaaauucauagagacaaaaaguauaauagaaugcuggcagccagaucaggaaggggaagaauagagaguuauuguuuaaugaacagaguuucaguuuugcaagauuuaaaaaaaaaaaaaaaaaaaggccuggagauggaugguaauuacgguugaucaacaacgugaauauacccaaugccacugaacuguauacuuaaaaaugauuaaaaugggcuggucaugguagcucaugccuauuucccagcacuuugagaggccaaggcaggacgaccgcuugaggccaggaguucgagaccacccugggcaacauagugagucccugucuauacaaaaaaaaaaauuuuuuuuuuuaauuagcuaggcccaauggcaugcaccuguagucccagcuacucaggagacucaggcaggaucacuugagcucaggaguucaagguugcagugagcuaugaccauaccacugcacuccagccugggugacaaagcaagacacagucucuuaaaauaaaauuauuaaaaugguaaauuuuguuauauuuacuacaauuuuuugaauaaaaaauaaauacaauguacgucuaauagaaaggugauaaaauuaaauauaucaggaauccuacuacauauaauggcuuaaaauacucuaaauaaaaggaaaagauaucuagacugaauauuaaaaccacaacaauaugcuguuuauaagacacacuucgaacccaaaagacugaaguuaagaagauuuuuuuuaaagauagacaaaacaaacaaauuuagcuggugugaccauacuaauacuaauauccaacaaaggagacuugaaggcaaguagcauuacuagagauaaaaauaucucagaauggugaaaaggucaacugaccaggaaguuuuuacaauuuuaaauuuguauacaaugaauaacauagcuguaaaauauauaaagcaaagguuaaaaaaagagagaaaaauaaaucuauaauccuagugacuauuuuaauacauaucucaauaaaugauagaauuagcagacaaaaaaauuaacaaggacauaaaauacuggaacaacauauucaagcagccugaacuaacagacacauacugaacccaaaaacugcaggauuaacauuuuuuuccaaguaaauuaugaaaaauuuaccaagaaaaagaaaacauuaggucaaaaggcaagacuuaaauuucaauuaugcagaauguguacucugaccacacuagagaaacagaaaaauaaguagaaaauaauguuugaaaaggaauguauuuccaauuuaugggucaaugagcaaaucacaauagaaauuagaaacuauuuuuaaaugacugauaaggaaaaugacauacaaaaugugugcaguaccuaaggcaaugauuaagagaaaaauuuaaagcucaaaaugcauaucuuauaauaaggaaagguuaauauuaguaaccucaaccaucaucucuaagggcuagaaaaauuacaggcaaaggaaaaucuuaaacaggaaaaaagagagaagaaaucaguaaaguagaaagcagacuuagaaaagaggaaaaaaaucaaaggcaaaaauauaaaauauaaaauugauaaacccuuaagaagagaaaucaagggaggaaaaaacccacaaauuaaaaauuacaguaauuaaaaagaggacaucaccaccaaaucuacugauaauaaaaagauaacaggauauuaugauaacucggagggacaacaagcuugaaaacuuagaaaggacaauuccuugaaaaucacauuuucuaaaaugauauaacuagaaacagaaaaucuggauagucuuugaacuuucaaagaaauugaggucguaucuuaaaaucuccauacaaaauguccaagaaaaauauugggcccagacggcuuuguugaugaacucuuccaaacauuuaaguuagaaacaguacgagccaggcacaguggcugacuagccuguaguccaucauuuugggaagccaaggcagauggauagcuugaucccagaaguucaagaccagccugggcaacauagugagacucugucucuacaaaaaauacagaaaaauuagccaggcaugguggcgcauuccuauagccccagcuacucggggagacugaggcgagaggaucaccugagccugggaguuccaggaugcaaugagccaggauuggccacugcacuccagccuggaugagagcgagauucuguuucaaaaaaacaaaaacaaaacacacacacaaaaaccaauaacaacaguguauaaacuuuuauaggauauacaaaaaugggaguuguuucaugagaccagccuaauucugaagccaaauccuuacgucgacauuacaagaaaagaaaaucauagguuuaagguaguguuaauguuuuuuguuguuuuuuuuuugagacggagucucacuugcccaggcuggagugcaguggcgugaucucaacucacugcaaccuccaccucccggguucaagcaauucucaugccucaaccuuccgaguagcugggauuacaggcccccgccaccacacccagcuuauuuuuguauuuuuuguagagaugggguuucaccauguuggccaggcugaucucaaaccccugaccucacgugauccgcccaccucagcuucccaaagugcugggauuacaggugugagccgcagcacccugguagaguuaaucaaaaaaaaagaaaaaagaaaagaaaagaaagaauuacagaauuuugccucauguaacagaacaaaauaccuuaauaaaauauuaucaaauuuaaucuagcaauauacaacaagguaaacacauccucuacaaauggguuugcugcaggaaugcaauggcauuugaauauuuuuaaagaaucaaaguaauuuaccauauuguuaucucaagaaacauagaaaauacauuugauaaaauucagcauccauuaaugauaaaauuagcaacaggagaaaauguccuuauuuucauaacgaguagcuacaaaaagccaacuacgaacaucuguauggugaaauacuuaaaacugcccuccugguauguaaagcccaauguccuaacuuuuauuuuacauuauauuaaagguucuagcccauacaauagggcaaaaaacaaaacaaaacaaacaaccauaaaaaaaaacuuaagaacuggaaugaauaaaacugucaguauuuacaaacaacaugccuguauguaacuacacagauacuaucagaauguacaggcaaguaauuagaauucaaauaaauuuaggccaggcaugguggcucacacuuguuguggucccagcacuuugggaagcagaggcggguggaucacuugaggccuggaguuggagacuagucuggccaacacagcaaacucaucucuauuuuuuaacaacaacaaaaaauuuuagaacaaagucaauauguaaaaaucaaguauguuaccagcaaaaaaaaaaaaaaaaaugaauagcaaguaaauuacaaaaggcaacaaaaaauaguaucuagaaauaaaucuaacacaugaagauuuauauacuuuuaaaagcuaauacuaaaaaguuauagaaguaaauaaauugauauaccauguucauagauuuuaaaacuuaauauuguaaacaucuuaauucuccucaaaccgaucuuuagauccagugcacuccaagcaaaaccccaguaauguuauuuuuugaguauuggaaaggugauccuaaaauauauacaaaaaagcaaagggucagaauaguaaagacaaucuugaagaacaaagugcuagaggaauuuuacuacuagauaucaagaccuauuauaaagcuaaaauaguaagagugugauacuggugcaauuacaggcaaauaauccaauggaacagaauagagaaacagagcuacacacaaauaaucacauaauuuaugaaacagacaacauacuccauaaggauuacucuggcugcuaaaagaaagcuuaacccccuccagaaucccuagaauuuuuuguuacaauaucuggcauccaguucaaaauuacaagguacaaggcaaucuauaaaaacaaaagcggcuauaaagaaaccaaggggaaggaauaaaagcagaccuucauuugauugacauauugcauuuauaaaauauaauagacuuuaugauuaauacauucaugaaaacagaagaaaaguugcagaugucaacagaaacuuggaauccauuuuaaaauuucaaaacauaaauuguauuucuuuuacgguuuuccugcugauaaauccaaaagaauuauaagcaggaaaaugacaaaaugacaucauccaauuugcauucuuaaaaagacuacucugggccacuuuuuuuugcugcguuuacugugagaaugaagaccauucucagcaaucagacuguugacauuccagaaaaugucaacguuacucugaagggacgcacaguuaucauaaagggccccagaggaacccugcggaaggacuucaaucacaucaacguagaacucagacuccuuggaaagaaaaaaaagaggcuccggguugacaaauggucggguaacagaaaggaacuggcuaccguucggacuauuuguagucauguacagaacaugaucaaggguguuacacugggcuuccauuacaagaugaggucuguguaugcucacuucccccaucaacgucguuauccagaaugggucucuuguugaaauccgaaauuucuugggugaaaaauacauccgcaggguucagaugagaccagguguugccuguucaguaccucaagcccagaaagaugaauuaauccuugaaggaaaugacacugagcuuguuucaaauucagcagcuuugauucagcaacccacaacaguuaaaaacaaggauaucaggaaauuuuuggaugguaucuaugucucugaaaaaggaacuguucagcagguugaugaaucagaucuaagaguuauccagcuacagaaagaagaugccagaugacuccuaagacauacuugugauauuucaaugaugcaauaaaagaccuauugauuuggaccuucuuaaaaaaaaaaaaaaaaaaaagacuacucugggccaggcgccguggcucaugccuguaaaauuuugggaggccgaagacagguggaucaccugaggucaggaguuugagaccagacugaccaacauggcgcucaucucuacuaaaaauacaaaaauuagcugggugugguggcgggcaccuguaaucccagcaacaugggaggcugaggcaggagaaucgcuugaacccaggauguggagguugcaaugagccaagaccacuccauugcacuccagccugggcaacaagagcgaaacuccaucucaaaaaauaaaaaaaaaaaaagacuacucugggaaauagacagaagaggaacaaaguggaacuaccaaggccagccaggaauuacugccucuuuuguaagaaaugauaacugggccaggcacgguggcucacgccuguaaucccagcacuuuggggggccaaggagggcacaucaccugaggucaggaguuugagaccugccuggucaacauggugaaauccugucucaacuaaaaauauaaaaauuagcugggcacgguggugggugccuguuaaucccagcuacuugggaggcugaggcaggagaaucacuugaacccaggaagaaagaaaaaaaaaaagaaaagaaaaaaaugguaacugggaaaauggcaaugaagaucacaggaaacagccaauucaaggaauuccuaguuuucagauauaauauucuucuauuucucuuauguauuuuuauuucacauuauaaauuaaauuaaacauaauaguucauugagagggugguuauaaauauggauaaagcuaaacaaauuuacccuuugacucaguaauccaacucuaggacuuuacccaaaguuacuucacaaaugagaaacaacauaugcauaaagugauuuacugaggcauuaucuauacuaucaagagacuaaaaaacaccaaaugcccaucaauaagauaucagcugaauaucugaugacacagacauaaagcacuaugcaaccacaaaauaugauaaggaggccgggcacgguggcucacgccuguaaucucagcacuuugggaggccgaggcaggcggaucacgaggucaggagaucgagaccauccuggcuaacacagugaaaccccgucucuacuaaaaaauuaaaaaaaaaaaaaaaauuagcuuggcugaggcaggagaauagcaugaacccgggaggcggagccgagaaugcaccgcugcacuccagccugagcaacagagcgagacuccaucuccaaaaaaauaaaaaaaaaaugaugaggaauaucucuaugaaccagaguaauucccagguuuaucauuuaaugagaugaacaaaaggcaaaauaagcugccuuuuguauaagaaagcaguauggaggggagauaaagugaacacauguauuuuugaagaagaaacagaggaaggacaggucaaaagugaauguaaaugguuaucuaggccggcuguggugguucacaccuguaauccuagcacuuugggaggcugaggcgggcagaucaccugaggucaggaguuugaaaccacccuggcgaacauggucaaacuccauuucuacuaaaaauauuuuuuaaauuagccgggcaugguggugggcgccuguaauuccaguuacuugggaggcugaggcaggagaauugcuugaaccugggauguggagguugcagugagccgagauugcgccacugcacuccagccugggcaacaagagugaaacucugucucaaaaaaaaaaaaaaaaaaaaguuuaucuguagggguaaguaagagcaggaaugggaaugaaucagaauuaccucaguagggauaacuuuugauuuaguugugauuuugaaccaugcaaauguuuucauguauucauaaaaugcaauuaagugaaaaagauaaaaaacaaauacuaagauucaauauaaauaaaaauccaagguauaacugcacagaaaaaaaguaauucaagugacuuuugggaucaguacccuaacuguacaccccaaaagcauuaauuacacaaaagccaaugaaacugcaaagacauuuugaacuuuacuucagguuugccauuggcagugguauuaaugcaguaauucugaagcuauuuuguauauauuguaggauagagcaaaugaauaaaugcagauguugagaaccaagguuuucacuaugaaagaaggggaguuucaaauauagacuggggaaaauuuaagaagaaccuugugguaauggauuugaauucaaaguaucaggguauacagucaggguccauugaacccaguuuuauuuuuuuaguuucuuucuugaguaguucuaacuauuugcaaggauuaauauuucaugccuuuuaucuucucuuagaggccuuccaaggaaucaaaagaaaauuuuccuauuaagaaaaaaaaaacucauuuuauucugcaauuaccauaugaauacaguggcuuuguaagucuaagauacacuacaggauccuagugauuauguuuuuccugcaucuugccauuucaucaucaccuuaguaauuauuuuaugaucaacuauuccuaacuacgcucuaaaaaaaaaaaacuaauaagaaaaugagaaaauggaagaauuauggaaucacucagaaggauaaugcaaucaacagcaaaauaucauccuuccauugucuacugcauugccuaggauauugcaucaucuuucaagacaguauaaaugauaacagacaccaucuuuguacucugcuuuucgcuuucaauaaacacaguugagaauucagauuguuuuuacuuucugccuauaauggaaagaggaaaaaagugauggaaagauacuucacaauuauuaaaugaaucagauuaugaauauaaagagcuaguagcacucuugaccaaugaaguccaauaaauuuuuuuuuugaugaagggaaucuucaucagcacagaccaauacaacagucaauagccaaaugugacuaaugagcacuugagauguggccauuguaaccaaaaaacugaauuuuuauuuuacuuaauuuuaauuaauuugaauuuugaauuuaaguauaauagccacaugugguuaauggcuaccacauugguuagcgcagaaagacacucgugauggugaaaugagagcauaaauuaaaucucagauuaugagccuucagaugaaaauauccuagaugaauuuucucaaaaucaacaaucaaugaauauacagaaauuaacucaaaacggaucaaugaccuaaauauaagcgcuaaaaucaugaaaucccuagaaggaaacauagguauaaaucuucaagaccuuggaucuggcaauggauucuuagauaugacaccaaaaaacacaagcaacaaaauguauagucauaaaugacuugggguuugggggaggggagaaugacagcguuauugcuuaauggguagagaguuucuguuuggggugacgaaaaaguuuuagaaagaauagugaugguuaccuaacagugaauguaaucaaugucacugaaaaguauacacacaagaaauguuaaauggcagauuuuauuaaauauauuuaguuuaccauaauaaaacaagauugcuagaauaaaagaucucuaaacucuauuuccucuucuacuccuguaaguuuuuuaaauucuugaggucagaggcuaggagaaaaaaacccugaagacaccagaaauagguucuuaaagcaggcauucuguaaugguuuaucuuuguauuguuuuaaguccuagaagaaaccaugccaauggaggaagaaaacuacaugcaucugaacuuagugaauguuaaaaaagaguugacugauuagaauaaggaaaaauuaagaauccgugagugaacacuauacuuguaagaacaaaaaggaaauaggauauucccauccagucagucauucaacaggaaagacuucaugaugcaagaaccuggauaaucucauuguucuaagaggacauguggcaguauucuuaaaucucuuauaaucuuugugcaucaagauuugcuuaauauaaagagaacugcuguguuuaaauucugauuaaacuuuccaauaaaauuguuuuucacuaacccuuauucuuagaccuguaaauuauuugcaaaaauuacuuaaaaauauaaacaguaaacaggauccacuggaccuagaugguaaauggugaugacugcuuuuucugguauauugaagguuaauauauuuccuuaguacugucugcuugaugcaauuaacaccccagcagcaaucagcacuacuuguguccauaucuugguuucuaagcauuucuuauuuuauaaggcucuuggaagaaacagucaauuucaggacuaaggcaaacuacagggcaagccuggaacauccugugccagaaagcaagguaacgaucaaauaaugaaaaaagaaugcacaagccaggcacgguggcucacgccuguaaucccagcacuuugggaggccaaggcagguggaucaccugaggucaggagaucgagaccagccuggccaacauggugaaaccucgucucuacuaaaaauacaaaaaaguagcugggcgugguggcagaggccuguaaucccagcuacuugggaggcugaggcaggagagucacucgaacccaggaggcggagguugcagugagccaagaucgugccaccgcacuccagccuaggcaacaagaaacucugucucaaaaaaaaaaaaaaagaaugcaugcuugagccagcuugaaggggcucccauuggccaaauuuagaacaauuugaacaucaaaaggaaugaagaaaucacaucacucucaacuugaaacaacaaaaaaaugaguuuauugugaaacuaaaggggggggugcuagaguucuuguugcucgaaaaacauaaacuaauaaauacauuguuagaaaaucacuaauuagcaaacaccaauauaacugauuuaggcaaggaucauccauggcaaaaggcuuuugaggaauaggauauuuacacugucuucaaguacuauaccauuuaaagguaacuuuaugauggagagacuugacaucuuaaacaagugguuagcaacacuaauaaugggacaaaaaugacauuaugugucuccugaugugaugcaauggaaagucaucaucaucuauguaaucacgcguguauguguguguguguuuuuagagacaggaccuuaccacuuuguugcccaggcuggacuccaccuccugccucagccuucggagcuuuuggaguaacugggacuauaggcuugugccaccaaccagcuaucuacguaguauucuugccaaaaauguuuguuucuucaugauuauguucauuagacaucuccaaauugugggacguucuacaagaaaacugaucuaacgcuucaaaaaugccaauuucauaaagacagaagguggcggggaauaauuuuagaugaaagaagauuaaggagcuaagagagucaaaugccauaguaaucucugauuggcucuugcauugaaagagaguuauaaaggacauuuuuagaaaaacugagaaaaugugaauaugguacaugucaauguuaauuucuugaguguaaaaaaagauaugguuauguagaagaaugaccuugauguaaaaugauaagugcuucaguauuauugaugugaugaugucugcaauucacuuuugaaugguucugcagggggaaaagggaaaaaaaaggaauauauaaagagaaaagcaaauaggacaaaaugcuaacugauuacucuaaacaguggucaucauauuguucuuucaccuuuccuguacuuuuauaauuuuucaaauaaacaguuguaguuuaaggggggaaaauugcauaugacagacuaaaaagauugagacaucacucuggagauaagggcaagugauacaagcuaaaagguucuuaaacuaaaaaugauaacaacagguaaaacaaaauaaagcaguuauggccaaaucacagauuccacgcaccuucuucccccuuuccccccaguguuuugggaccauuaccaucuuuucuuccaaucuagagaagccuaaaacaaugaaauggguuuuuuccuccuugaaauacuguuuuauguuuauugacaacuuccaaagaacuaaaaccaaaguugucucuucuuauggcacauuacuggcacaauacuaagugccaacaacaagaaguuuaucuaaaauaaaacuuacaaguaaugaguucugaaaacucaccuaccuacaaaacggaaugugccuucggcuauacaagcaaacauauucuuacaacugugccuuucuuaaaaaauaaguaaccucucccucccccucccccucccgucuccccacagucucccucucccucugucuccauggucucccucugaugccaagccgaagcuggacuguacugccgccaucucggcucacugcaaccucccugccugauucuccugccucagccugcagagugccugggauugcaggcgcgcgccgccacgccugagugguuuucguauuuuuuugguggagacaggguuucgcuguguuggccgggcuggucuccagcuccuaaccgcgagugaucugccagccuuggccccccgacgugccgggauugcagacggagucucguucacucagugcucaauguugcccaggcuggagugcaguggcgugaucucggcuggcuacaaccuccaccucccagccgccugccuugaccucccaaagugccgagauugcagccucugcccagccaccaccccgucugggaagugaggagugucucugccuggccgcccaucgucugggaugugaggagccccucugcccggcugcccagucugggaaguggggagcgccucuucccggccgccaucccgucuaggaagugaggagcgucucugcccagccgcccaucgucugagauguggggagcaccuccgccccgccgccccgucugggauguggggagcgccucugcccggccacgaccccgucugggagaugaggagcgucucugcccggccgccccgucugaaaagugaggagccccuccgcccggcagccgccccaucugggaagucaggagcccccucugccccacagccgccccaucugggaggugaggagccccuccgcccggcagcugccccgucugggaagugaggagcgucuccgcccggcagaagccccguccgggaggcggggggcagcccccgcccggccagcugccccguccgggagggaggcggggggcagcccccgccuggccagccgccccguccgggagguggggggcgccuccgcccggccgcggucccgucugggagguggggggugccucugcccggccgccccuucugggaagugaggacucccucugccuggccgccaccccguguggcagguguacccaacagcucacugagaacaggccaugaugacgauggcgguuuugucgaauagaaaagggggaaauguggggaaaagauaaaggaaucggauuguugcugucuguguggaaagaaguagacauaggagacuacauuuuguucuguacuaagaaaaauucuucugccuugggaugcuguuaaucuauaaccuuacccccagccccgugcucucugaaacaugugcuguguccacucaggguuaaauggauuaaggguggugcaagaugugcuuuguuaaacagaugcuugaaggcaaaaaaaaguaacuucaacauuacuuauugaaguuacagaacuuacagaacaaauauacucuuuucaauaaauuaccauaauuaaaucaauuuagaaaaagcauuucuaaaauucaacacccacucauaaaaacucauagcaaacuuggaauauaaggaaauuuccuuaaucugauaaaagcaaauacaaaaauuacucacaguaaauaccacacuuaaugguaaauguuuaaaaguugaccccugaugcccacuaccagcacuugaacuggccaguaucaaaagcaagaaaaagaaagaaacagcauacggacuggaaaggagaaaauaaaggcaaucuugaggaaccacaacuaaaacuacaccaccauguaccagguaccaagauaacacaaagucauaaugauuuagacaguguagguuugcugcaagaacagacaagccaacagaacagucaagaaacugaucuacuuacacagucaccugauuuaugacaaagaugacaaugcgguggagacaugacacucuuuccaauaaaugcugaugggacaacuagguauccauacaguaaaaaugaaaccugaccucaaucucccccauauacaaagccaauuccagguagaauguagauucucaaugugaaaagcaaagcaguaaagcuucuauuagacaauauaagaggauaucuucagaaaaguaguaagaaagaccucuuaaaaauaagacaaaaaacacuaaccaugaaggaaacaauuguuaaaauuaaaaaugucuguugaucaaaggacagacaccacuguaagugcuccaagucaagccacagaccagggaagaaacuuacaauauauaauuggaaaggcagucauuacuaugaaucaauuagaauauaacuaacaucccaauagaaaguaguuaacagaugagcagguauuucacaaaaacaaaacacaaaaauccaaguagccaauaaacaucugaaaaggucaucaaccucauuacucaucacuagauuggcuagcaaauaugaaaagacacauggugguaaagacugaagcagggagaacuucuguccacugcuagcaagcgguaaacugguauaaccaccuuagaaaaagcauucuaaguggaacugaagacacaaacacgccaugagaaaguuccaggcaaaaacuagaaacaaacuguucaucugaaaaauaaacaguauuaaugaaaauucuaagaucggaucuguaaacaucuaucacaaugcguggcacacagaguugcucccuauaauguaauuccauccguccauuucuucacauaugcaugacaaauggauauaauuuaagaucagccucaaaacacauuccaaucguuucccaucucacaaauaugaaaaccaaaacucuuacaaugaucugguacugcucucauacuggcuagaaagcucuucucuaaaauauccuccauauauccacacagcucacuccccacuuauuucaaguuucugcucaaauggaaccuaacagagaagcccucucugauggcuuacagaagacaccaucccuccacucacaucccucauucucuacacgccucuuaccuuccuguuuuucuacuuagccuuaccuaccaaacacccaagguaaggcuauguaacugcaugccuucaccccuagaguguaaccaugaaagaaagaacuugcuguauuuuguucauuacugcacacucagcagaacaugccuggcauguaguagauacucauuaaauauuuguuacauaaauucuauggcauggauucuaggcuuggaaagaauagcuguuauauggccuacguggcugacaguucuuuaaacuaugugcaguuuaguuuaucacaagaaauaugaaaacccuccauuaaguuaaauuagcuguucugcuuuauaaaaaauuuaaaauauuuacucuuaaugcauuuaauuccccaaggaucuauaucaggaaguauaagcuauuccaaaauuccaagugagaacuacaugaggcacucaauuauaaauauauuauccuaaugaauuuucuaaucuuacuauuauccugcaaauaagccuauaaaaacgauacuggauccaccacuuuuuaaaauauuacaauaaaaucucaguaguucugcuaauaaaagcuaauaguaucuagagauaaaauacagguaucucagaaacaucaccuuagccaagaaacaaaaauuucaacauaaugcaauucuuagaaucagauuuaacaagaucuuaguacaaggaaaccucccugaacagcccaagacacuccacaacaguccuagaccacacauuuuaugguauaggucacagucuagacagguuaagcuuccauuuuuccaacaaauauuuuacugcuguuaguaaaaacagauuuaguuaaagacaaaaaaaggaugaucugaauuucucuccucucccuguaucuuauaacaaaugaagauuaaauaaaaccuuugggggggggaaggaaaucaacuggaagaugguuguuugaauaaauuauauauaucagcucugaaguaaccaagaaauaaaccugccuaaccggcauucaaaccagccaagagccauuuuucaggcucagaaaguguuuugcaauuaaaguaacauuccaauuuucguuaaaauuaaaauaaguuuuaucaauagcuuuuuuuggaaaaaaaaaaaucccauccaauuuuacaaacuuuuagguaaaauaauaaaauuguguacuuuuaaaacaaugguguuuuccuauguaaaauguguaaauauuuauauaaacguaacuggaaccacccuauacauacuguccuaguuuucaaugccuacguaacagcuccugauuuauuuaaccaaucccccaaugucagacuuuuaguuuuucucuuuauaaacaaagcugcagggaauguuucuuacauguuuuauugcuagaucaaaauagaaacaaaccgaaguucuaacuaaaauaaauuguuuuggaaauguuucaccauugacuguaagugaaagcaauguuaaaauauuugauccuaaccgcugacuacagauauugucacuuagagguuguggcuuguucaugccccuugucuguccucuuccucagguugccaauuuuuuguccuuuuuauuccauguuccagagaacauacaagaaaaaaagagagagagagcguaaaacuuguuauacuccuuagcugaauuuggaaaaaaagaaagagcaaaacuaaugagcaacauuuaagccacauuaccuaccagccccucucaaucaaggcucccagagaagauuaugcccuaagccuaaggcacccacuguguguaaggaacucauuucucucucugcaucuacagccaacuagguagguacccucucagggaaaacugagaacagucauucaaaucauuuucugcagaguuuaacucugucucacaaaacccauguagggaaaggccaagagcuuaaaagcauguuugauucaucuuucauaaaggaauacuaagugccacauaugaagcuacuaugacauuuuccccuucuacacucaggaugucacuacgcuucuacuuuacuagaacucacuguacucccacaacugggccagcuuuaaagccuaaauaaauugcuucacaaaaaauuuucacugccgauuuacuggguaguuuuccuguacuacacuauaauuacagugcagcuaucuaaucaguuuauuuuguggccuugugggucuccuguccacugaagcaaaugcuucuauuaaauaaagauagauuaaauacugacgcgcuuuuuccugaacuggggauaauuuuacacacccaugacagauauacgugguuauuuugugugccgaauuaacauuaacacaacacagaaaaauaauuugguagcacagucaaugucuacagaaaacagucauucaguuugccacaagacuguaacugaaaaagcaguuacucucucuuccaauguaacucaacacgauaccagaaagcuguucagagcaccccaaaaaguauccuuugcauuucagucacacuaacaucagaauaaaacuaaggauaucuuuuuaauaugccaaauggcagaaaacauaucaagucagcauuaugcacguauuauacacugaaggaggugaaauuaacccacugcagcagaggaaaggcaauagaaacaccauccucugagggucugugucacauucucugaaagaauaaaaaaugccaaguuuuggcaaaaggaguaagauuucaugaggggcuguuuuuucuuucuucuuuuucuaucuuucucuuuuaaaaaaauacauuaaugucuucuaauuuaaagacgccaaacuaguuaaguuuuauauauauauauauauauauauauauauauauauauauauauauauauauaugaaugacagggucucacucugucgcccagggugaagugcaguugcaugaccauggcccacugcagccucaaacgccugagcucaagugauccucucaccucagccucccaaguacgugggacuacaagcgugcaccaccauggcccggcuaauuuuuuguauuuuuuuguauagacggaggucucccuguguugcccaggcugaucucgaacuccuuggcuucaagcaauuccacgaccuugacaucccaagcagcugggauuacagguuugagucaccacccuagccacuggauuuuuaaaccuucaucuugaaaacauggcuuccaaaccuaacaguugcguuauuagagaaaaauggcugagaaaugaaaauccaacccacaaaauaauuuaaaccaaccagaacaaagaaagauucccgcaguucaucccaacaggugguuuccaagcaaacgaggguuuuuuaaguucuaucaaaacccccaucuaguagaacugaguauauuuuuguaucuauguaaacagucguucuuauacaggaauguucaauuaaaaaguuaagaacuuuuaaacugcuuauaguguugaagcaacuuccuaacccuuuauaauccaugcucuuccaaacaugacauaaaauauuuuaagcaaauuaaauacugcuuuucaaaguaacaauuucaagacacuugaggggacagaaucaaucugaaagaccacagaauccacagaaaaaucagauuuaacaauaaaacuauuucuuaaauugggaauacuucuuuauauaaagucccacuaggaaacacaaaacuuuguacccuuuucaccaguaguuuaaaacucauuuauuauacgaugaaauuaaaauuuguaaaaaugagccgggugcggugacucaggccuauaaucccaacacuuugggaggcgagguggggaaggguaggagggggaggaucgcuugaggccagaaguucgagauuagccugggcaacauagugagacucucuuuuuuuuuuaauguuuaaauggcauuauauugugacaaauauuaaauaaccaaauauugcacaggaagcauuaucaugacaaacgcgguaaaacuuuuccgugcaaucaaagagcaacaaacaguacacauuuuaagcaauguuuaggucauuacaagcuacaaauauuaaggcgaacgcuuccguugacagcgugcugcccccgcccccaaauucccacgcgcugccgcacgccuucagcucagaagcccccuuuccugggcaggcgaacgggcugcacaccccucacuccgcugcgaagucaaagggcugcagacaaagacaacagaagcacgugacaaaaguuuauccccguucccuccgggggcccgggcagcugggccuaggccacgcggggcggcggcccagagcacaggcaggggcagcccggcgggcggaggcggaagcggcgcggggcugcuaguuaccuuuuccugcuccucgcgcagccgcgccacauccggggcgcgcaacggaaccagggcaggggccggggccgaagggggcgaggggucggggggcgucuccacggugggcgccuccaugacgggcccgcgggccucagcgcggcgugu

SEQ ID NO: 192913 - RNA, 73189 nt, Homo sapiens
acacgccgcgcugaggcccgcgggcccgucauggaggcgcccaccguggagacgccccccgaccccucgcccccuucggccccggccccugcccugguuccguugcgcgccccggauguggcgcggcugcgcgaggagcaggaaaagguaacuagcagccccgcgccgcuuccgccuccgcccgccgggcugccccugccugugcucugggccgccgccccgcguggccuaggcccagcugcccgggcccccggagggaacggggauaaacuuuugucacgugcuucuguugucuuugucugcagcccuuugacuucgcagcggagugaggggugugcagcccguucgccugcccaggaaagggggcuucugagcugaaggcgugcggcagcgcgugggaauuugggggcgggggcagcacgcugucaacggaagcguucgccuuaauauuuguagcuuguaaugaccuaaacauugcuuaaaauguguacuguuuguugcucuuugauugcacggaaaaguuuuaccgcguuugucaugauaaugcuuccugugcaauauuugguuauuuaauauuugucacaauauaaugccauuuaaacauuaaaaaaaaaagagagucucacuauguugcccaggcuaaucucgaacuucuggccucaagcgauccucccccuccuacccuuccccaccucgccucccaaaguguugggauuauaggccugagucaccgcacccggcucauuuuuacaaauuuuaauuucaucguauaauaaaugaguuuuaaacuacuggugaaaaggguacaaaguuuuguguuuccuagugggacuuuauauaaagaaguauucccaauuuaagaaauaguuuuauuguuaaaucugauuuuucuguggauucuguggucuuucagauugauucuguccccucaagugucuugaaauuguuacuuugaaaagcaguauuuaauuugcuuaaaauauuuuaugucauguuuggaagagcauggauuauaaaggguuaggaaguugcuucaacacuauaagcaguuuaaaaguucuuaacuuuuuaauugaacauuccuguauaagaacgacuguuuacauagauacaaaaauauacucaguucuacuagauggggguuuugauagaacuuaaaaaacccucguuugcuuggaaaccaccuguugggaugaacugcgggaaucuuucuuuguucugguugguuuaaauuauuuuguggguuggauuuucauuucucagccauuuuucucuaauaacgcaacuguuagguuuggaagccauguuuucaagaugaagguuuaaaaauccaguggcuaggguggugacucaaaccuguaaucccagcugcuugggaugucaaggucguggaauugcuugaagccaaggaguucgagaucagccugggcaacacagggagaccuccgucuauacaaaaaaauacaaaaaauuagccgggccaugguggugcacgcuuguagucccacguacuugggaggcugaggugagaggaucacuugagcucaggcguuugaggcugcagugggccauggucaugcaacugcacuucacccugggcgacagagugagacccugucauucauauauauauauauauauauauauauauauauauauauauauauauauauauaaaacuuaacuaguuuggcgucuuuaaauuagaagacauuaauguauuuuuuuaaaagagaaagauagaaaaagaagaaagaaaaaacagccccucaugaaaucuuacuccuuuugccaaaacuuggcauuuuuuauucuuucagagaaugugacacagacccucagaggaugguguuucuauugccuuuccucugcugcaguggguuaauuucaccuccuucaguguauaauacgugcauaaugcugacuugauauguuuucugccauuuggcauauuaaaaagauauccuuaguuuuauucugauguuagugugacugaaaugcaaaggauacuuuuuggggugcucugaacagcuuucugguaucguguugaguuacauuggaagagagaguaacugcuuuuucaguuacagucuuguggcaaacugaaugacuguuuucuguagacauugacugugcuaccaaauuauuuuucuguguuguguuaauguuaauucggcacacaaaauaaccacguauaucugucauggguguguaaaauuauccccaguucaggaaaaagcgcgucaguauuuaaucuaucuuuauuuaauagaagcauuugcuucaguggacaggagacccacaaggccacaaaauaaacugauuagauagcugcacuguaauuauaguguaguacaggaaaacuacccaguaaaucggcagugaaaauuuuuugugaagcaauuuauuuaggcuuuaaagcuggcccaguugugggaguacagugaguucuaguaaaguagaagcguagugacauccugaguguagaaggggaaaaugucauaguagcuucauauguggcacuuaguauuccuuuaugaaagaugaaucaaacaugcuuuuaagcucuuggccuuucccuacauggguuuugugagacagaguuaaacucugcagaaaaugauuugaaugacuguucucaguuuucccugagaggguaccuaccuaguuggcuguagaugcagagagagaaaugaguuccuuacacacagugggugccuuaggcuuagggcauaaucuucucugggagccuugauugagaggggcugguagguaauguggcuuaaauguugcucauuaguuuugcucuuucuuuuuuuccaaauucagcuaaggaguauaacaaguuuuacgcucucucucucuuuuuuucuuguauguucucuggaacauggaauaaaaaggacaaaaaauuggcaaccugaggaagaggacagacaaggggcaugaacaagccacaaccucuaagugacaauaucuguagucagcgguuaggaucaaauauuuuaacauugcuuucacuuacagucaauggugaaacauuuccaaaacaauuuauuuuaguuagaacuucgguuuguuucuauuuugaucuagcaauaaaacauguaagaaacauucccugcagcuuuguuuauaaagagaaaaacuaaaagucugacauugggggauugguuaaauaaaucaggagcuguuacguaggcauugaaaacuaggacaguauguauagggugguuccaguuacguuuauauaaauauuuacacauuuuacauaggaaaacaccauuguuuuaaaaguacacaauuuuauuauuuuaccuaaaaguuuguaaaauuggaugggauuuuuuuuuuuccaaaaaaagcuauugauaaaacuuauuuuaauuuuaacgaaaauuggaauguuacuuuaauugcaaaacacuuucugagccugaaaaauggcucuuggcugguuugaaugccgguuaggcagguuuauuucuugguuacuucagagcugauauauauaauuuauucaaacaaccaucuuccaguugauuuccuucccccccccaaagguuuuauuuaaucuucauuuguuauaagauacagggagaggagagaaauucagaucauccuuuuuuugucuuuaacuaaaucuguuuuuacuaacagcaguaaaauauuuguuggaaaaauggaagcuuaaccugucuagacugugaccuauaccauaaaauguguggucuaggacuguuguggagugucuugggcuguucagggagguuuccuuguacuaagaucuuguuaaaucugauucuaagaauugcauuauguugaaauuuuuguuucuuggcuaaggugauguuucugagauaccuguauuuuaucucuagauacuauuagcuuuuauuagcagaacuacugagauuuuauuguaauauuuuaaaaagugguggauccaguaucguuuuuauaggcuuauuugcaggauaauaguaagauuagaaaauucauuaggauaauauauuuauaauugagugccucauguaguucucacuuggaauuuuggaauagcuuauacuuccugauauagauccuuggggaauuaaaugcauuaagaguaaauauuuuaaauuuuuuauaaagcagaacagcuaauuuaacuuaauggaggguuuucauauuucuugugauaaacuaaacugcacauaguuuaaagaacugucagccacguaggccauauaacagcuauucuuuccaagccuagaauccaugccauagaauuuauguaacaaauauuuaaugaguaucuacuacaugccaggcauguucugcugagugugcaguaaugaacaaaauacagcaaguucuuucuuucaugguuacacucuaggggugaaggcaugcaguuacauagccuuaccuuggguguuugguagguaaggcuaaguagaaaaacaggaagguaagaggcguguagagaaugagggaugugaguggagggauggugucuucuguaagccaucagagagggcuucucuguuagguuccauuugagcagaaacuugaaauaaguggggagugagcuguguggauauauggaggauauuuuagagaagagcuuucuagccaguaugagagcaguaccagaucauuguaagaguuuugguuuucauauuugugagaugggaaacgauuggaauguguuuugaggcugaucuuaaauuauauccauuugucaugcauaugugaagaaauggacggauggaauuacauuauagggagcaacucugugugccacgcauugugauagauguuuacagauccgaucuuagaauuuucauuaauacuguuuauuuuucagaugaacaguuuguuucuaguuuuugccuggaacuuucucauggcguguuugugucuucaguuccacuuagaaugcuuuuucuaaggugguuauaccaguuuaccgcuugcuagcaguggacagaaguucucccugcuucagucuuuaccaccaugugucuuuucauauuugcuagccaaucuagugaugaguaaugagguugaugaccuuuucagauguuuauuggcuacuuggauuuuuguguuuuguuuuugugaaauaccugcucaucuguuaacuacuuucuauugggauguuaguuauauucuaauugauucauaguaaugacugccuuuccaauuauauauuguaaguuucuucccuggucuguggcuugacuuggagcacuuacaguggugucuguccuuugaucaacagacauuuuuaauuuuaacaauuguuuccuucaugguuaguguuuuuugucuuauuuuuaagaggucuuucuuacuacuuuucugaagauauccucuuauauugucuaauagaagcuuuacugcuuugcuuuucacauugagaaucuacauucuaccuggaauuggcuuuguauaugggggagauugaggucagguuucauuuuuacuguauggauaccuaguugucccaucagcauuuauuggaaagagugucaugucuccaccgcauugucaucuuugucauaaaucaggugacuguguaaguagaucaguuucuugacuguucuguuggcuugucuguucuugcagcaaaccuacacugucuaaaucauuaugacuuuguguuaucuugguaccugguacauggugguguaguuuuaguugugguuccucaagauugccuuuauuuucuccuuuccaguccguaugcuguuucuuucuuuuucuugcuuuugauacuggccaguucaagugcugguagugggcaucaggggucaacuuuuaaacauuuaccauuaagugugguauuuacugugaguaauuuuuguauuugcuuuuaucagauuaaggaaauuuccuuauauuccaaguuugcuaugaguuuuuaugaguggguguugaauuuuagaaaugcuuuuucuaaauugauuuaauuaugguaauuuauugaaaagaguauauuuguucuguaaguucuguaacuucaauaaguaauguugaaguuacuuuuuuuugccuucaagcaucuguuuaacaaagcacaucuugcaccacccuuaauccauuuaacccugaguggacacagcacauguuucagagagcacggggcuggggguaagguuauagauuaacagcaucccaaggcagaagaauuuuucuuaguacagaacaaaauguagucuccuaugucuacuucuuuccacacagacagcaacaauccgauuccuuuaucuuuuccccacauuucccccuuuucuauucgacaaaaccgccaucgucaucauggccuguucucagugagcuguuggguacaccugccacacgggguggcggccaggcagagggaguccucacuucccagaaggggcggccgggcagaggcaccccccaccucccagacgggaccgcggccgggcggaggcgccccccaccucccggacggggcggcuggccaggcgggggcugccccccgccucccucccggacggggcagcuggccgggcgggggcugccccccgccucccggacggggcuucugccgggcggagacgcuccucacuucccagacggggcagcugccgggcggaggggcuccucaccucccagauggggcggcuguggggcagagggggcuccugacuucccagauggggcggcugccgggcggaggggcuccucacuuuucagacggggcggccgggcagagacgcuccucaucucccagacggggucguggccgggcagaggcgcuccccacaucccagacggggcggcggggcggaggugcuccccacaucucagacgaugggcggcugggcagagacgcuccucacuuccuagacgggauggcggccgggaagaggcgcuccccacuucccagacugggcagccgggcagaggggcuccucacaucccagacgaugggcggccaggcagagacacuccucacuucccagacggggugguggcugggcagaggcugcaaucucggcacuuugggaggucaaggcaggcggcugggagguggagguuguagccagccgagaucacgccacugcacuccagccugggcaacauugagcacugagugaacgagacuccgucugcaaucccggcacgucggggggccaaggcuggcagaucacucgcgguuaggagcuggagaccagcccggccaacacagcgaaacccugucuccaccaaaaaaauacgaaaaccacucaggcguggcggcgcgcgccugcaaucccaggcacucugcaggcugaggcaggagaaucaggcagggagguugcagugagccgagauggcggcaguacaguccagcuucggcuuggcaucagagggagaccauggagacagagggagagggagacuguggggagacgggagggggagggggagggagagguuacuuauuuuuuaagaaaggcacaguuguaagaauauguuugcuuguauagccgaaggcacauuccguuuuguagguaggugaguuuucagaacucauuacuuguaaguuuuauuuuagauaaacuucuuguuguuggcacuuaguauugugccaguaaugugccauaagaagagacaacuuugguuuuaguucuuuggaaguugucaauaaacauaaaacaguauuucaaggaggaaaaaacccauuucauuguuuuaggcuucucuagauuggaagaaaagaugguaauggucccaaaacacuggggggaaagggggaagaaggugcguggaaucugugauuuggccauaacugcuuuauuuuguuuuaccuguuguuaucauuuuuaguuuaagaaccuuuuagcuuguaucacuugcccuuaucuccagagugaugucucaaucuuuuuagucugucauaugcaauuuuccccccuuaaacuacaacuguuuauuugaaaaauuauaaaaguacaggaaaggugaaagaacaauaugaugaccacuguuuagaguaaucaguuagcauuuuguccuauuugcuuuucucuuuauauauuccuuuuuuuucccuuuucccccugcagaaccauucaaaagugaauugcagacaucaucacaucaauaauacugaagcacuuaucauuuuacaucaaggucauucuucuacauaaccauaucuuuuuuuacacucaagaaauuaacauugacauguaccauauucacauuuucucaguuuuucuaaaaauguccuuuauaacucucuuucaaugcaagagccaaucagagauuacuauggcauuugacucucuuagcuccuuaaucuucuuucaucuaaaauuauuccccgccaccuucugucuuuaugaaauuggcauuuuugaagcguuagaucaguuuucuuguagaacgucccacaauuuggagaugucuaaugaacauaaucaugaagaaacaaacauuuuuggcaagaauacuacguagauagcugguugguggcacaagccuauagucccaguuacuccaaaagcuccgaaggcugaggcaggagguggaguccagccugggcaacaaagugguaagguccugucucuaaaaacacacacacacauacacgcgugauuacauagaugaugaugacuuuccauugcaucacaucaggagacacauaaugucauuuuugucccauuauuaguguugcuaaccacuuguuuaagaugucaagucucuccaucauaaaguuaccuuuaaaugguauaguacuugaagacaguguaaauauccuauuccucaaaagccuuuugccauggaugauccuugccuaaaucaguuauauugguguuugcuaauuagugauuuucuaacaauguauuuauuaguuuauguuuuucgagcaacaagaacucuagcaccccccccuuuaguuucacaauaaacucauuuuuuuguuguuucaaguugagagugaugugauuucuucauuccuuuugauguucaaauuguucuaaauuuggccaaugggagccccuucaagcuggcucaagcaugcauucuuuuuuuuuuuuuuugagacagaguuucuuguugccuaggcuggagugcgguggcacgaucuuggcucacugcaaccuccgccuccuggguucgagugacucuccugccucagccucccaaguagcugggauuacaggccucugccaccacgcccagcuacuuuuuuguauuuuuaguagagacgagguuucaccauguuggccaggcuggucucgaucuccugaccucaggugauccaccugccuuggccucccaaagugcugggauuacaggcgugagccaccgugccuggcuugugcauucuuuuuucauuauuugaucguuaccuugcuuucuggcacaggauguuccaggcuugcccuguaguuugccuuaguccugaaauugacuguuucuuccaagagccuuauaaaauaagaaaugcuuagaaaccaagauauggacacaaguagugcugauugcugcugggguguuaauugcaucaagcagacaguacuaaggaaauauauuaaccuucaauauaccagaaaaagcagucaucaccauuuaccaucuagguccaguggauccuguuuacuguuuauauuuuuaaguaauuuuugcaaauaauuuacaggucuaagaauaaggguuagugaaaaacaauuuuauuggaaaguuuaaucagaauuuaaacacagcaguucucuuuauauuaagcaaaucuugaugcacaaagauuauaagagauuuaagaauacugccacauguccucuuagaacaaugagauuauccagguucuugcaucaugaagucuuuccuguugaaugacugacuggaugggaauauccuauuuccuuuuuguucuuacaaguauaguguucacucacggauucuuaauuuuuccuuauucuaaucagucaacucuuuuuuaacauucacuaaguucagaugcauguaguuuucuuccuccauuggcaugguuucuucuaggacuuaaaacaauacaaagauaaaccauuacagaaugccugcuuuaagaaccuauuucuggugucuucaggguuuuuuucuccuagccucugaccucaagaauuuaaaaaacuuacaggaguagaagaggaaauagaguuuagagaucuuuuauucuagcaaucuuguuuuauuaugguaaacuaaauauauuuaauaaaaucugccauuuaacauuucuuguguguauacuuuucagugacauugauuacauucacuguuagguaaccaucacuauucuuucuaaaacuuuuucgucaccccaaacagaaacucucuacccauuaagcaauaacgcugucauucuccccucccccaaaccccaagucauuuaugacuauacauuuuguugcuuguguuuuuuggugucauaucuaagaauccauugccagauccaaggucuugaagauuuauaccuauguuuccuucuagggauuucaugauuuuagcgcuuauauuuaggucauugauccguuuugaguuaauuucuguauauucauugauuguugauuuugagaaaauucaucuaggauauuuucaucugaaggcucauaaucugagauuuaauuuaugcucucauuucaccaucacgagugucuuucugcgcuaaccaaugugguagccauuaaccacauguggcuauuauacuuaaauucaaaauucaaauuaauuaaaauuaaguaaaauaaaaauucaguuuuuugguuacaauggccacaucucaagugcucauuagucacauuuggcuauugacuguuguauuggucugugcugaugaagauucccuucaucaaaaaaaaaauuuauuggacuucauuggucaagagugcuacuagcucuuuauauucauaaucugauucauuuaauaauugugaaguaucuuuccaucacuuuuuuccucuuuccauuauaggcagaaaguaaaaacaaucugaauucucaacuguguuuauugaaagcgaaaagcagaguacaaagauggugucuguuaucauuuauacugucuugaaagaugaugcaauauccuaggcaaugcaguagacaauggaaggaugauauuuugcuguugauugcauuauccuucugagugauuccauaauucuuccauuuucucauuuucuuauuaguuuuuuuuuuuuagagcguaguuaggaauaguugaucauaaaauaauuacuaaggugaugaugaaauggcaagaugcaggaaaaacauaaucacuaggauccuguaguguaucuuagacuuacaaagccacuguauucauaugguaauugcagaauaaaaugaguuuuuuuuuucuuaauaggaaaauuuucuuuugauuccuuggaaggccucuaagagaagauaaaaggcaugaaauauuaauccuugcaaauaguuagaacuacucaagaaagaaacuaaaaaaauaaaacuggguucaauggacccugacuguauacccugauacuuugaauucaaauccauuaccacaagguucuucuuaaauuuuccccagucuauauuugaaacuccccuucuuucauagugaaaaccuugguucucaacaucugcauuuauucauuugcucuauccuacaauauauacaaaauagcuucagaauuacugcauuaauaccacugccaauggcaaaccugaaguaaaguucaaaaugucuuugcaguuucauuggcuuuuguguaauuaaugcuuuugggguguacaguuaggguacugaucccaaaagucacuugaauuacuuuuuuucugugcaguuauaccuuggauuuuuauuuauauugaaucuuaguauuuguuuuuuaucuuuuucacuuaauugcauuuuaugaauacaugaaaacauuugcaugguucaaaaucacaacuaaaucaaaaguuaucccuacugagguaauucugauucauucccauuccugcucuuacuuaccccuacagauaaacuuuuuuuuuuuuuuuuuuuugagacagaguuucacucuuguugcccaggcuggagugcaguggcgcaaucucggcucacugcaaccuccacaucccagguucaagcaauucuccugccucagccucccaaguaacuggaauuacaggcgcccaccaccaugcccggcuaauuuaaaaaauauuuuuaguagaaauggaguuugaccauguucgccagggugguuucaaacuccugaccucaggugaucugcccgccucagccucccaaagugcuaggauuacaggugugaaccaccacagccggccuagauaaccauuuacauucacuuuugaccuguccuuccucuguuucuucuucaaaaauacauguguucacuuuaucuccccuccauacugcuuucuuauacaaaaggcagcuuauuuugccuuuuguucaucucauuaaaugauaaaccugggaauuacucugguucauagagauauuccucaucauuuuuuuuuuauuuuuuuggagauggagucucgcucuguugcucaggcuggagugcagcggugcauucucggcuccgccucccggguucaugcuauucuccugccucagccaagcuaauuuuuuuuuuuuuuuuaauuuuuuaguagagacgggguuucacuguguuagccaggauggucucgaucuccugaccucgugauccgccugccucggccucccaaagugcugagauuacaggcgugagccaccgugcccggccuccuuaucauauuuugugguugcauagugcuuuaugucugugucaucagauauucagcugauaucuuauugaugggcauuugguguuuuuuagucucuugauaguauagauaaugccucaguaaaucacuuuaugcauauguuguuucucauuugugaaguaacuuuggguaaaguccuagaguuggauuacugagucaaaggguaaauuuguuuagcuuuauccauauuuauaaccacccucucaaugaacuauuauguuuaauuuaauuuauaaugugaaauaaaaauacauaagagaaauagaagaauauuauaucugaaaacuaggaauuccuugaauuggcuguuuccugugaucuucauugccauuuucccaguuaccauuuuuuucuuuucuuuuuuuuuuucuuucuuccuggguucaagugauucuccugccucagccucccaaguagcugggauuaacaggcacccaccaccgugcccagcuaauuuuuauauuuuuaguugagacaggauuucaccauguugaccaggcaggucucaaacuccugaccucaggugaugugcccuccuuggccccccaaagugcugggauuacaggcgugagccaccgugccuggcccaguuaucauuucuuacaaaagaggcaguaauuccuggcuggccuugguaguuccacuuuguuccucuucugucuauuucccagaguagucuuuuuuuuuuuuuauuuuuugagauggaguuucgcucuuguugcccaggcuggagugcaauggaguggucuuggcucauugcaaccuccacauccuggguucaagcgauucuccugccucagccucccauguugcugggauuacaggugcccgccaccacacccagcuaauuuuuguauuuuuaguagagaugagcgccauguuggucagucuggucucaaacuccugaccucaggugauccaccugucuucggccucccaaaauuuuacaggcaugagccacggcgccuggcccagaguagucuuuuuuuuuuuuuuuuuuuuaagaagguccaaaucaauaggucuuuuauugcaucauugaaauaucacaaguaugucuuaggagucaucuggcaucuucuuucuguagcuggauaacucuuagaucugauucaucaaccugcugaacaguuccuuuuucagagacauagauaccauccaaaaauuuccugauauccuuguuuuuaacuguuguggguugcugaaucaaagcugcugaauuugaaacaagcucagugucauuuccuucaaggauuaauucaucuuucugggcuugagguacugaacaggcaacaccuggucucaucugaacccugcggauguauuuuucacccaagaaauuucggauuucaacaagagacccauucuggauaacgacguugaugggggaagugagcauacacagaccucaucuuguaauggaagcccaguguaacacccuugaucauguucuguacaugacuacaaauaguccgaacgguagccaguuccuuucuguuacccgaccauuugucaacccggagccucuuuuuuuucuuuccaaggagucugaguucuacguugaugugauugaaguccuuccgcaggguuccucuggggcccuuuaugauaacugugcgucccuucagaguaacguugacauuuucuggaaugucaacagucugauugcugagaauggucuucauucucacaguaaacgcagcaaaaaaaaguggcccagaguagucuuuuuaagaaugcaaauuggaugaugucauuuugucauuuuccugcuuauaauucuuuuggauuuaucagcaggaaaaccguaaaagaaauacaauuuauguuuugaaauuuuaaaauggauuccaaguuucuguugacaucugcaacuuuucuucuguuuucaugaauguauuaaucauaaagucuauuauauuuuauaaaugcaauaugucaaucaaaugaaggucugcuuuuauuccuuccccuugguuucuuuauagccgcuuuuguuuuuauagauugccuuguaccuuguaauuuugaacuggaugccagauauuguaacaaaaaauucuagggauucuggaggggguuaagcuuucuuuuagcagccagaguaauccuuauggaguauguugucuguuucauaaauuaugugauuauuuguguguagcucuguuucucuauucuguuccauuggauuauuugccuguaauugcaccaguaucacacucuuacuauuuuagcuuuauaauaggucuugauaucuaguaguaaaauuccucuagcacuuuguucuucaagauugucuuuacuauucugacccuuugcuuuuuuguauauauuuuaggaucaccuuuccaauacucaaaaaauaacauuacugggguuuugcuuggagugcacuggaucuaaagaucgguuugaggagaauuaagauguuuacaauauuaaguuuuaaaaucuaugaacaugguauaucaauuuauuuacuucuauaacuuuuuaguauuagcuuuuaaaaguauauaaaucuucauguguuagauuuauuucuagauacuauuuuuuguugccuuuuguaauuuacuugcuauucauuuuuuuuuuuuuuuuugcugguaacauacuugauuuuuacauauugacuuuguucuaaaauuuuuuguuguuguuaaaaaauagagaugaguuugcuguguuggccagacuagucuccaacuccaggccucaagugauccacccgccucugcuucccaaagugcugggaccacaacaagugugagccaccaugccuggccuaaauuuauuugaauucuaauuacuugccuguacauucugauaguaucuguguaguuacauacaggcauguuguuuguaaauacugacaguuuuauucauuccaguucuuaaguuuuuuuuuaugguuguuuguuuuguuuuguuuuuugcccuauuguaugggcuagaaccuuuaauauaauguaaaauaaaaguuaggacauugggcuuuacauaccaggagggcaguuuuaaguauuucaccauacagauguucguaguuggcuuuuuguagcuacucguuaugaaaauaaggacauuuucuccuguugcuaauuuuaucauuaauggaugcugaauuuuaucaaauguauuuucuauguuucuugagauaacaauaugguaaauuacuuugauucuuuaaaaauauucaaaugccauugcauuccugcagcaaacccauuuguagaggauguguuuaccuuguuguauauugcuagauuaaauuugauaauauuuuauuaagguauuuuguucuguuacaugaggcaaaauucuguaauucuuucuuuucuuuucuuuuuucuuuuuuuuugauuaacucuaccagggugcugcggcucacaccuguaaucccagcacuuugggaagcugaggugggcggaucacgugaggucagggguuugagaucagccuggccaacauggugaaaccccaucucuacaaaaaauacaaaaauaagcugggugugguggcgggggccuguaaucccagcuacucggaagguugaggcaugagaauugcuugaacccgggagguggagguugcagugaguugagaucacgccacugcacuccagccugggcaagugagacuccgucucaaaaaaaaaacaacaaaaaacauuaacacuaccuuaaaccuaugauuuucuuuucuuguaaugucgacguaaggauuuggcuucagaauuaggcuggucucaugaaacaacucccauuuuuguauauccuauaaaaguuuauacacuguuguuauugguuuuuguguguguguuuuguuuuuguuuuuuugaaacagaaucucgcucucauccaggcuggagugcaguggccaauccuggcucauugcauccuggaacucccaggcucaggugauccucucgccucagucuccccgaguagcuggggcuauaggaaugcgccaccaugccuggcuaauuuuucuguauuuuuuguagagacagagucucacuauguugcccaggcuggucuugaacuucugggaucaagcuauccaucugccuuggcuucccaaaaugauggacuacaggcuagucagccacugugccuggcucguacuguuucuaacuuaaauguuuggaagaguucaucaacaaagccgucugggcccaauauuuuucuuggacauuuuguauggagauuuuaagauacgaccucaauuucuuugaaaguucaaagacuauccagauuuucuguuucuaguuauaucauuuuagaaaaugugauuuucaaggaauuguccuuucuaaguuuucaagcuuguugucccuccgaguuaucauaauauccuguuaucuuuuuauuaucaguagauuugguggugauguccucuuuuuaauuacuguaauuuuuaauuuguggguuuuuuccucccuugauuucucuucuuaaggguuuaucaauuuuauauuuuauauuuuugccuuugauuuuuuuccucuuuucuaagucugcuuucuacuuuacugauuucuucucucuuuuuuccuguuuaagauuuuccuuugccuguaauuuuucuagcccuuagagaugaugguugagguuacuaauauuaaccuuuccuuauuauaagauaugcauuuugagcuuuaaauuuuucucuuaaucauugccuuagguacugcacacauuuuguaugucauuuuccuuaucagucauuuaaaaauaguuucuaauuucuauugugauuugcucauugacccauaaauuggaaauacauuccuuuucaaacauuauuuucuacuuauuuuucuguuucucuaguguggucagaguacacauucugcauaauugaaauuuaagucuugccuuuugaccuaauguuuucuuuuucuugguaaauuuuucauaauuuacuuggaaaaaaauguuaauccugcaguuuuuggguucaguaugugucuguuaguucaggcugcuugaauauguuguuccaguauuuuauguccuuguuaauuuuuuugucugcuaauucuaucauuuauugagauauguauuaaaauagucacuaggauuauagauuuauuuuucucucuuuuuuuaaccuuugcuuuauauauuuuacagcuauguuauucauuguauacaaauuuaaaauuguaaaaacuuccuggucaguugaccuuuucaccauucugagauauuuuuaucucuaguaaugcuacuugccuucaagucuccuuuguuggauauuaguauuaguauggucacaccagcuaaauuuguuuguuuugucuaucuuuaaaaaaaaucuucuuaacuucagucuuuuggguucgaagugugucuuauaaacagcauauuguugugguuuuaauauucagucuagauaucuuuuccuuuuauuuagaguauuuuaagccauuauauguaguaggauuccugauauauuuaauuuuaucaccuuucuauuagacguacauuguauuuauuuuuuauucaaaaaauuguaguaaauauaacaaaauuuaccauuuuaauaauuuuauuuuaagagacugugucuugcuuugucacccaggcuggagugcagugguauggucauagcucacugcaaccuugaacuccugagcucaagugauccugccugagucuccugaguagcugggacuacaggugcaugccauugggccuagcuaauuaaaaaaaaaaauuuuuuuuuuuguauagacagggacucacuauguugcccaggguggucucgaacuccuggccucaagcggucguccugccuuggccucucaaagugcugggaaauaggcaugagcuaccaugaccagcccauuuuaaucauuuuuaaguauacaguucaguggcauuggguauauucacguuguugaucaaccguaauuaccauccaucuccaggccuuuuuuuuuuuuuuuuuuuaaaucuugcaaaacugaaacucuguucauuaaacaauaacucucuauucuuccccuuccugaucuggcugccagcauucuauuauacuuuuugucucuaugaauuugauuacucuaaguaccuuuaaguggaaucauagaguauuuguccuuuugugauuggguuauuucacuuaccauaaugucucaagguucguccacguuguggcacauaucagaauuucuuccuuuuuaaggcugaauaauauuccauuguauuauagaauguauuaugcaguguauuauacguuuuuguuuauuuuagcauccauggauacuuggguugccucuaccuuauggugauuuugaguaaugcugcugugaacauggguguuugguuuaaguaucugcuuuugauucuuuuuuuuuuguuuuuuuuuuuuuuuguuguuuguuuugagauggaguuucacucuuguugcccaggcuggagugcaauggcacaaucucggcucacugcaaccucuaucuccuggguucaagugauucuccugccucagccucccaaguagcugagauuacaggcaugcaccaccaccccuggcuaauuuuuuguguuuaguagaguugggguuucaccauguuggucaggcuggucucgaacuccugaccucgggugauccacccaccucggccucccaaagugcugggauuacaggcgugugccacugcgcccggcugcuuucgauucuucuggguaugcucagagguggaauuucuggaucauaugguaauucuguguuuaauuuuuaaggaacugccacacugcuuucuccggugacuguaccauuuuacauucccggacaaauucacaaggguuccaguccacauacugggcaacuuuuggcauuugcauuggcuguuuuuguuuucuguaaggaccauccucauuacuggagugucaaaugguuccccauuauaguucuaauugauguacuuuuauguucuuuuuucucugcuuuuuuuuuuuccuuccuuuggaucaaacauuuuguauuguuauuuccuccuauuaacuuguuugugauacauuauuuuuuacuacuuuuauacuguacuuaugguuuaguacuaaauauaauauguauuuauaguaucuuuuuuuuuuuuuuuuuuuacaauuccuuuucacuaaguaagucucuggugucucuagagaucauagcauucauucauuuauccagcccaccucuugcaugauugcucccaugcauuuuaauucuacguauuuuaaacaccacaacacuguauuuaauuguucuguguggucaauauugauuuaucuuuacccaucuuuuuuuuuuuuuauccuguaccuuuacucuucaauucuuucugcauuuauauuacucugaagaguccuuuuuguuguuguugcugucuuuuuuuuaaccgaucacacuuauuuaauaacaauaucuaguuuaauaauuuuuuugauaagacauuuuauuaacaacaugucuaguuuaauaaaccguauuucuuuuaaugaaagucugcuggugcagaauucuguuucuguugaaaauguuauuuuuuccuucauguuggaggaucuauuugcuguguaugucacuauagauuuucaguuauuuuuuccagcauuucaagauacucuguuaucuuucacuuucugucauugauguugaaguuagcucuagcucuaagucuugucacuccuuugaaggcugugaaucuccccugugccuccuccgccuacccccagcugcacauaaaguuuucccuuuuucuuugguuuucaucacuguuaacuauguugugccuugaaauuuucuuugugcuucucuugcuugggauucuuggaguuucuucagucuaucggcugauacuuugauaucaguuuuagaaaauccagaauucaagaucuuuucaauauugcuucugcugcauucucucuucccuuucuggaucuugcacuuacacuguguuucacaugucucuuauuggucuuuucuguauuuuccauguuuuauuuuugaaucucugggcuuuaauuugguguuuucuuuugaccugucaaguucaaaaauccugauuucugcuguuuaaucuucuuuuaaugccauuuauuuuaauuuuugguucuucaguuguacaauuuucauugguuucuuccuguagauuucaguucucuagugaaaauugcuauuuuuaaaauauauuccuuuuaucuuuuccucuauuuccuugaacauauuaaucauuauguuuguuaacaccaguaucuagauugcauguguguuugguucuguuuuauauauuuuuucuuuugacuuuuggucauaugauccuguuucuuggcauccuaguuauuuuugacuaaauccugggauugugucuuuaaagauuguagauauuccugaaggugauaacuuccucuggaaaaggcgcguccuuucuucuacugaagcagaugcagugggagcuggucaccuuacuccgggcaggugcuggguggagugaaggccagguuguuguuuuaguaagccaucugcugcuucugguuucuucaggcuuucaucuggaagcuugauuuugcucacuacaccauauuuccuuggaggcuucugaacuaauuuuuguuugauccugagcucugcuuuucagaguuuuaguuuaucuuuuuggccuucgcagcucagaauuugacagauaccaugggagggaaagcaguuguaugcuuaagaccucucuugugcucucauuuuacuaccauauagccuugucagacugcgcaaguucugcuuguuucuuucugcuagccauggcugucuccucagggcccaacauaauucucagccucuugccugugccuccuguugucugagaaaaaaguggcuucagaugaucagcucacuucuccacaguucuccccucucugaauccuuggucccucuuguccucacugcuuuggcagcucuugggugccuuuaaagagauaauuuuuguauuuaucugucugucucuucuacuuucugagaguuacaagcuuuuuuuguccuacuuggagguauuacgcaagucuagacugaguuuugaauuuacauagcuacuugcagugauuuagugugauuugagauuuuuacuacagucucacugacaguggugguuucuuuuguuuuuguuuuuuguuuuguuuuuuuuuuuuuuuuugagacggaguuuugcucucguugcccaggcuggagugcaauggcgugaccuuggcucacugcaaccucugcuuuccggguuugauuuuccugccucagccuccugaguagcugggauuacaggcgccugccacaacgccuggccaauuuuuuguauuuuucguagagauagggcuucaccaucuuggccaggcugaucucaaacuccugaucuuaggugauccaccugucucggccucccaaagugcugggauuacaggugugagccaccacacccggccagugguguuuaaaauaaaaauguacuucuuuaauuaaugcuaaauaagauugcuuuaauuugacuuuuuuguuaccugggaguauauuuuccuguuuuuuuuuuuuuuucuucuacuuguauuuacucuucaguggacuguuuguuuccuuugagccuuucacaggcacauucuccuccuaaccuguguggcaaguuugcuacucuaaaguuuucuuaguugcaaaucauacagaugcuuaggaaauuaugaaauaauuuacuguaagaagucaggagggagucaaggguaggaguuuuuugggucucuguguuuuguuuucuuguacauuuauguuguuuccuguaccagcugcuuuagaugguugguuagcuugugcagauccuauaguggucuuucuuuuaggaccagaaucuguaaucaccucaggcucugauguccaaaguaaaugagguugguccaguuagcagcagguaucuauccucucccuuuauuguggcuacagacggagaaaugggauucuuuacccauucuuuaugggagaagggcaggguuucuacgaggaaggcaugugaauggagaagaaaugauugauaaucucugauaaaacagugggcaugcaagguggaauucaggcaguauuucagauucagaaauguaggucacaauuucuuaucugcaguucggaagccugaaaagcacugaaaacacaguuauucuuaaguuuauggcauauucauuguugacaaaacuggaacuuauaugggugaggcauuuauuacauuuugaauauucauauguuucauugcaaauguuauguuuacuacauggcccuaccucauggagcuuucagccagaacaguuagaguuccuggaucucuaguucaagucacccccaaaacccuccaaacauguaaacgucuucauucuuagaaguauuacugaauguaugugucaccacucuuaaaauauuuccaauaggagaaaacuguaauagaauacuuaagauagugaguaaugauuacugaaagaaaaaaagagcccaguuuguagguaaagccaacaagggagggagauguauagugccagagcacguuagacauaguccgauauuuguguaaaacgagacuagauuggcauacaggaaaaaaugcuuagaagccuguguaggaggaaucuggcuaaaacauaaagguaaagauuaaggagacuuuugauuccaucuuagcuaacauuuuaaauaagaacauguaaguguuuucagaaguggcuccauauaauuggacuuagcuuucauuagcaguuuugcuuugcagcauauuuggaacauaauuuguuuaaaauugaaaugguuuucuuuacuuuuauggugguugauuuauuuauuuauuuauuuauuuuuggggacagggucucugucugucucccaggcuggagugcaguggugugaucucggcucacugcaaccuccaccuccuugguucaagcaauucaagcuaccugaguagcuggaauuacaggcaugcaccaccacaccuggcuaauuuuuguauuuuugguagagacgggguuucaccauguuggcuaggcuggucugaacuccuggcaucaugugaucuacuggccugggccucaaagugcuaagauuacaggcgugagccacucugcucaggcuauggugguuuuuauacagcaacacucaguuuauuacaguuuaucccagugcuuauugcauuuuuuucuguuaggaaccuguagucaauuccucccuuauuugcaaagggguuuacuuaaaagauuuguaauuuuuguaaauuuuguugaaaguacacuauuuguauacuuugguaaugauauuuauacaucuacuugacaaaucuaucuuuuaagaaauuauuuucagcuuuuaaguaacugucacauaacauguauguccaguauccauuggcuucagcucccacugauacuauuuucuuuuugacucagcagcuuuaaaaccaaaauaguaagaucugucuugaagccacagucuagcaggagaagcaaacuauauaaauuuagacagcucugauuagcacaguucccaaacuguuauauuaugcauuaacccauacaggaagaauuuaaaauugcaguauggugagacaaguuuuagaagugaagcauuuuugagaaaaguaucaaagaugaagaaguacucuugaccuuuuaggcuuucuguuccagucuaguuuuaguguggcauuguauuuaacuugccuuagaaacucauagguuuaugcccucuuguggucugucaccaauauaaauagcacaaaugaaaauuuuaaguacuggagaucuuacugcauguuacugcucuccuuuauaaaauaauuuuuaaaaagcagcuucugaggaacaacagcuaagaaauuauuauuccugucuuccauauaauguguggagcuuaaaaguuaccaaauguuauuuuaacccuugguaacaaaauguauguguauguuagguggacacuaaugaacagaaaaauauuuuuggaugggcuguccaucauuguccuucuaggugucuaacccuauuaauuuauaagugucuuaaaaauaugaugaggugugauaguaauuguagggcuagcacauuacccuucuaccuucaccuaaacauacacagauauacuaguaaaugaugcuugggaaauguguuuauacuuguuucaucugaaagggucaggagcuguaggaggcauuggaagaaauaaggauuauaauguuagugaauuggugaacuuaagcuuacagaauuugcuuuuacugacaugauuggcaaggucuuauuugugagugugggacugaggaacuaacuaguggaggagaaacagcaauagcagucaguguuuuaagacugcagcuguaaccaguguuuuucugcuguuauccaguaagccgcaugaugguuggaagcaggccaguauagggacugugcacuuuaggauuagauagaaucccugauagaaagacuugguuuuaaaacuggucucaucucuuaccaguuccuggacaguuguguaauauuaaguaaguuacuucaucucugaauacagguuuccucuccaaauaaagauuuaaaccgccuccauugaacucuuugcaguucguuuugucacaugcaguguuggcauauacuccuguuguuauugcucauagguuaaagacaguuuuguguugcaaagaauggauaccauaugacuuuguagccacuggguuguugguaaagacuccuaaauagugguaaaucagcucauaguucuuuuucuuuacuguggacuuacugcuguacuucuauguagguacauacuuuauuauaaauucuugaguguaaacgaggucauuauguuaaagaauuuacuaguucagguauuuuaaaguugaagccuaguaacuauuuuuaagaaaaaugaaaauaauacaauaaguuuuuuuucuuuaggggcacuauuugcauguuuuggcagguuuaaaaaauaaacaaaaacuaguuuuguucuuccauuguggucuuacuuuuguggaggacaacaaaguaaugaaauguuuuuguuucuuuugcuguguuuuucaaguguugcuuguagaacaaggcucgcugccuuaugguuacuuuuaaaauuuaauacuuaaaguaauuaaucugaguccccuuucaggagaaauaagauuauuuagaauaauuuaacuuaagggaaaaauauuuguuuuuauaacaccuucuaaaauuucuaaguuguagaaauuuacuaauuuuuucuuuuuuuuuuuuuuuuuuuuuuuugagauggagucuccuucuguuguccaggcuggagugcaguggcgcgaucucggcucacugcaagcucugccucccagguucaugccauucuccuaccucagccucccgaguagccaggacuacaggcaccugccaccaugcccggccauuuuuuuguauuuuuaguagagaugggguuucacuguguuagccaggauggucucgaucuccugaccucgugauccacccaccucagccucccaaagugcugggauuacaggcgugagccaccgcgucugaccaaaauuuacuaauuuuuucuuuugaauaacuugcugugaaauagaagacaacuaaaaaaaaaacccucuaaauauaauagaacugcuugggcuuaaaucuuuucugcaaguagguggaccauaaaucauauaaacaaagauaaccuagacaugccaucagaaggcuagucuauauauuuuuauaucuaccucuuucaucuuuccccuuauuucugauuucccaaaugucacuucuuuaguuuacauuuggauagugcuuauuugaagucucugauauucuacacacuauauguaacuaauaaagacuuuaaaauguaaggcagcauuuugguagugaaaauuucucuuguacauugugaaauggauuuuguuguucgucuaucuuccuagggagacuguuuaagggaaguaaaaggaacagggcaagaauggccggaacgaaguggaggguagacuauggggagugauggcaagaacacaugccauucuaccagugacuuguuucuuaaacauaaaaagcauaugugccaaauuugcauauuuacuaauuaaaaaggcuuccuggaaacauuagguagacuaucuucuauaaccuuuaacaccgucacuaauggauauagcuuagaagauuuccucgaagguccuuuaaauaauguaaaugauuaugaauguguaacuaguuaauaugcagcuacgaaaggauuaucauguagagguuaaugaacauucugcucuuaugguuugcagggcuuugcuuucugugcuuuuggcucucuucaugcuuggaaacacaugcauugggauuggaaaacauccugacuguucuugggucucaucuuuuaaugggguuguuaaauaggaacuuuaugaaaaggauuucaugagcauuuuuuuccuuuuucaauuuacauuuaauucuauuugucuauuuuguaauuacugccaaaucagaaacagugaaauggauugauguaguuuuagcuuggcucuuccagauguaaagucaguacucuauuauauauugccacuguuauuaaguguugcuaugugauugauacuuacugagagaucuucauucuaaaauggacuuuuuaugcugaguuaauguguaguaugguuggguuucugauuauagcauguauuuugguacagaauuucugucuuaguauuuaaaaugucccaaaagaggacauuuauuucaggaauuaaauguuacaauagaggaauuuagugacaggucuaaaaaaaaucguguguauuuuuuuuuuuuuuuuuuuuuuuuuuuugcugggacgggauggugaaacauugagcauauacaagagacaauauugguauuuagagcagugaacuagagcagcguuuugcaaaccagauaaugcugcucucuuuuucucauggccuagucuuaagcauuuuggcuuucauccccuaguuucucugucucuaaaaugguauaugguauucuagacugcuguuuaaaauuuuuauuaauagguaauuuaaaaguagauaauuagcaauccuugaaaacaguguuaauucuuaaauugucauucaaaaauaguguuauuuuuuuaaauugcauuuuucuuuauugucuagucuucuuauuuucugagcauuuugagaaucuacugacauaucuccaaggaaaacaaauaacuuuuguacuuaaauucauuguuuuaguauuauaaacauaguuuaaacuggcugugaagugcuuacagucuugaucauaauucacuggggaacaaaugagcuguucagagcaucuccuuaucccaaguauuucuucuugaaaauguaguagaaaaauaucacugaauucauuuuuuaaugcgucagaauaaaaauuacaggugaaaauguuuggagauauacugacaaaauaaaauauugucacuacagucauuuuuuuuaacugacgaaacguggauguuacauugguuucuuguuauuuauaacauuuauguauucuacaaaauauguaauauugaaaacaggucuguagauuguacaaaauacuaguuaucuuauaucauaugucaccuaauaguuaugaagcggguuuuguaccaaaguaugaaucagaaagcuguaauuuguucugcaguuaucagccugcauuagaggguuaugauaaagugugcugcuuaaaaacuaacguucacaucucugugcauuugacaaauaaaaauguauacugagaugcuauuaaaucuguaaagccaauguucuaguuuucagauacacugauuuuuguagcucugugcauagcucuguuuuuucaugaguaguuaucuguuuucaugacagguggucacuaacugccaagagagaauccagcauuggugagugaaagaugguuuuauuacacuucugaaauacugaugggguaaccuacuuguguucaaauaauguguuuacuguuugcguguguguguauguaugacuaguaauugaauucuucuaguagucuccauuuugaaugccuuuaauacuaauuuauauugucuuugacccuuuucugaauuacacauuucugauuuccugacguuguguuaccacuuguauuuauucuaagugccuuuucuuuucuaagaauaauauuaauaucauuaugaauuggagacugagacauuuuugaaugugacuuagcucuauuuuggggauauuucuuacauuuuaguagaaaaauaaugggaaucaguuacuuuaaaauaaugauggaaauagggcacagaaauguuuucccaaaguuugaaaaaaaaaucuaauuuucuacuuuucagagcuuguuuuauugacuguacuuuuuuuuuuuuuaagagagagcauaucuauuuuaaugugcuaaucuauaguuaauaggaccauguuugguaaauaacacacuuuccuuuggcuucugaggaaaaugcucgauuuaauggugaauaaaaucuuauauuaugaguugucaugaaguauagcuguugaucuuacagauaucaaauuacaauauauccaugcugugcuuacgaagguuuuacugagagaacaacaggagcugucuugauuauugucugcaggguuauugcaaaaaucaugguaacugccccuuuaguggugagauuaaaccuucgguuauacaccaucaagcauauaauauuuuaaauuuauuuuaagaggcuuuuucuucaugccugagagaucuccaaggaaauaauuuauaguuaguguauaucaaauguuuuuugguuuaaaugcacauaggcugcaggcaguggauaagagugaaaauuggugcaaucuguacacaucaucuuauuaaauuuugacuauuggcuugcagaaaauaaucuaaaacuaauaauauccacuuuauaaguaaaaauucaggacuucauuaauuuucaauaaaugcaucguuguaguugcuuccacuggugguguaaguguguuagcauuuccauaauggaccauucgccuuucauuauacauucaguucagguuaaaacuugaaauacaagucguuggccaaagaauuuuuuccccugcacauuuagucagaguggcccauuuuacaaauaauuuccagaggaaguuuauuaacguggacuucugucuauugguuuugguaagaaguucaggaaauuagaaagguauucacuggaaauagaugcuaguuuacauaaaugggugaaugguaacuugcuucugguuuguuuuauaagauucuuauuagaguucuuuaaggauaagggcacguuuucauccuuuuauucacagccccuacugcuauguuuggcacaaaauaggcacuugauaaauguuugaguaaaugaccaaauaugugguuauuuucuauauaacauuuuaguuuacaaauacucuaguagugcacaagucuagugagcagugacagaaaugugacauuuacuucauggcagguucaugugacccucaauuucacuuuucaguuuuguaaaacccucuaaacuguagaagcuuagcauauuugccuacacauaucuugaaguaauauaguacuuuauacauuuaaaaaauuauuuuuuuccaguuaaaauuugcauuuuccucugaaucauuucugguuugguucaggaaacagacuuuucucuuugcuuuuaaugaagaucuauacaugguauauugcucaaaucugaauggccaguaaauuaaucaauucauuauaucaaaaaauugaaaccaaagugucaccauuucccugaaagcaaggaaauugcuguuugggagagucguggaauucuugugauauuuuugcauucucuuaauuccucaaacaauaguugaguuucuaccauaugccaguauugugcugcuguuuggaauugaaagacccugccauagaagaauucauagccagacauauaacagggaaaucacgauaauuuugugcuauuugcggagauaugaagcaacuacaggaguucagaggcuggagccguucuuagggugucucacacacuacuuuuaaaagcauguugcuuuaauuccuacuuaacccuugguauuagccuagucuaaaauauaauuucuguuaagccccuauucuuuaugaguacgcaccaguauaguaaagaagaacaaaauauaugguuugaaaaaugcauucuuaugcuggugauguuuaugcuuguuuguauaauuuuuaagggauucuuuaaggaacaaguauauguauucuaggcucagaaauaaucuaaauugguuuuuguuuaaaaaaaaauguaggacagggaguaaaaauauuuauagaaaaauaggagugaaaauggucugggaccacaggaucuacccaaaaaaaucuuugagaaaauuaauuuaaauccuagaacuuuggugaacgaagaaauuuauaauauuuguuuaguuaauaacagauaaaaaggaaagauucaagccuauuggaugagaauuuguacauuauuuuagagcuaauaauaaugguuuucaguuuagugaggauuuaaaaaauguuuuugaaucaaacuuuuuuucuuuauaauccuuuuuaacuaacucaggaaauaagguauuaugaaauccacacacuguuaccuccuuaaaguaugaggauacuucccacuguuugguccacuaguggcugauuauuuuguuuguggauuauuuguaauuuucuuuuuaauucuuccuuaaagagcauggcauuuggagucacagaccuauauuugaauccugucauuuacuagcguuuugaccuugaacaauuaugcucagagucucaguuuuuucuuguaaagugaugaugauacuacuuaacucacaggguuguagugaagaucaaaugagaucaugucuguagaacacccugcccggcacucaauaaguauuaauaggaacccauauaccucuuuugaaaauuuuaauugucagacaaauaaaaaaaaaagccagugcuuuguaaauauucgugaauauuuaguguucauucuguuuuuuugucaugauggagagagaguuggguuucugugaauuacuguuacagcuuuacauuaauauuuuuaaaucacuuuuugguaugaagaauuucaaaugaaaggugauagaguaguauagugaauccucauguacucaucagucggcuuugauaaucaucaacucaugauuuucucuaaacuguucauuucaacaucuuaucuugccaucuacuccuaccuccaauuuuuuuuuaacuuuuauuuuagauuugggagguacauguagagguuuguugcaaaggugcauugcaugaugcugagauuugagguacaauugaacccaucacccagauagcauaguacccaguaggcaguuauucagcccuugccccugcccuuucucaccgcucuuguauuccccaguguuuauuuguucccaucuuuauguccauguguccccagugguuagcucccacuuauaagugagaauauacaguauuugguuuucuguuucugcauuaguucgcuuaggauaguggccuccugcugcauccauguuacugcaaauauuucuucuuuuuuauggguguguaguaguccauaguauauauguaucacauuuuuguuauccaguucacuguugaugggcacuuggauugauuccauggcuuugcuauugugaucauugugguagugaacauacaggugcauguaucuuuuuggcagaaugcuuuuuuuuuuuggguggucuguauucaguaauggauugcuggguugaaugguuguucaguuuaguucuuucagaaaucuccaaacugcuguccacaguggcuggacauucccacuaacaguguaaaagcauuccuuuucuuugcaguccugccaacaucuguucuuuuuugacuuuuuaauaaaaacuauuuugccuaucccaucuccaguuuugaaaugaaucuaagccguaucauuccaucuggaaauauuucaguauauaucuuuaagagacaagaaagacuauauauuaacuuuuuaagauuuaaauaaaaaauauuuaaugagacaauacauuuacauguuucaaaauuuaggagguaugaaaggauguaaaugauguauagguuccuccuaacuuuguccccuaauucucaguucuguuuacuuuuuuuuuuuuuuuuuuuuugagauggagucucacucugucauccaggcuagagugcaauggcaugguuucggcucacugcaacuucugccucgcggguucaagcuauucuccugacucagccuccgaaguagcugagauuacaggcgcgugccgccaugcccagcuaauuuuuuuaguauuuuaguaaagacgggguuucaccguguugcccaggcuggucucgaacuccugagcucaggcaaugcacccuccuccgccuccuaaagugcuaggauuacaggugugagccaccgcacccggccccucaguucuguuuucuggaaacagcaguuuuuuaccaauuucucauaaaucuuuucagaaaugguuugcauaauguaaguguuuguguauguauguguguguguuguguguguguauucaucuacauguuuauauacggcucccauccuuuuggacaaaaaugaaaucagauuguaccuguucauuuaauacuauaccuacccuguaucauuaacuaacaguuccucuuuaccucauuccauacauuuugcuguaugucagacauuuaacuuuuaggauuacuaaaugagaccuggaacuauuuuuuuuuaaauaaauaauugcuacaugacugagaguauagcucugaacucaaaauauauccuugcuaagaugauauaucuguuauuuuacugcuccuuaguaaaauuacugcaaaacuuaguggcuugaaacaaccaccauuuacuugcacaugauucagugggugugcauauuaagcugggcucaccugugugguucuucugcuagucuugugugggcucacugcuuugguugcagccaguugguggcugggucagcuuuguuguccagaaugaccucacccucaagucuggugguuagugcuguugguugagccucugccuccaugugcucuuuuguccagcuuacuuucuaugggcaucucagcagcaagaauggaagcugcaaggccacguuauguuggucaaaggaagggccagcgcagauucacaaggugggaagauaacacccaccuguugagaggaggcgugaaaaagaauuaauggucauuuuuaaugcacugcaaugacuuuauugaauagguccuacacacacaaaaaggaagucuccguccuuuauguugacuggugagaaugaaaugaaauaguacaugugaugccuggcaguucaucuuuauguuaggcauuacuuacaaucguaaaucguaugcaugugaguuguaaaaaauuuauugccuugcuuccuuuauuuuaaaaggauuuuugguaaagguaucuuugaaauuacaugaaacagacuuaaauauagaagaagauacuuuguucagguguuuaauuuuggaaagaauacuuuaaauuuagacauaaaaguucuaaaacacuuuggcaugugaguuuugagagagucuaaagcaaauacucaacauuuuuuuauuuuucaaaggaaacuggacaaaaauaauuguucagaggaaaagaguaacuagcuuccauuagaauuuauaguuaaaguauauaguaggaaauaaccaagaaagcauaccuguauagcuaaaaaucucaggugaagauuugauuuucucucucucuuuuuuuuuuuuccuguuggagcuacucuuuccuaucagucgggauggagauaccugcuuuaugcacacauuguauaucugucuauaugucucauguuuuugaggcauuccuugugcacagaagcacugaacuauaucauuguaacaaugccaugguuuacaguauauuucauaugaauaccugaaacuguuuucuugaguugccuucacaugcuauauaaaauuuauuuuauuauguauaauaugugaaauauugaucugcauaccuuuaaaacuuguaaaagccaaugacuuuuuucuacaguguuagguagauuuguaaacuguguuuuucagagucuguauuuuacugacuacaaaguuuucagucacuguuuuguagagggccuucuguuugggcuuuuucuuuauguuauuuuuucuuuuuuuuuuuuuuuuucccuccucuugagcagagagcaacugccaaacuuucuggaaauuuugcauguuuuuguuguuggaguuucuguaguuguuuaugaaagucuuagggauaagggggaagaaucauauaugucaaaucuugucauuaaguuucugcacaguuuuaaaaaauggugugaguuaguacaugcgcuagugauuaagugaguuuggaacucguguguaauguuucaaagcaaauuaagaggcaaaaaaaaagauucaaguugaauguuuaaagaauuuuuuuuaaaucugaguuagguuuuuaaauguuuauucugaauauaaaaugaaugcaugcuuaguuauggaaaaguugaaauaagaaaggaauaaagauaaauuuacucauaauuguaaagagaagcuaauucucucccuguuuuuaaaacauucccuuuuauucccucuagcuucuuaauucuguauguguauuuaugugacuaaggucaaacuguaaaugcauuuuucuuuuccuucucuuuuuaaagaguuaaaugauuuuuaacuuguaauuagaauuuauuacuuguaggaguccucaagcuuuuauaucauguuuuuggaagcaaccagcuaguuuaacgcacuucugaaaaugaaaggaaaacuuacauguuauaggagaguuuuuuuccccugaagaguuuuaaacuauuauuaaaaaaaaucccuaaucacauuucaucaccuagaauaguccuugaugacgacguguuuccagugucaauaugguuugguucaguuucccaugaccagcucaaguccaguaucugacugaggcaaagggcuuagggcuuacugcuuugggcacaccucaugauuuuuuaucuuugucucaacuguauuagguuugaaaacuguacuucuuuguacuuuuuuuucauuuuccauuuuuuuuuaugaagaguaacauccaauaaaacucuuaagcacagaguccuguuugaggaugaagaugugaauauugcaacaaccacagugcuugucugagaagugcaucacuuggugauaauccugagugcuuguucuuauuuugagaaauauaaguccagauuccacuauaccaaagacagauugggguggguaucaguguaagaccugagagaaauguaggcugugaaaaauggaggcaugccuauaauuuacuuuuuacuaauucauauugaacucaugaucaaauuggugaggguuuucacauuuuucuuuuauuuuuaagucaguugauaauuuugagguuuuuaaauauuugguagguucaaaaccaggauugccauuuuucacuguuguaaaaccucuugagaaacuuuaacccggagguaucuaugauugggccucugcugaaacuauauguaaaauaugaguucuuuucucagggaagagccuagaguuuuucuaguuucucauagggaucagugaccuaaaaggguuuuuuaauugcuacuguaauuaagaaaacccacaaaauuacuuuuuucuaaaauaugcuuuagaaagaaaauauagaaaguguaaaguagcaaaaccuaugaauuacgguaagauuuaaguagaaauuugcacaaacuuucaaagcuuaagucagcuauaaacucaucacaccuuuucuaaaagguccuuuccuuugauuuguaauaggaauuuauauuaguuauagaaaauuuggaaaauaaaaagaacaaaaauuacauauaaacucaucaguaaaaauuaacuaggcacuuuaggauauuucuuucaaacguagaugaauguguuuuuacauaauuuuaaagguuuuuugcuuugaauucacaucucauuuucuuagagcaaaagauuaguaaugagugaagaaacaggcaccugugauaacugacaagucuucaaacacauguguaugguuguuguagagagaacaguagaacagauuuuucuguccaggcuuacuauauauauauauccauugcacuguuuucucauuguugaaaaguuaaauugaagaaaucuaguagaauguuagcugcaucucucuuuagauaauuuuguuucauugacuugaaaaauuauguuuuuauaugcggguuaaucuugguaucuaugucuaauaguaaaguuuucugauggacucauaaaauauaaagaacauagauuauuucaucagcaucuucugaugacauaaauuccuugguauaauagaguuauaaaaaaggaauauaccaccauucugccugaauuuugugguacauuucaguuacuuauaucaauugaaauuacugaauauuuugccaugaccauuuagaaaaaaaguguaaugcuauugauuuaauucaaguacauuuaaauuuuccaugaggaguguuccuuuucccaccaaauugcauaaagcauaacaguauagaucccuuuuucaagaauuuuuaaauaaaauguaacuuuuaucaauuuguuuagauuguuuaaaaggauacuuugaaaaaaaucauuauuucuugcuuuaguaacuggaggacaucucuuuaucuauauagaauccaugcccaaacuuaauauuccucuauuuucuugauuuuagaggugaaaagccaggcauccuucaagcuaguggaucuuugacaaagaugcauugcaaaacaaucaacaaacaaucagaaaggcaugcuaugugugagugaugaucccugcagcauaugccauaggcuuguuguagaggagcugcucaguaaaugguggauucaauugaaacaagucuuuuuuggaugcuuaaugggaaguuguaggguggguaugauggacuaaaaauuauuucuaaagaagguuauauauuguauauauuccagaaucuuccguuuuuaucguuucuuaaauuaaaaaauaaaaauuuaacucugucccagguuaacucagauguuaacacuuauauagaaauuuuuuuccucuuuccccguuaggcaucucacaguauuuucugcuugucuguuuaggauguuagguagaggaaaagagagugauagaagauuuuuuuucuuaaaaaaaaaaaaaaaaaaaaaaaaaaacugggccaggcaugguggcucacaccuguaaucccagcacucugggaggccgaagcggguagaucacaaggucaggguucgagaccagccugaccaacauggugaaaccccgucucuacuaaaaauacaaaaauuagccgggugcgguggcgcgugccuauaaucucagcuacucaggaggcugaggcaggagaaucgcuugaaccugggagguggagguugcagugagccgagaucacgccacggcacuccaggcugggugaaagagugagacuccaucuccaaaaaaaaaaaaaaaaaaaaaaguucaauguuaguauuugcugucuauuuuaacuucuuacuuuaaaguaaaauuagcaaagucuuauuguuucaaccugauuuaaauuuuaucucccuuuuuuauuauuuaaagguuggagucuuuaucacuggccucaaaggauguagacuuuuuuuuuuuaauagagauuuuuauuuuugucagucacuuuuaagaggauuaaaaauguugaucccuuucauauuuccucgucccuuuaaaaauauucuauuaugacaaauuucaaacauauggaagagugaaucuugaucaccuaucugucuguacccuaauccguuaauccauuuuuuucugaugaauuucaaauuaaguuguggacaucuguguauuucaccccuaaauacuugagcauaucccucauuuaacuugauuucucucuuacuuucuacaauuuuaugcaaaugagcuguuucccauagguucugucuugaucuuaauccuuuaaggguaagggcuaacuugugguuguguuaauggucuucaucgcugcugccuauuuuuuuuuuuuaauuuccuuaaaacaaaagguacucucaaaaggcauauugcacaugauuagcaagauucagaaggaagugguuaaaguuucuuacaugccuuauaccuaugcuuuuaguucuuguuuuguauaaggaauguugcaugaggauauuggaaaaaaauuuaaaauuaagaguugaaggcggaaccugaucuauaaggauccauuauguugaagccaaagaagcaggucuagcuauucuaaguaaguaggcuggagagguguuucuuaacucuaucuggguuuuguuuuccauuugaagaaaaauuauuuuaagcaauuaccauuuuugauuacuguaaugacuccuguguccaaaaauuaauuacguuucuaauuauuaaaauagaaaaaaaaaucuguucaaauuuuguuauaaauaaagaccccagacuuaaccucaguaaugcauuaguucuuagcauaacuuuugcauuuucuguugcauaggcuuugugaucuuuaacaggauuauuuaagccugaaauaauagagauacuauuuggagaucacuguuugacuaagcccugaacauuuccacgaauguagccuuuagagagagaggguuccucaagcuguaguuucuuccagagacauugcuugacuccuccuggccucccuucauaaaggauuucuacaugggcugcauuuuaagugaucuucuacuuuuguauuuuuagaaaauaauucaaaauuuauaaauagcaacucuaaucuuaaacugcucuccaguauguccgcauuuuuauuccagagagaauuauuaauaaguugaaaacugauuauauuugacuugaaauauugacauugaucucugguauugccuguuuuugaacguacuguucuuuuaauguacaaaauagauguuuuuugugaggaaguuguuuuuuuuucuccuaagcauuguuaccaaaauaagacuuauugaauggugacuuuaauacuagcuucuuaauauucauagaaauauuuagauaucuaggcugguguauuuaguccuugagcauuugcagaauuacuuaucugaaacauaaauaagcuguuaguguuauguuauuaauagugaguguugacugucuaggcacuguaccagucaguccuauggagacauucucccauugauugcucacaccaguccuguuuccaaagccccugaaugguuacauucagcuguacugucuuucagcaaguuauacuauuuguaucaaauugguuagugaaaucuuguagguaauagucuuucuugaaaguuuuggaauugauguuuuuugaugcuucaugaaaaaaaugaguuuugaguuuuggaaccaaaauaguaguugcuccaugcugggcaguguguuagaccuuuuauauuuaauucuguugaaccugugagauaaguauuaguccaauuuugccauugaaguuacuaagacuaaggugaauuuguguaaauugcauguagagcuugggauucacucucuggucugacuucaaagccauguucuuucugguacauagccuugugcaugaaguuuuuuugccauuuuauccauauaaaaauuuuccaggaggaggauuuuugccuuaaacaaaagaauaaaacauguuucguauuuauuuauagaaaaggauuuuuuuuggggaaaguuauaaagcaguugcacacuagaaaaugagaaagcuuucaugaaggaaugcaggucagaagaccuagcuagguuaaacucauugcuuaccucaucuugauagaggagaucuggcuucuugcuaugugguuuuuccaucuuccuucuacuuugucuucuguaagagaaaaauacugauaagugacauuuauuauagguuauguaaaauaauauauaugugaaauuccuuaagaucuuaagacugagcuaauuuuuuuuuauuaauuaugcuacuguugcuucagggaacuaagcaguaagcugaaaccaauucugugauguuugucauuuauauuaucuggagaguuguuaccuacauugcaguuuauccugauuucaauuugacaaugucuacauguucuuuuaaauuacuugcugaguuggugaauuuuuguuucuguuauuuuuaaaaacugacaacauccuucugcuuaaaaaaaauucagugcuguaguuuugcuugcagccuguaucuuagcagggaacccuuuggaaacccagucuccagagaaaguuugacgggcaucuuggcauaggcugcugccugguauuacucaaaaagaagggcuguucauuuccagcagguguuaagagcugaguaaggcccauagcauggaaauacgaucaucucugccccuacagaguuacauauaccuuuugguuguuugaaauuacuuauuugguagcucuguuugauguaacaagaaacagacuccuaggccaaauugaaacgccuuuuguauuaucucuacuuaauuucuucuacccccaguugauucucucuuaccuuaaucacauuauuaugaauaauugaagagcugaugaugcauuuuucagccuaagguuuucugaugaggacuaaagcaucugaucaaauuucauguucaugauuucaacuucacagccaguaucuauucacucaaaagcuuuauuaaaucucuucuuucggccgggugugguggcucaugccuguaaucccagcacuuugggaggcugcgguggggggaucgcuugaagccaggaguucgagaccagccuggccaacguggcgaagaaaccuaaucucuauggaagauacaaaaauuagcugggcguggugucaugcgucuguagucucagcuacucaggaggcuaaggcaggggaaucacuugaacccaggagguggagguugcagugagcugagauugugccacugcacuccagccugggcaacagagagagacucugucuuaaaauaaauaaaucucuucuuuuuucaucuugagucccuucuucucuccaaauaucaggcccucuuuuacugucucccuuaauuuucacauuuuauuugguccagauagucuuguaucuuaaaaaacaguaauucucaaaauuugaguauucugcuucuaaaugccagagucccugaagagucuuaauucuucaauaaauguaugguagaauaaugccauugcuaaacuguauaaaaacaggauuuuaaaacuaaaaauaaaaccacauuaaucuugaauuugcuaaaauuauguuuuugauuagcuuguuuuaugauaccuggccuacugggccucccaaauugcugggauuacaggcgugagccaccacacacgacugaaagaagagauuuaauaaagcuuuugagugaggccaggugcaguggcucacgccuguaacucuagcacuucaggaggcugaagugggaggaucaugaggucaggaguucaagaccagccugaccaacauggugaaaccuccucucuacugaaaauacaaaaacuagccuugcaugguggcgcacacuuguaaucccagcuacucaggaggcugaggcaggagaauugcuugaacccgggagguggagggugcagugagccgagaucacgccacugcacuuuagccugggcgacggagcgacacucugucucaaaaaaaaaaaaaaaaaaaaaaaaaaaaaaaaaaaaaaaaaaaaaaaaaaaaaaaaaagaaaaaucguuaauaauguguguauuugguguuuucugucaacaggaagaagguagauaaugacuauaaugcccuucgagaaagacucagcaccuugccugauaaauugucuuauaauauaaugguauguuugguguguuucuuuuaaaguaauaguuguuucuuguaaacauauuaacuaugugucgguucacagaaugucaggcugauggacuguguccaagguaacuauguagcaaggaagauuuguuuuguuuuacuuuauaagaacacaguaauuguaguaauuguugguauuuaccuuuuuuuuucagaauauauauggugacacaaaugacauaaauauuagcacaaaauuggacauauuucaaauggaaacuuacuauauaaaaaauguaauuaugacagaaauaugguacuaagucguuucuuguuagccagagcaggaauaggccauaauguuuuguaauucacagaauuaaaccuuaggacauugauuuuuauauaaaaacgugcugcuaauuuuuguuuuaaugaucuucacaucgacauagugaucuguucaugagcccuggauuagagccuuucauugcaugaauguucuuucuuaugaagacuuuguucuuuuauacuaguccaaguauuuuguauauauagcuagauagauccauuaaagcuauuuguuuacuaauuccugcuuugcaaaagugucuacuuuauugaaaauaauuuuuaguuuucuuuaucaaaaguauuuugcauugacaauguuucacuacuaguugcuuucacuuagauuugcaagugaaugaaaaguauaaacaugccgagacaguacuacuuucuuuaagagcuauauguaaauaugguguggauuuauuuuccuguuuuaacauugauuuaugaacauaaagcaauuuucuuuagauuuuccuaguaaaauuuuaauauaguguugaauuucugugaagcuggcauuuuauuuuucccaauguauaaauaaaaaaauucaguuauguaaggcuuuuaaugcgaaguguuuuauaaaauguacuuuucaguguuuuauguuuuuucccuuuuuucuuuuuuuuuaaacaauagguaccauuuggcccuuuugccuucaugccaggaaaacuuguccauacuaaugaagucacuguuuuacugggggacaacugguuugcaaagugcucagcaaagcaggcuguagguuuaguugagcaccggaaagaacguagguacccauuuuaaaugauguuucuuuguuguauauguauccauucacagauugccaagcugaagggcuguuucuuaccaaaaguaccuuccgugaucuaugaauccaggcuguuugugauucuguugaauuguagguaguuugaguagaaccaacauuugagaaugagcuggagaauggagcauccggguuggaaaugucaccuacauuggcauguuuucagaaguuacaaaguuucaaagucauuaugugauuuuguaguuagaaguugggaagacauaaaaauuggagucauuuuauaccuuauaauuuuuuuuuaguugcuauuauagacuuauuuuugcacuuaauacuuuaguacacagaaauaauguguuuucuccuuagugaacuaagagaaauaccuguuuacauaaguagacaauucuuaaaaaugcuuuuugguuuggaaaaaaaaccauauuuucauuugauagaggagaccaggugugaaaaggugcuaccuaaaacagcacccuuauccuuuuucaguuguuugaguucucugcaucccuuuauuagggcagcucuugaguuuuguuuauccgugcuauuaucuguagguguauagaagccuacauacacacacacaacacacacuacacauuuugcaguuggaugagcuagcuuggguucuagcuuaguuauauuuuaaaauuagguucaguuuauaaucuguuguuauuucuguaauacguauuuagauugagaguauaauauccgcccuaccugcuuuuuaaccuuuuaguuaaauguguauuugaaaauaaaugaugggaagauccuuuuuuauaaauaaggucauacuaaacagaaaacagcugaguuuucuaaagcugaacuugauuucacuuauacaugaaugaguacuagagaacucauuuacucagugaaauucugggaacuauauuuggagacucuaauugcaaaucaacuccuauaaguuuauaauugauauauauuuugaucuuuugugacacuaaucagaaucuuauuguuaggccuguauguaauuucuggcaaugauaaaucuuuuggcuuugcugcauuauuuuugucauguauauuagcgaaagagaaugggcauacuuuuuucuuaaagaccuuacugaagacgaagccucucuuuauauacugaaguagcucugauguuaugaaaugaauccauagccuguugaaguuuguucacauugauuuucauauuucagugaaaaaaaucuuuauaauuaguuauaacuuaaaauauuaaugggaauacuuauacuacaauagaauagagcucuagaguagagaaacauguuuuuguaaaucacuuucuaguaguuaaauaugguuuuggaaagugaccaaacauagaugacuuuugggaucaauauuuaucuaaaauaauuuucaaaguacauauuuccuguuacaauaaauucugggccgggcgcaggggcucaugccuguaaucccagcacuuugggaggacaaggcagguggaucaccugaggucaggaguccgagaccagcccgaccaacgugguaaaaccucgucucuacuaaaaauacaaaaauuagccgggcgugguggugugugccuguagucccagcuacuugggaggcugagacaggagaaucacuugaacccaggagguggagguugcagugagcugagauugugccacugcacuccagccugggcaacaaagcgaaauuuugucucaaaaaaaaaaaaaaaauuacguaaagcucuuuuauucacaugguuuuauaauuuauaccugaagaaaauacuuagguauauuguuguacuucacauuuauuaagaaaagguacuuuauuuuucuuaaggcagaggaaauauaaccaguuaaacacauagucaucuaugucaugguugauugggguaauuggggaaggucugaguuacaacacgggucaugauuuguuuagccagcaccacagucaggacacggaauaggauacaagauacugcucucaggacucagcuccuaucaaaaccucccucacacugccccuugguggucacacccuacggcugccuacugcugaaggauugacgacuucacgucugugucuuuugagauuagcuucuucacuugcuguaacgccucauccaggugguucuguguauucaaaguucauuucuuuuauugcugaggaguguuccguuacaugcauaucuauuaaaugcacguacagcaguuuuuccauucaccuuuugagggacauuugggugcuuccauuuuuuggcgguuaggaacagagcugcuguaagccuuuguguacagguuuuugugcgaacauacauuuuuauugcuguugguaaauaccuacaagugagauuguuagaucauaugauaaauguauguucaauuuuuaagagacuaccaagcuguuuuccaaaguggcuguaugauuuacaucucuuucagcagugugugauagugguaucuuugcgucucuaccagcccucaauauugucaguuuaagaaguguagccauuugaauagguguauagugauuuuaguuugcaucauugccuaaugauguugagcauugauucaugcacuuauuuuaucuuuguguccucuuuuaccuguugaacucuuuugcccauuuuaaaauauuggguuauauaugcuuuuuuuuuuuuauuuuuugagauggagucucacucugucgccuaggcuggagugcaguggggcgaucuuggcucacugcaaccuuagccuccgagguucgagcaauucuccugccucagccuccugaguagcugggauuacagacaugcgccaccaugcccggcuaauuuuuuuguacuuuuaguagagaugggguuucaccauguuggucaggcuggucuugaacuccugaccucaggugauccacccgccucagccucugaaagugcugcgauuacaggcgugugccauugcaccuggccuggguuauauauuuucuuucuuuuuuuuugagauggagucucacucugucgcccaggcuggagugcaguggcgcgaugucaguucaucgcaaccuccgccucccggguucaagugauucuccugcucagccuccugaguagcugagauuacaggugcguaccaccacgcccggcuaauuuuuguauuuuuaguagagacaggguuucaccauguuggucaggcuggucuugaacuccugaccucaugaucuguccgccuugugguccacccaccuuggccucccaaagugcugagauuacagguaugagccaccgcaccccgcugcauuguauauuuucuuacugucguuuugagaguuuuuuuuuuuuuaauauauucuggauuuauguuaaauaggugaugugcaaauauuuucucccacuuugcaucuugucuuuucauucucuuaacagugucuuuccagagcaaguuuuuaauuaugaaguucagcuuuuagcuuuuuuuaauggaucauauguguggugucauaucuaagaacgcuuuaccuaaccuuaguuguugaagauuuucuucuguguuuucuucugaaaguuuuauacuuugauauuuuacaauuagaucugugauugauuuuaaguuaauuuuuguuugaggugugggguuuaggucacgguucauuuuucuugcauauggauguccaguugcuccaauacuauguugaaaauacuguucugucuccauugaaaugacuuugcaccuuugucaaaaugaauuggcaacaagaccaucuuagauaccacacuaggaugguuauaauaaaaaagacaguaacacuuguuggugaggaugugaaaaaauuggaacccucauucauugcuggugggacuguaaacuggggaagccacuuuggagaacaguuuggaauuuuucagcaaguuaaacauuguguuuuacugugaucuagcaguuccacaccuagauaguauucuacccaagggaaauaaaaauguauguccacaaauacuuguacaugaauauuaagagcagcacugcuuauaguagccgaaacauggaaacaaccuaaaugucuaucaacuaauaacaggugaauaagugucguacauccaugcaguggaauguuguuuggcaauaaaaagauguguaccuugaaaacauuagaauaaauuaaagaaaccagucacaaaagaccauauauuguaugauuccauuuacaugaaauauucagaaaagguaaauuuauaaaagaaaggagaguaguggcugcuuagggccaggaaggugugagagagaauggagagugacugcuaaagaguauggagauuuuuaggggcaaugaaaauacaaaaauacagauuuugguaaugguugcacaacccuuugaauauacgaaaaccaucaaauuguacauuuuaaaugggugaauuguauguuaugugaauuauaacuuaaauuguuaaaaaacaaaugaaugagccauuuuguguaauuguguuuuuggaccaucuguucuguuucuuuaucuaugugucugucucuuugcugaugccacucuguuuugauuacuguagcauuauaguguuccuuacaguguuccuuaaaguugguaguacgggugcucuaaguuuauucuuuccaaauuguuuuggcuguucuaccuccuuugccuuuccauauacauuuuagaaaccacucgcuuauguuuacaaaaacuccuagugggauuuugauuggaaucgcacuaaaucaacacauuaauuuggggagaauugaccucuuaacuauuaaaucuuccaguguguaaauacuuacagccuguaaauacaguguaucucuguauuuaggacuucuuuaaucaguuuuguaguuuuugagcauacaggucauaugcguuuuguuagguuuauaucuaaguguuucaccuuuuguggagcuguuguaaaugauggcauuuuaaaaucuuguuuuucaaguguucuaguauauagaaauaacucuuuuuaaaaaagaauuaacauuguauccuccauucaugcugaccacauuuguucucugaacuuuuuugggguagauuccaugggauuuucuauguagacaaucaugccuuuuguaaauagcuccuauuuuuuuuuauuccuuuccaagguguauacacuucauuucuuuuucuugccuuacuuccuuggcuaggacuugcaguauaauauugaauaggagugguaagaguagguaggugucuuugucuugaaacugaucuucuggggaaaaauuuggcauuuuauuguuaaguguguguuagcuguagguuuuuuaaaaaaauuaauacucccuauaaguuuagggaacuuucuaccugguucuaauuugcggauuuuuuaaaugaaaauauguugaauuuuguccaguguauuuucugcaucuauugauaugaucuuguaguuuuucuucuguaucuguuaaugugguggauuauauugauugauuuuucuucccuggaugaaccgcauuugaucaugguguauucuuucauguauuacuggauuugauacauugagcuuuuuuuguuuaauauuugcauggcguauauuuuuccauuucuuuuacuuuuaugcuaacuauaucauauuuaaaguggguuucuuuuuuuuguucuuuugagacagagucuugcucuauugcccaggcuggagugcaguggccugaucuugacucacugcaaccuccaccucccaaguucaagugguucucccgccucagccucccgaguaguggggauuacaggcgagugccaccaugcccagcuaaucuuuguauuuuuuauagagaugggguuucaccauguuggcuaggcugaucucgaacccuugaccucaagugaucugccuaccuuggccucccaaagugcuagguuuacaggcgugagccacugugccuggccuaaagugaguuucuuauaggcagcauggaucuuuccuuuuuaauugauucugauaauuucagucuuuuaauugauguacuuagaccauuuacauuuaauguaauauguuuggauucagguuuggcauucccccguuuuuguuccucuuguuacccuuucuuguccucuuuuagauuauuuaauauuuuuaguaucuuauuacucuguuguugcugaaauaggaacuucuuaaaguauuuuuaauguuacaaauuagggauuaauguauuucacgugaacuuaaaaguuuuacucuaaauacuugcuuugagauuugcugaauucuuuuuuacguuagagagcaauuuuuggcuuagaaaggaguacaucuucaaugagacuaagugaaaagaccaggauuuaaucagagguuucuacaguauagacaaguuuuugguaauuuuguuucugcaugucucuguaaucuacuuuugaacaccgguauauagaaugacuugaaauucuaguaucuaggcaccaugucuuagaauuuuuggcugugacaacaggcauuuggccacauuucuagucauuaguccagugauuaauguuaaacaguuuuacuuauaggaugaucuuaauagauuuuccuuucaaagauaauauggggagaauuauuuuaccgugugucuuuuguucagaauuguaucugacacauuuauuuuaucuuauuuuuacuuuugucuuaaaaaugcauacuuagucuucauuuuuacaauaaaguuauuuuuauuaaauggaagaguggacaugaagggauaagagcaugaacuagggguaauggcuauaggcuuagagaagagaucagaagcaggaagaauuucugagccugauaggacuuggcaacugauugaaugugaagguugaggggaagcauuggaugaguggugaccuagaggcaauguuguugacauaaucaaguaaguuuguagaucacugcacacuacuuucccucuaccagagaguaaaaugcacauaggcacguuacuuagaagcccuguaaugaaaaauaucccuuuagucuuguuuaauguugugguucccaaacuuacuugauuuugagaaacuuuuaaaauguaaugucuguuaucuuacagagcauucuaaagaaaaucuugauuuaggaauacauuuuuaggcagauuucagaagaaagugggugauaagacguuagcaccgaauacagcuuuuuuuuuuaagugauaggagaagaaagauuguaugaggugcaucaggucauucacaagaugggcuuuuuuaaaaauuauuuuuuuaguagguuauauauggacaugauacaaaaucuaaaggauauuuauuaaaaaacaacuaugcuuccuuuucuuguucuuuaacauccaguuuaccucccuggaggcaucgcuguuaucaguaucuuacucauuauuccagggauauucugugcauuuacagccauagacuuaugcauuccuaccccacccuauacaccuccacucaaauuguaggcacacuuuuauuuuuuuguuuuggcagcuugcugucuuauucuuuucauggcuauauaguauuauauuguacucuauuuagccaguccuuuacugauaggccuuuagaucgucuuccuuuuuuuuugcuguuaaaaucaaugcugcagugaauaaccucuguguguauguguguguguguguguguguaucauuuguacuuguguguaucuguaguauaaaugacuuaagauacaauugcuggcaugaagugaaguagauuuuuaacuuugacagugcuggcuuuaacagacugacuacaccuuugccaacccaauguguuugcaaacuuguuuugaaacugauaccuuauuguaggcccccuggcacugcuaacuagcuaacuuacugucuuuuccuccuuuuccuccccuccccucccuucccuuccccucauucacaugguuggucagcuauaaccaccauccaucuccagauauuuuucaucuucucaaauuaaaacuguaccaguuaggugauaacuccccauuuuuuccuuccuccccccauccccugguaaccacuauucuacuuuccauaugaauuuggcuauucuagauaccuuacauaaguggaauccuacagcauuuguccuuuugugucuggauuauuucacauagcauaauguuuucuagguucaucuguguuguagcacgugucagaauuuccuuuuuuuuaaggaugaacaauauuuuauuuugugaauaaugugaauuauucuguucgcuauugugaauagugcugcuaugaauauagguauacaaauauuuauuuaguucccugcuuuaaauuauuugggguguauaucugaaaguggaauugcuggaucauauggaaauucuguggauuuuuuuuuuuuuuuuugaggcagggucucacucuguugcccaggcugggagugcaguggugcaaucuuggcucacugcagccuccgccucccagguucaagagccuuccugccucagccuccugaguagcugggacuacaggugugcaccaccaugcccgacuaauuuuuuguauuuuuaguagagacaggguuucaccauguuggccaggcugaucuugaacuccugaccucaggugaugcaucugccucagucucccaaagugcugggauuacaggugugagccaccacgcccggcccuauguuguauuuuuuaaggaaccuccauucugucuuucacagcagcuguaccauuuuauauucucaacaccaaaauacaaggaauccaguuuucccacauucuugucaacacuuguuacuauauuuuuuauauauaaaauaaauauauuuugaaguggcauaucaucaaggaauauaguuugaaguggauuugaagugaaguaucagcaggguuuugauuuguauuucuucagugauuaauuauguugagcaucuuuucauguguuuauuggccacauguauaucaucuuuggagaaaugucuauucaagucuuuugcccauuuuuuauuuggguuguuuguuuuucuuguucaguuguaguucuuuauauauucuggauauuagucccuuaucagaaguguaauuugcaaauauuuucuccuggucuguugguugcccuuuuacuuucuucuuuuauuuugucuuacuuaaaaaaaaaaauagcugccagguagagugcccuuuuacuuucuugauaauguuguuugaugcacaaaaauuuuuaauuuucacuguccaguuaguguuuuuuuguuuuugccuaugcuuuucaugucauaucuaagaaauuguugccaaaugucaugaagcagcuucccuguguuuuuuuuuuugaguuuccuagauuuagcuuucauuuagguugcuguauccauuuuauauaugcuuguaagguaaggguccaacuuuauucuuuugcaugugguuccaguuuucucaacacgauuugcugaaaacacuguccuuaccuuuuugaaugguuuuuacacucuugucaaaaaucauuuggucauacauuuaugaggucuuaugucugagcuuuguauucuauuuuuugguccguaagucuguauuuauguugguaccacauuauuuugaugaggguagcuuuauaguaaguuuugaaaacagaaagaugagacuuacaacuuaguuuuucuuuuuaaauauuguuuugguuauuggggaacccuugagacuccaugugaauuuuagaaugggcuuuucuguuuuugcaaaaaaaaaauuacuggauuuuacugggaguugcacugagucuguugguugccauggguaguauugacauccuaauuauuaaauauauucacuccgugaacauaggauaucuauuuauuugugucuuauuuguuuuagcaacacuuuauaguuuuuagugugcaagucuugcaccuucuuaagaguuuaguccuuuugguucuaguuuaaaugaauugcuuacaaauuuccuuuuuagauugcucauuguuagugcauagaaaugcaguugauuuuuguguguugauuuugcauccugcaacuuugcugaauuuuuuuuauuagcuuuacaaggguguuuuguguguguguguguguguguauucuuuaggguuuucugcauauuacauauaagauuguaucauauguugguaguagagagaacuugacuucuuuccaauuuggaggcuuuuuauuuguuuuucuugcuuaauugcucuagcuagaacuucuaguauguuguugaauagacauguucauagugagcauccuugucuuauucccaaucuuaggggagagacucgcagucuuucaucauagagugugaugucagugugggguuuucauauauggccuuuauuauguuauggaaguucccuucuguuucuaauuuauugaguuuuuuuuuuuaaucaugaaagguuguuggauuuugucaaaggcuuuuuuggauucaaucgagauuaccauguuuuuuccucuucauucugcuaauguaguauauuacauugauuuuuauauguugaacccauccuugcauuccaggguguggcagagaucauucuuggucaugauguaucauucuuuuaaugugcuaccguauuuaguuugccagcauuuuguugaggauuuuuauauguauauucauaagagaaauuagccuguaguuuucauauuuuuaucuggcuggcucacagaauguguucccucccuuuucauuguuuagaagaguuugagaggauugguguuaauucuuugaauguuugguagaauucaucugugaaagcaucucuucuugguccuuucuuuguugggagguuuuugauuacugauucaauaugcuacuuguuacaagucuauucagauuucaguuuugguaguuuguguuuuucuaggaauuugucuauuuuaucuaaauuaucaaacuuguuggcagucaguuguuuguacuauuucuguauaaucccauuaauuucuguaauaguuuuuauuguuccacuuuuguuugugauuuuagugauuugaaucuucucuuuuuuucuuagacagucuaauaaagauuugucaauuuuguugaucuuguaaaaaaccaacuuuugguugcauuaauuuuucagcauuuuauaaaaauucuguuuuguuuaucauucucuaaucuuuguuauuccuuucuucuguuagcuuuggguucaguuuacucuuucuuuuuuuuccaguuucuuaaaguguacagugaaguuacugauuugaaguauuucuuuuuuuuugauguagguauuuacagcuauaaauaucuuucuuagcauugcuuugcugcaucccauaaauuuucguugaguuuucauuuuuguuggucucaggguauuuucucuuuucuuuugagacagagucucacucacucuguugcccuggcuggagugcaguggugcaauaucggcucacuguaacuuccaucucccgcguugaagggauucuucugccucagccucccuaguaguugggacuacaggugagggcuaccaugccuggcuaauuuuuguauuuuuaguagagucgggguuucaccauguuguccaggcuagucuugaauuccuggccucaagcaaucugccugccucggccuccuaaagugcugggagccacugugcccagccauauuuuuuaauuaugccuaugauuucuucuuugacccauugacagauuauuuuguaaaauuuucauauauuuaugacuuuuuccaauuuuccuucuauuaaugauuuuuaauguuauugagcauuccaguuagaaaagauacuuuauaugauuucaaucuuguuaaauuuuucgagacuuauuuuguggccucucauaugaccuauccuggugacuguuccauguuucccuuagaagguguguauuuuuccuguuguuggguggagguuucuauauaugucuauuaggucuaauuggucuuuagugguguucauguucuuuauuuccuucuggcuguucuguccuuuauugaaaaggggauauucaugucuccuccagcuauuauggugaaauaauuucucccuucuguucuguacauuuuugcuuuguacauuugagcucuguuagguauguauguauuuauaauuguuguaucuugauagauugaaccuuuuaucagugugaaauauccuuugucucuugugacuuuuuuaauuuaaagucuauuuugucugauacuacuauagcuacuucauuucuuuuuugguuacuauugguauggaauaucuuuuucauuccuucacuuucaaccuauuugugcccuuagaucuacaagugagucucuuauagacaguauauaguuggauccuuuuuuuaaaacaauugauucugccaauuuaugcuuuuugauugggaaguuuaaucuguuuacauguauaguaauuacugaugggggaaagacuuucgcuguuuuguuauuuucugcauguuuuauagcuuuuuuuugacucauuucuauauuacugccuuccuuuguguuugauuuuuuuuuauggugaaugguuuugaucuccuuuucacuucuuuuuaaaauauagguauuuucuuugugguuaccauggcgauuacauagaacauccuaagguuauaaaauguauuuugaauuuauaccaacuuaacuucaaucacauacagaggcuuuauuccuguucagcuccuucaccucuuuauauuauuugugucacaaauuauaucuuuauauauugugucuccauuaauauagauguccagugauguguauucauuuuucuuuaucacauagaaaagaaaaaaguggaguuacaaaccaaaaugacaguaauacuuauuuuugccuauguguuuaccuuuaucagagaucuguguuuucauauagcuuugaguuacugucuuuucauuucuacccgaagaacuuccuuuagcauuucuuggauugcaggucuaguggugaggaaugcccucaacucuuguuuaucugggaauaucuuaaauuuccccucauuuuuaaaagacuguuguuuugcuaaacauagaauucuuggaugaaguauuuuguuucucucucagcacuuuuuaaauauaugucaucccauaaccuucugugcuucaggguuucugcugagaaaucugauaaucuuguugaagauuucuuguuugugaugagugguuuuucucuugaugcuuucaagauucucucuuuguuguuguucaacaguuugauuauagugugucuuggugugggucuggguuuauccuacuuggauuucguugagcuucuuggauuuguagauucguaccuuaucaagcaauguguaugcucuugaguaucuccaauaaggcauuucaaaauacaaauuuaugauuuuaguuuaugauagauguauauagcuuuaaauaaccacaaaccaucuuaagacguuauuuaaaaaaaagagcagcauucacuuaucccuuuuggcucacaguucccauuccucagauguaauuacuuucuguuuuuggcuauuuuuacucugcucuuuuuauucauauuuuccagugguuggcauauccuguuuuuguuuacuucuuuuuuuuuuaauuuuauguauuauuaacuaccugucuauaauuuaagaggaccauguagcauuuuuacauguccucccugucucugcuucucuaaucuuuuugcuauuguuguaucacaauuuuuguugaaucaguauucaugcuuagauauuauguaauuccauuuuguucuuguacaggcuuuuaguugaauuuaacugcuuuuuuuguugcauaguuuucuaugugucugucauuaauucagucagauacuuuuuuuguuguuaaaaauuuuacugcuggagucuuucauugucuugcuucaauuuggacuggcuucucuccugaucaaaggagagccgucuuccuggugucuucuuacccuguuuuugccuuuuauuuauuuccuguuuucuguuucccaaagcacccuuuuuucagguucuauuuaguuuguuggaauauugcuuuaaguaacuuuugggaaccugcucggagguacuucuuugaauuuuuauguaucugaauaacucuuauauuccuuauacuccugcuucuuauuguuaaguagacuguuuagaauucuaggucuuaaguaacuguugcccucagaauuuuggauacauuauucuguuaccuccugucuuuaaguguugcuauugaaaaucuugaugcuauuuucguuuucuuuguauauaacuuguuuuuuuguuuuuaaagcuuugagauuccuuuuugguccuuauuccccaugaucuggaauacaacagugguacaccuugaagccgugcuauggauccuuuaaaauuuguuugcuagugcuuaguaggccuuuuuugaguggaggcuuaaguccuccagccgugggaaauuuauauuaguaauuugaaaauuuccuuuucuuguugccuauuuguuuguccuuguuguaauuuuugaagugauuucuucugcauacucuuuuaaaucauguauugacuuuaaaauuuuccuguacauaguuucauuucuggaagcacuuuuuuuuuguucuuuggcuguuucuuuguuacagcauccuguucuuguuucauggauggagggucuuuuuuuaaggaguauuuguuuuuucuuuuaaaguuuucaucuuuaaacauuuccuccauguuucuuuuuucuucucccucuuuucucucuugcucucuuuuuuuggucucuagcauuaauguucaagaauuucuucaaaugucuggugauccuuggcuaaccauuuauacuugcguugaguacugucaggaagcucugugugcauaggcaagguuuguugacugauagguauuuuuuguagggauuuaagguagcaagcugauuuauuuauuuuuuuuaaauugagcaaucuuuaaguaucagcagauucuacaaaagagucuucugaucuucuucaucuaguguucugagaaccaggcugggcguuucaagguucaguauguucacuuggaauuaauccuccugguuucacuaagacauuuucuauucucuuuccacuucccuauucccuaccaucucuacaaaccacucuaagcugugaaucuuuuguuuaagcaagaaaggagaaaccuuucuugugagauuaggguuuggggaccuguucuuuucaaacuuuuaucuagaucuuugguuaaaguucacucuucuuuuggaaauacucucaagugaauugccuuuuccagguccgauaucccagaucgacuuguaguagcuuuucccagccacaguuagguuccauuuuuuucuguugugcaaaguccauuaucaguugugcaguuuccaaaauuugguugacauuucuugucuauuuucucuucaaauguauuugucuuuauggguuuaugccuuuaaaaauuucuuaguuguuacuuuaccuaagguauaggggaaaggcaaauacuaaguacauguauucaaugugcuauuuuaaagcagaaguccaaaccuuuguacugguuuaagaaggaguacauccuguccagagguuugugaguauuuccaccagggggcacguccuguugaagcugucgaaagaauauuuaaaaauuccagcacacaaaagaaacgagguugagaauagaguggucacaaaggauucaguagagaauugcauauuuacaggcuucauacuauucaguacauaugaauauauggcuaaguaaaaaagacuccuuucacgaaugauguucauaacuuuuauuaguguuuugcaaauaauuuuuauuacaucugcauuucuguuccuuucaaauauauacaauucuacaaacuguuaacuaaauguuucuaaauauuuggucuuacuuagugaguaggcauaucguuuaucuuuaggugaaaaugacugcuuaaguucuuaugagguuuuaaauuuucuuuuuugguuuaaacaugucuuuggaauuugcacuguuaauuugcuuuaagucuccuuuuucauagcuaacucaaaggauuucagccaguucuggacaaagauucugaauuagugaagacuuuaaaauauuagcuuaugcuugcugcacauuuaaccugcagccugguuuugucagcuaaauaaauaaaaacuauaccucauucuauacuucugaaauccuagaaaauuuaacuucugauuuuuaguuaaaauaaccuguguuugaaaacaaucuucuguccuucaaauuacuaauuuuuuucuucaauuuuaguuuuuauuuuuugggguggggggaaguaucuguggagaacugucuuuuguacauuuucacagcuauuucuuugaucccauugaauuuguuuucuuuuuucuauaauaauugguaacuaaaauguuugagauuaaaaugaauacagauauugucuauaucacaaaguauauuucuuuuucucucaguaguguuauuugcuauaauuucagugugguuugaaauuuugcuuaauuagauuucaacuuagccauguuuggagcguuaaaauugauugagucuguuuaaaugauccauuuuuagugacauguauauuucaccucuuaaaauaaauuuuuggagaauagaguacaaaagcuuuagugaaaaauguaauagcaugguuucuaauguuaaaucucagaguuauagaaagaaauggaauuaaauucucauucugcuuuuuuaacuguuguucuuuugaaacaaccuguagauacgaauuuagacuuguuauuuacuuuguacaaaaucgaaauaggugcuuaccauucugcuguauuuuauguuauugugagcaccagguucguuugccuugcgguugcccagcuuucuuuugucuugucuuaaauuuucuguauagcuaucuaauuuuuuguugcucuaggacauaggacuuaugauaauuuaauagagauauauaucugcauauauaauguguaugugacgguguuggugcuuaucaguuugugguauuucugagauucugauauaaaguauaugcuuuugagaucugauuucuuaaccuugugauagugguuuauauuaauguaugauucagaaagcuuucuugaauuuaaaaauggaacugugcaaucguauuucaguuuuucauaauuacccuauuuccaaaacacuuuguuucuuaaauggaauauucacacaacuuuuucuuacaugcgugaguuaugaugaauuuuuuuuaaagucaacaauaguugauugaaaguaacuccuauaacaucagugaacaaucaauucuuuacacauugacaacccaaggcuuucacugauaccuuuagcuuaguugcacaguauuuauauguggauagacuuuuaaaaauguacuuagcuuaccuaccugccauuuuuaauauuuuccagucuucuugaaaaaaguuauugauuugaccuccuaccuaaaauaauguucuuuagaucuaaagcugguuagacacauuaucugacugaguuuacugaagcaaaaacauuccauaaccuuaaccuuuucccugacccccugcuuuuaacaacugccgacauaguuuuaugcuguuaugugaccaugcucggaugaaaucugucaaacagcuccuugaguuauuaggcugucugagucugaccuuucugcaaucaaagauauaugacuuaagggcucagauuugccauggcaaccgguccaauuugcugccgugagaaaaggucuaauuguugcagaaauuuaaugaucuagagcgacaucagggcugugagauuuuaugaacuguuuacaccguaauuuucauuuuguuaaugcagucuuuuuuuuguaacccauucauggcuagagcauaagugauuguguuuuauuuaaaauagcauugcauagcaugagagccguaucggagaacaugugccacucucgagaagcccuucauauguggugauauuucacuuuuaacucccuuccuuauuuucauucuuuuaaaagauauuuuaacugcuuagaccuuugccagaccugcauucaucauugguagagaaagaacuauguacuuuucuccuccauccucuucugaucugcuuacugauugagugccuguuguaaaacaguaggaaaucacagagcaucugggggaggagguaucauaucacugucuauuauucuuuaucagcgcuuggccauaaaaauucuguauuuggagaaaaguaggauauuguucagcauauaauuauaguuagaaaccccauguauuuuuuagauggugccauuuacugcuuagcagagauuucuacucugauuacagaaacaugaauuacuuguugcauuuguccaguauuggguagagaaauguuugugucuauucucaaauuaaaauuuuuccucaaauagguuaauagagggugguauuuaggagauguugaaaggcuguguguuguguuguuaugcaguuuaacuuggaaaugguugauuauauaccguaaaaaauguguuguauuuucagucaucuaauuuaggaauauuuucuguucaggaacagaauaacuugucuuaaucuauguuaucuaugcauuauccagcuggacaaaaauuaccugugcaacaaaacuguuaugaaauacugcauuuuaugugaugauccaacuagauauuuauccuauagaaaccugguagcaccaggcagcaucuacaaucuaguucuguacucuguaauagagagaaaauauguuagacauuuuauuacgaacaaaguaaugugcuauauauauagcacaaaaauacacaguauaacuuauuaaaaguccauuuaaaaggaaaauaguguaagauuuuugaaaagcauuacuguuaaaucauacuuguagugugauaggacuacaguuaaaauauuccuacaggucguauauaugccaugcuuuacauaaugguuguguucauuguuucagauguaagaaaaacaauagaugacuuaaaaaaagugaugaaaaauuuugaauccagaguugaauucacagaagauuugcagaaaaugagcgaugugaguauuuguuuuuagucuucuauauuuuuagaaaauauuuucaaagaaauaugaagcuaucuuacagccaaggaacaaauuaauugaaguuuaaaaugcuuucagacaucuuagguugaauaguugcucuuuggauaauuuuaguaugcuggagauuuguguuguuaauacgcuuuuuuuuuguuuaaaaaccaggcugcaggugauauuguugacauacgagaagaaauuaaaugugacuucgaauuuaaagguaagcaguaagauuguuuuauguguagcuguuuagauauuuugauuuuuguugauuuucagugggcuuucugugagauauuugggauuuagaauacacuuuuaaauucauaggaugccaacauuuuucuacucauugauuuuuuuuuaugugaaacauuaauggauaaauaacuuuugguuaaaaaugugauuccugacuggucuguuuuaguggugggauuacauggcuuuuuucucccaaaguucuccagugcuccaaaccucuaaaacucagaagauguauauucuagacauggaucugcuccuaauuuguucucugaccauggugaaguccuaagauaucuuuugcuaguuuuucuucuuuuaaaacugcagcuuuguaagcuguuuuuggaagaaugaaugaauguggguguauuucagccauuccucuuauggugccugcaguggcuuucccugcgcagguuguucccaucuccacccaguagauuucuuuugccaaggcuggcuuauguguuuggguuuacuucuguaaagccaaugguuccuucgucaguuguaaaguguuaacgguagugaaauuguaaaaaguauuacagauggcuuauuauuugcuacuguagaagacuguacagugucuuaaacaaauguacugagcauucguuuugacuuucagcacucauauuuuggugaugaacucuuaagauaacuuacugguugaaagaagccacaucacaaguaacaggaaguggcuuuagaaggugaaauaaaggauauguauauuaaaguugaacagaaagacaagauuuuuguuuguggugaccagugacaaauuaugagcgcuacaggucugaaauaaaaauuguuaacuacugucuuaucaauaauaguuacagagaauaaggcugugaaacauaauuugauauuuucagauguaugcaacaaugcagcaaauuugaauauaugauggacucgaggucaucugguagugccauaucucauaacaggacgcaucuuagacuucuucccauuacuuucccauuacuuugcuuuaauaaagcaaauaaagccuuaauuugcuuuauuaaaaaauaaucuauuuuuuaaaaugaaaagcagauaccucugaguucagauuugacccaucuuuuuuccucacaugaagauuacaaaugaagcaguuuaaaaaguagagauguucauauguaaaaugauaauagaacuuuacagagaugagccgccguuguuuccuuguaggguacucauuccuuggcagugcccuggaguuuaaaguauccugucacaaggcuuuugcacguuacuguaguaacuagauuuccuugaguaaggaugguaaauggaaauuuaucauuuauguguugcauuucgccuuauaaccagggugcauuguggccauuucuuaugcauuuuugaagcucuucucacaaccuugaauguguaugcagguucucuggggcucuuguugaaauacagauucugauucagugggucuaggguguccuuagagcuuacacuucugaaguguuccccaaggacgccagugcuguugauccauggaccacacuuugaguagcaaggcuguaagagacauucauccuuggaguucuguuuggcuuaaaaauugugaccccucuguuucaauauuucccuugccccaaaagaaagucucauuaagucuggguuugugccuuuuuuauguuggcuauuaacagccacgucuuuuccuuuuucuaaauagcaaaacaccgaauugcucauaaaccgcauuccaaaccaaaaacuucagauauuuuugaagcagauauugcaaaugaugugaaauccaaggauuugcuagcugauaaagaacugugggcucgacuugaagaacuagagagacaggaagaauugcugggugaacuugauagguacuugaugacaaauuaucuuuccaagauaauuuguuucuauacacauuuccucauuaaucuuuuucuucauuaauaaaauaauauguguucauugaagaaaaugcagggaagcauaauauauuaucaauaauccuuucaccucaagaugaacauuaauucucuggaauauuuucuuauaggauuguguguuugugcauauucccaugcauguacauguacuuaaauacuuaagaucaacaucuucauuuuuuauuauggccuauuuuauauaauuaauuauaccagauaguugacuuuuaauaaucauggauuuaauauauauaauguuaaauuuuaaaugaaguauuuuuaugccacacccaggauagugcucuaucuuugaauguguugugaaaaacaaaaauacacuuugaauuuaaauuugauacaguaaaauguuuauucuugcuuuccuuuuauaaacuuuggagcagguaauuuguaaucuggucagauagcuauauguaugagaaacuuuacgaaauugcuguuugaaauacacauuagcacacacuuagaauuguuaaaaugcuaaaugaaaucugcuacucgagaaguucuauauuauuuugcuuaaaugauguaccauaugcaauaauuaguuucugugaaaaauagggcaggaagcauaaaaguuucuuuuuccuaguguuucaccuauaaauucuuaggucuuuuugauuaacuaauacuauucauuuuuuaaaaccaguuuuggaucuugugauuuuucuuggucaugauucucuuucuauuuuuuguaugauguuauuucaguucuguugcauuuucaauuuuguuauuuuuguaagguccucacaucuuuuauagaaucaaguaugauaaauguucacucaugcauauagauauauucgugugcauauguauaaauccuuuauuuuuaaaaauuacaauaauacaugcucauuguaaaauauucugaguauaggaguagaaaauaaguguguauuaugugguuucaauuucuggucuuuagagauaaauguucucugaauuucuuacaacuuuauuauuauugauacuauauuuauauugcauauggccaauaucuuucuugcaaagauaaaaaaauuaucuucuauauucuacuuaugucugaauaaccucaauauauagaagcagcauaggaacuguuuuuuguuaauuuauuucaaaacauuuuuuuguuuuugaacuuagaauucuaguuuuaaaaauacuuuauucaagaucuuaguauuuacccauggaaacuaacuggaaauuuaaauaauguaaaauucuaguauguuuguuugaucuuguuaauuuucuuccuugcuaguaagccugauacugugauugcaaauggagaagauacgacaucuucugaagaggaaaaggaagaucguaacacaaaugugaaugcgaugcaucaaguaacagacucucauacuccuugucauaaggauguugcaaguucagaaccauucaguggucaagugaauagucaguugaacuguucagugaaugguuccaguucuuaccacagugaugaugaugaugaugaugaugaugacgacgacgacgacaacauugacgacgaugauggugauaacgaccaugaggcuuuagggguuggagauaauucuauaccaacaauauauuuuucacauacuguugagccuaagaggguuuguauacuuuuaacuuuacuaauuuugcauauaauuugaacauuaagcauuaugauauuuuuuagaagagcaauauuaacaaucauuaucauuguggauagugccagacaggaaaaucaucuuuugccucuuguucugaccaauuuaagaagaaaaagggaaaaaaaauuuaguuagcugguauugguccauuguucucugaaacaaugcauuguuuggggucuggaaggggaucagauuugaguggcaacuacuguaacuucaccuguccuucauucagagaguuuucuuaagaauccuggaguuaauuauauuguggacauuuuggugugcuuaggauguugaaagugacugcauuaguuaaauuuuuaauuaugccagguuguuuucuauggacauaaaaugaauacuucauaggcacaaagggaaaauguaggaggaaguaaaaauuaguuucuuuucugacaaaguaaauauaaacaucuguggauaaucaugacuuagaauuuuggcauuuuagagcugggggugacuggagauuuucuaauacagaguuuuaaagcuuuucucuaguaugaaaagccuuuuguucccuccauacuuacuguagaaucccaguauuuaaaauagaucaaagcagcuuggcucugauugaaggaaggauaggcugccuuaaguccaucuuugcccucucucugcuccauguacugcucuaaggggacacugggaauucgucuaauucgucuuucucagggaaauuuaaggccuagaagacauagaucugguugguaacaaaacaggaacucuuucgccucugagugcccuuucuacacaauaucccgauugccuguaucaguuaagggucugugguaucauucuuaagugugugugauuauuauuuagugaaauauguuuaaaacauauuugauauuucuuagcuuccuaaaguuauuccugcuccuauaugaagugaaauaauuguuuguguuuuuauauucuaauaugucagacugaaggggucuuccccugauucuucgggaaaaguugacugagaugauuagccagaaaaaaaggucgcuuuuuaaucuuuugccaggcuuuuacuuuuuuccuguuuucauuuagauaaaacagaaagaacaaauauuauuugcaggaacguuacagguaauaguggucauuauuguggaaaguaugcucuaagugcugacuagggauagaaaaauaacauguuaaccccaugugaacccugaacaggcuugguuuuuauuuuuuuacuccuucaauuucuaaaaauuagagauguuuuaaaaauucuaaauaggcauuauuuaauaguacuuuuaugacuuaaagguuguauucuuacugaauuuuuguuuauacucuuucuuuugaaauacauaauucaagccaaacacuuauaucaaaggaauggggugaugggaaguuuauaagaaaucuagcauuuaguucaaauguauuuugcuuucucuacaauaauaaagacacugaagacuaggauuuguuaauaaagaagauuuucuuuagaugucauagaucuaugagauaaggacuuuuuaaaaaauuccaucugauaaugcacaucauuucagcaucagaaaauuucagcugccucucuuacuauuauuuuuuuaguuauagaguuuauuuguuuugguuucacuuugauuuaauuugucaaaagauucuuaauuucuugcucugaaauuuuagguccgaauaaauacuggaaagaauaccacuuuaaaauucagugaaaagaaagaagaagccaaacguaaacgaaagaacagcacuggcaguggccacucugcccaggagcugccgaccaucaggacgccugcagacauuuacaggugggaggcgcucacagcugcagggcagucugcugggcuugccucucuuucugccacugaaccuuuacuggagaaaguugacuguaacacagaagacccucacugaaaagugaaguguucugaggaguuaacuuaggaucugauaggcugaccggcuguagcuucccaguccagagcagugggaauggaggauuuuuuuuuuuuuucacuuucuccucuucaccagugcuuuugaaacauuuccaaauggucuagucagaaaaucuuguaucuucagaaagcauuuuuguuuccagugggcuaggucccuacguuucuaccacagccguaacaugcuuggcaugcaguuuaccuuuucagaguagaaauuauacuguugcagguuuuuuuuuuuuuuccuuuuuuuuggaauuguuuguugagaaaacuaucacuugaaaauaccuacuguuuuuaugacccuuauuuauaaaucagugaaaauugcuaaauguauacgugggucuaaaacuuuauguagaauuuuggcaaaccaugcuauugccaccuaggacaugcuuaaaaauaacaugcuguguuuuuguucucacucauaggugggaauugaacaaugagaacacuuggacacaggguggggaacaccacacaccggggucugucaugggguggggggaggggggaaggauagcauuaggagauacaccuaauguaaaugaugaguuaaugggugcagcacaccaacauggcacauguauacauauguaacaaaccugcacguugugcacauguacccuagaacuuaaaguauaauaaaauaaauaaauaacaugcuguguuuuauuauuaggccagagaaauagcuuucaaaauaguaugaagauaccauuugaggcuauaaaauuauugugauugugacuauuuuagauauaagauuguaauaaaaauuuucagauuaauuucuagaauagauucaaggaaauuuucaaaaaguuguucucaguuuuaugaguuacguauagugaaugcauauguguuuugaauaucacagagccuuuguugauguugugaauggagaauaugucccucgcaaauccauccugaagucucgaaguagagagaauaguguguguagcgacacuagugaaagcagugcugcugaauuugaugauaggcggggaguuuugaggaguaucagcugcgaagaagccacuugcagugacaccagugagagcauuuuggaagaggaaccacaagaaaaucaaaagaaacuuuugcccuuaucaguaacaccugagguguguguguguaucuuuuaauucuuuauuucauauaguaucuuugaccaguuuuagcuauuuaaucugaaaagucauaagauuaaauuaauucuagguuuuauacuuucuugguacuaauuaauaaaaaauuaauagucacaaacaguacaaauauugugauaaucaaauaguuuauuuuuugauaaacacauuacuugucuuaacguucuauuucagcaaaaugggaaauuuaaaaugucuuacuuggcauuauguauuacauuuguagcuaggaaauuauuucgcaguuuauuuuaaauaaauuaccaguaggucauuuucugauaguguaaggagcagauuacauuauucucuuuuaaauaccuuggcuaaguuaaagaaaaauaaugcaugcauagcagauaauuaccuaaagucuaauauuuuaccuuguaccagugaaacuuaacucuugggggauuauggaauuguuuuauaaucugaugaaagcuguagacccuguccauagaaaaaauagugcacacucaauacacuuucacccaccacacuucuuacaguuuuuggugguggugcaggggagguuaggaaauccccaaauaaggaugucugugaaauauaaggcuauugauuucuucauucuuguguuuuggugcguauuugaaguuuucaauuuaaaaaguauuuaggaagauuggggaacccaugccuggaucaaaccaguguacacauuuguauauacaauaagauacaugcauauauauaaccuuaucuaaaaauuccauugcuuuuacuaaaugguauuauacucaguguauuaaaugguaauuggggauggagauugguagcauuuagggacaguacauaugacuagaauguuuucuuccccucuucuuaguauaaugaucuuaggugaccuggaaaguaucuuaccuuauuugauagucuuccauacuguuagaaaacagguaauggauguuaucagguaauugcugauaaauguuugaaaauuaguuuuuuguaaggacuuaguguaucaugguacagcuagaguguggaaccuauuuuuuauuucacccuuaguagcuuugcauuuuguauggaaauguuuaauaguaguugcuauacauuuuuuaacaucaaagaaauaguucaugauuaugguaaguacuuuggaagauauccuuuucaguaucuuuuuaaaugcuaaaauaccucuuuuucaaaggcauuuuaaauagaagaaggagaagaaggcucuaugcucaucgugauaaaguggaguuuuuaggaaaguaagcuuuaagcugcuuuuaccaguugaacuccaaaaauaauguaggagagagauggcuuucuuuguuuuuguuucagugguggggcaagguagaagaagguggcuuuuuaaauuauuuagguguuacguuguuuuaacuaauuuugagcacuugguagacagaggagaacaaaauguacauuaaaguucaccugucaaauuuucauuuguagagggaaggauggagguucuaaauaccagcaaucuuaaaaaaaaaaaaaaaauuaacuccuugugucuuaccuauuuuuguauaaaacgacauguacagauauuuccagcaauuuaugcacauucuuuaauucuguuccaguugaacauauaguugaccagauuaaaugcagcaaacauccaggugaaauugagucauuucuuuuuuuguggaacuucugauuucugucauugaguuaauuauauuaaaauuuugaaaccuguacuuauuccuacuaguaucagcacuuuuauuuuucaacuuccacugaucuuuuaaaauugaggcaauaugcaguaaaauauuuaaauaauugcauaaacaccaccaaagagauaucaguuagaaaugucaguacuggugaaacuaagcuauuggcuagcaggcagcaaggccaucauaggauagcucauucaucaacugauguacaaaagucagaguuugacacccuaauagcauuuuuauuuuaauacauuauuuuucacagcaugggcuggacaugaauggaauguaugaaaguuugaagaccuuuuauuuauccauuucuuuuuuuucccagauaaaauuuacauuuuacauuuuguuuucuugcauguauacuguaaaaauuacuucuguuugguggugaaauuaaaacuuaaugguguugguuucucugaacaauuaguauuuugguguaguaguguugucuagccaaaaaucucgugaauuuacuuuuaaugaaaagaauugccaaaugagugaaugggaagauuuugugggugucuuauuugcauuuuauuaccauaaccugacuuuuguuuucuaggcuuuuucuggaacuguuauagaaaaagaauuuguaucaccuuccuuaacaccacccccagccauugcucaucccgcacuacccacuauuccagaacgaaaggaaguucuguuggaagcaucugaagaaacuggaaagaggguuucaaaguuuaaagcugccagauugcaacagaaagacuaggcccugucuaggaaaugggaauuuacauccuaaaaccuaguuguucauuuguuuagaguaucuauagcaaaauagguuacauguaguuugaaauaagguauccugaguuacuuuggcaacaaguucuuuuacccuuacccgugguauuugaaaaaaaucaagguaacugucugaauacuuuaauaucagcuuguuuugugaauucucugaauacugucaacacucuuaucuaaguuugccuuuaugaugcaguggcagcauuuugaauuacuuuucaaagaauacuguucauaugcauuguuuuuguguuucaaacuaaauacaggcaguuuugugccagcugugauauugugcauaccauauggaccauuuuaaagaaaauuuuaaaauuucaaauagauucaacaauuacauuacuugcuuucacauuuuaaaggcacuuuaaaaaaaucuacuucucuuguagguuuugcggcuaguuggcuauucaagaaaccucgccccucugaaugucauacuguaaucuuuaaggaagaaagcuacaugaauuaauuguacucuaugggaaaauuucuuuggaaagauauuuuguaaaacuuuuuuuuccaaguaaaaacuuuaugaaacuuggucucaa

SEQ ID NO: 192914 - RNA, 948 nt, Homo sapiens
augacaacacaccgaaaugacacccucuccacugaagcuucagacuuccucuugaauuguuuugucagaucccccagcuggcagcacuggcugucccugccccucagccuccuuuuccucuuggccguaggggccaacaccacccuccugaugaccaucuggcuggaggccucucugcaccagccccuguacuaccugcucagccuccucucccugcuggacaucgugcucugccucacugucauccccaagguccugaccaucuucugguuugaccucaggcccaucagcuucccugccugcuuccuccagauguacaucaugaauuguuuccuagccauggagucuugcacauucauggucauggccuaugaucguuauguagccaucugccacccacugagauauccaucaaucaucacugaucacuuuguagucaaggcugccauguuuauuuugaccagaaaugugcuuaugacucugcccauccccauccuuucagcacaacuccguuauuguggaagaaaugucauugagaacugcaucugugccaauaugucuguuuccagacucuccugcgaugaugucaccaucaaucaccuuuaccaauuugcuggaggcuggacucugcuaggaucugaccucauccuuaucuuccucuccuacaccuucauucugcgagcugugcugagacucaaggcagagggugccguggcaaaggcccuaagcacauguggcucccacuucaugcucauccucuucuucagcaccauccuucugguuuuuguccucacacauguggcuaagaagaaagucuccccugaugugccagucuugcucaauguucuccaccaugucauuccugcagcccuuaaccccaucauuuacggggugagaacccaagaaauuaagcagggaaugcagagguuguugaagaaagggugcuaa

SEQ ID NO: 192915 - RNA, 948 nt, Homo sapiens
uuagcacccuuucuucaacaaccucugcauucccugcuuaauuucuuggguucucaccccguaaaugaugggguuaagggcugcaggaaugacaugguggagaacauugagcaagacuggcacaucaggggagacuuucuucuuagccacaugugugaggacaaaaaccagaaggauggugcugaagaagaggaugagcaugaagugggagccacaugugcuuagggccuuugccacggcacccucugccuugagucucagcacagcucgcagaaugaagguguaggagaggaagauaaggaugaggucagauccuagcagaguccagccuccagcaaauugguaaaggugauugauggugacaucaucgcaggagagucuggaaacagacauauuggcacagaugcaguucucaaugacauuucuuccacaauaacggaguugugcugaaaggauggggaugggcagagucauaagcacauuucuggucaaaauaaacauggcagccuugacuacaaagugaucagugaugauugauggauaucucaguggguggcagauggcuacauaacgaucauaggccaugaccaugaaugugcaagacuccauggcuaggaaacaauucaugauguacaucuggaggaagcaggcagggaagcugaugggccugaggucaaaccagaagauggucaggaccuuggggaugacagugaggcagagcacgauguccagcagggagaggaggcugagcagguaguacaggggcuggugcagagaggccuccagccagauggucaucaggagggugguguuggccccuacggccaagaggaaaaggaggcugaggggcagggacagccagugcugccagcugggggaucugacaaaacaauucaagaggaagucugaagcuucaguggagagggugucauuucgguguguugucau

SEQ ID NO: 192916 - RNA, 71355 nt, Homo sapiens
uuggauuuuccauauccuuuaaugaauugcaaauauauuaacagaaaagacuuucccccucaacacuguacaauuucugaaauaagucaguuaaagcaaaaagaagacacaaaauuacauuguuucaaugcaaacagaacacacacuucauacccacacuugcauuuucccagguuuucacaaagaaaaugggucaccauauuucucagugaagacucauacuauacucuggcuaaucagagacuuccaaacuuuuuucuucaaaaagagcauuuuuaauagacuaaauacugguuaucacugaguuuuuguuuaagguacaacagcagcaugguucaaauguuacuuguaguucucggaaaaauuaaaaauuuuaagugaugaauacagaaaauguagggaccaccuuucauucuuuugaguaccacuguucucuugaaaaaauauucuaaccuucuaaaaucccagaguuaagaaccauuuccaaggggaaaaacaaauccaaggccacaacauaacuucugaacaagugugugcgcguauauauauauguauauagauguauuaaguuggugcaaaaguaauugcagguuuugccauaaaagucauggcaaaaaccacaauuacuuaugcaccaaccuaauauaugugugaaacagagaaaaggaugucaaacuacuuaauuuaauuucuguaaaauaaacuucugaaauuugaagcaaacauuuugcuugaucaaaauguguucuucuucggguuguuugauccccauuccaugcaaaaaacaaaaccaaacaaaaaaagaaacugcaaaagccagaaaguguuacuacgugggaaauaaggcuucaaauaccuaaaugacuuugaaaguagguaugaggaaaaauaaaauaggccaagcuugggcggaaacugucccccaaccagccauugccauggcaugucuuacaaaacgauccuuuuauccuuggucucaaaaaaucaguaccagaaagacucucaccucuggcacauaaauuccugcuacaaaaagauaauuauacuucagcaaguuauguucuaagcuuagcuuucuccaggcuuuauaacgcagaacucagguugaagcuuucuauaaaacucuaaaugacacuguuauacagcaccuugugcuuugccaauuaaaaaaauaaaagaaucuaaaauuaaauauuacagaacuaauggauaauacaauagcauacguguuagaauccaagugcuagccucugggaauuuuucauuauauuuauuuucucccaacuguuccuuuuuuuuaaaaaaguauuguuuuagacaguacauauacauaaauuuagguagggaaaucuguuaaauaucucucuggcaccugauaccuaaagacccugacuugaauuaauuuauaaauuguaccuaauccauguucaaaugagauuaacaguaaauuauagaaaauuacugagucuacagacuaaaauuuuuuucacaucuuuuguaauccaccuuauuuucacagcuugacuaacaaauacagguaaguuuguccuccaucaaauaauccagaauaauaacuguaggccugucauucauaagaaacuauaauuuguuauauucugacacuggcacuuaauaaaauguuaacaacuaaaauuucucuaaaaauuucaauacauuacaguaaaggagauaaacaauuuaagacuguuuaaaucuguuacuguggaauuccaauaauuaucauuuuauaugcauaauugaauucuuaaaauuguggccauuuuccaaagacaccaaucuauauuaugacaaacucagaagagaaccuaucuccuucauaagaauguuuuuucccccaagcuaaaaauuuccaacauccuaaacccaauuacucuuaguaaauguuuuggugacucacacuacugaaaaaaucugaagcagagagucaaaaagaauggaaaggaucucaaccaaagguaaccacacauucuuacacucugcuuaagcaaacacuuagaaaagucaaagggauguuuugaacaaauauagauucaagguuaugguacaauucugauuauauuaaggcuuucacuaucaugaucucuuaaaagucucuccacuuuaguguucuccuucugauucauauggugaacuuaagggguuauuaagggccuuguuuuggcuucucaguggggaaccacucuaucaucucugaauguuaaaggugaucccacagagcucaaagagaagaggcaauaugguaagaaacaauuuuaaaguuugcaauaccaagacaacaaugaucaacacuuugaagcaagaugaauaaauuaaaauucuugguuagacauuaaagcauucuugccaagaauaagaguacacuguauggagggauauuugauuccuacauacgagucccaauaugcccauuacauuuguuuaugggagauacugcaaguuuaagguaauuuacauuccuuggcaaucaagucacuguuauaggcaacgucuuuuauuguuccaucuggcacuugcaaacaccauucuugaagaaccuagaaaugaaggucaguuacucuguuuaucaggaacagaaccaaauaaaaacaaauuuuugaaaaagcaaccaagaaacucugguucaucacuauuuuccauaucuaaugguuccuucaagauaaagcauaacucuuccuuucaugauacuuuccaacaaagggagauuaaagaaaaacagaaaagaaaguuccccacccuaccccccauaaauugucauucauacugguaaaagagccagucuuguuagcagcuaaauauugcacugccuuucauucuguauacagucaggguccaaugaaaguggcacacucaugguauaagugacggacgaugacaccgccagcucaagaguaaagacucaguauacagagggacaagaaacacgucagcacuagucacacauccaguuguaaaagucugauuuccagaaguuaaaauucaucacuuucagcugcaugaaguugugugucauccgcaucugucaugcugcucuccugggauucaucuguucccacuuuaaaaauaaaacagaaguccacaguaaguuuucugacaaauauguccuguugguucaugaaaacaaguaagaaaaauuguauuauauucagagagauaaaacccuaaauaaaggcccuuaaaaauccucauauccuuuaauaaaaugcaacucaaguuuccuaacuuuauaauaggucugauauuagcuuacugcauuuuaccuuuaaguuuuaacuaccaaaacugccucuuccuaaugaguuccuuauuccugcccuaggaauuacaacuagcuaguucucugagacauuaaaaaaaaaaaauugacauuucccccaaccuccaaucacugacuccacuuuaagaauacucccugcuaguccacagaaacacagacuauaaccuucaguuucaaaagguuuauggggucagucuaucagucaaucaaucaaucaaucaucuaucuugcucugucaccuaggcuggagugcaguggcacaaucauagcucacugcagccucaaacuccugggcucaagugguaugauucuccugccucagccucccaaguagcugggacuauagacacguaccaccacagccagcuacuuuuaaaaauuuguuuagagacagggucucacuggcuagucgugaaauccuaggcucaagcaauccucccaccucagccuccugaguagcugcgauuacauacgcaagccaucaugccuggcauauauauacuuuuuuuuuuuuuuugagacagaguuucauucuugucauccagguuggagugcaauggcgugauuucggcucacugcaacuucagccuccuggguucaagcaauucuccugucucagccucccgaguagcuaggauuacaggcgcccgcaaccacgcccagcuaauuuuuguauuuuuaguagagacgagguuucaccauguuggucagcuggugucaucuccugaccucaggugauccacccaccuccaccucccaaaguguuggaauuacaggccugagccacugcgacuggccccauggcuuauaauuuuaauuaaagccuuucaccaaguuuucuggaacaaaggcaucuaaucagaauuuaucuugucagaaauuucuccauucuguuauuuaaaaaacuacauuuuuaugaagcagauaaaacaguacugguuacauauucaaacauaaauugagguccagguaaaacuuagcaaugaauuugucaaagucacacagcaaacuagauccagaacagagacucauuaucugacuuuauaugcauuuuguuauuacaucacccuguucaauuucccuaaaaguccauuugguauaaugaaaacaccaugguuagaaaaauaaaauaaaagaguagccuacaaauccuuaugcaaaagguaacuuucuaaauacucaaaaucauauguaugauacuuacugaucuguucuucuuggguuauuggcuccucaucaucuggaagauaacgcuuaucaauugccucuuuaaucugguuauuggcuccuuuaggaucuaaauccauagcccaagagaaauucaucagggcgaggugcguuugaccuaacuucuuguaaaccuaaaaauaaacagcagcacuacauuuuucauuaaguugugagcuucaacuauaaaauucuaacuauauauauacuuauuuauuuauuuuugagauggagucucacucuauuacccaggcuagagugcaauggcacgaucuuggcucacugcaaccuccaccucccagguucaagcgauucuccugcuucagucuccugaguagcucggacuacaggugcccaccaccaccccuggcuaauuuuuguauuuuuaguagagacaggguuuugccauguuagcuaggcuacucucaaacuccugacucagaugauccaccugccucccaaagugcugggauuacaggugugagccaccgcgcccagccucuacaauucuaaauauuuauaauuuaaauuaggcuccugauuuaugugcucuaaacucauucuaaggguaggacauuuucuuccuacagaugaacucauaccagcuuuugaguuccuuuuaauauaaucagacauuauuuucagaauuccuugcuucuaucuuucagguaguaaguuuccaauaaauaucacucugacuggagcaaugauaaugggauuaaauggauuauaaacugcuuaauuaacuuucauuuacagugauuuuaaauugaguuauaucaacucuuuacaacuguccacagucaccuuaacuaauuggcauauggaggucuagucuguaaaaaacugacuagucuggccuugggacucucagaagccauuucucuuaaucaagacaacacagugccauucauguucuucuacuuuuuuuucuacuuuuuuuuuuuuuuuuuuuucuuucugagacagaaucuuguucucuugcccaggcuggagugcaguggggugaucuuggcucauggcaaccucugccucccagguucaagugauucucgugccucagccucuggaguagcugggauuacaggcaugugucaccaugcccagcuaauuuuuuguauuuuuaguagaggucagguuucaccauguuggucaggcuggucuuaaacuccugaccucacguaaucuaccugccuaggccucccaaagugcugggauuacaggcgugaggcaccaugccuggcuaggauaucauuuucuuaaguguuagaacuaaaucuguuauucccagagcacucaguucggagcuuuaguuuaauuugcucaauagauauguacaggaaguauuacauuuauucuuauaaaaugucauuauuugcuaugaaagucacuguuugggaccaugaccccagucuuuaccuuuccuauuaagaaguaaacgagggauucuuugggaacaauuuguuucaauucuucaaguucuuguaaagcagacugaaaaaggcaaagaaaaaccuuaaaguagcaaaaauuuuuaaaguuuugaccaagcguuuuuacuuauuugauuucccaaaucaucuucacaaaagcuaacuaaaucuuaaucaauauacuuccuuauuguauuaguucuuauugcugugaaaauaaaaugcauacuuauaugacaauagguacuaagaaauggcaggcacucuaguacacugaaaacacacacacacacacacacacacacacacaccccucuucgugaaauaugcaggugguaacaauccuugcuuuuggucaucuaucuaucuaucuaucuaucuaucuauucauuuuuauuuauugagguggagucucgcucugucgcccaggcuggagugcaguggcgccaucucugcucucugcaaucuccgcuucucagauucaagcaauucuccugccucagccucccgcguaacugggauuacaggcaugcgccaccacacccagcuaauuuuuguauuuuuaguagagacgggguuucaccaugucagccaggcuggucuugaacuccugaccucaaguaaucugcccgccucagccuaccaaagugcugggauuacaggcgugagccaccaugcccggcccagugauuuauuuuuuaacgaaaaauaacuauauaauuuuucagaacaacaaaaaguuauugagaagaguggcauuaacauuuuugcaagucucuguuaguagaagacagcuagauucucacaucuaucugcuucuccauuuaaucuguuucaauaucacauauuauguagcuuuuggaaaauucuacuguccauuuggacagaaugagagugaaaaagguaaauaacgucaagauauuauuguaaaaauagcuuugaccucuaggacuccuuggaaggauuuuagggacccccagaaauucccagaccacucugagaauuauuacuuuaaagacaucuuuuuuucuuuuuugagauggacucucauucugucacccaggcuggagugcaguggugcgaucucugcucacugcaaccucugccuccuggguucaagugauucuccugccucagccucucgaguagcugggauuacaggggcuuaccuguaaugccuaauuuuguuuuguauuuuuaguagagaugggguuucacuaaaguugcccaggcuggucuugaacuccugaccucaggugauccaccugccuuggccucccaaagugcuaggauuacaguugugagccacugcacccggccuuacuuuaaagaaaucuuuuuuuuuuuuuuuuuuuuuuuuuuuuugagauggcguuucacucuaucacccaggcuggaguguggugucgugaucuuggcucgcuacaaccucucccucccagugucaagugauucuccugccucagccuccugagcagcuggaauuacaggcgugugccaccaugccuggcuaauuuuuguauuuuuaguagacacgcgguuucaccauauuggccagcuggucucgaacuucugaccucaagugauccucucaccuuggccucccaaagugcugggauuacaggcgugagccaucaugccuagccuuuaaagaaaucuuuuuuuuuuucccugagauggaguuuugcucugucguccagccugaaaugcaguggcucacugcaacucccaccucccagguugaagcgauucuccugcuucagccucccaaguagcugugauuacaggcgcccgccaccaugccuggcuaauuuuuguauuuuuaguagagaugggguuucaccauguuggccaggcuggucuugaacuccugaccucgugauccacccgccucagccucccaaagugcugggauuacaggcgugagcugcugcgccuggccuuuaaagaaaucuuaaucucuaagaugacacacuccaauccuccuucacugcuacaacacacacaauucagaauugauauguuuucuuucuaugauugcauauuauaauuguuaucaacauuucaugcaaccagcaugccuauccccacccccagcgaucuaauuacaaggacucauugagaaauagugucucacauagcaucagagcucuuacuuuuaccuuaaagacuuaagauuuaaauaauuaaauaucaguacagcacauuaaauaaggugauggcuagcaauguuuuagagauguugaaauggcccccuugauuuucauuuuggagccagaaaaucucagaagcaaucauuaacuuuucuuucuuuuuuucaagugaccagggaaugacacagccccaggagauccugagaacauguaccuuuuaacuuuuccuuaugcccuuuucauacagucacauuucuauaucuaauccaugcagcaaauuaggccucauaauucagcgaagccccaagcucauacccaaaaauggcuauaacugggaguuuuucugagucuacuguggcucagggggcugccugauauaauaaugauaaugauaauaacaacaaaagagggagucucucugguccuacuuuggauuggaaggcugccuaauuaaacaaucaaagaaaaccccacaaaaauggcuaucacuauauauaucauaguccagacaacugaugagauuagaacuuggguuucuugaagcaaguaaacgcugauuuauguggccuaucugguagguauguugguauuaaaauggcuuuaagaauaaugaauaaaguccuucauaucuaaagagguacauaaagcaaauacauaaaaacaaauacugauuugcaauuauaguacuucaaagaguaguuaaaaguugaaacgggcuuauuagauuuaaaauaagcuuuaugaaaaaaauuuuuuuuugagacagagucucccucuguugcccaagcuggaaugcagaggugugaucugggcucacagcaaccuccgccucauggguucaagcgauucucaugccucagccacuugaguagcugggauuacaggagugcaccaccaggcccagcuaauuuuuguauuuucaguagagacaggguuucaccauguuggccaggcuggucuugaacuccuggccucaagugaucuggcugccuuggccugucaaagugcugggauuacaagcaugggccacggcaccuggcccuaaaagaagguuuuuaaagacuccaguuagauaaaaaaauuagcugagcaugguggcuuaugccuguaguccuggguacaaggaauucagccuaggaauuugaggcuucagugagcuaugauugcaccacugcacuccagcuugggcaacagagcaagaaaaacaaaaacuaaagaaagacaagcuuuuuaaaaggacaaaaccaguaaaaauagaaacccgugucuucauaaagaagauagaauaaaacuaaaggaauuacuagauaaauuauauauuuaaucccuuuguauaucuuuauuagccuauuuuuacguuuuuuuuugagauggaguuucacucuuguugcccaggcuggagcgcaguggugugaucucaacucacugcaaccucugccuuccaguuucaagcgauucuccugccucagccucccagguagcugggauuacaggugcccaccaccaugcccggcuaauuuuuguauuuuuaguagagacgggguuucaccaaguuggccgggcuggccucaaacuccugaccucgugaucugcccgccccagccucccaaagggcugggauuacauacgugagccacugugccuggcccuauuuuuuuuuuguuuuuuaagacagggucuagcuuuguggcccaggcugaagugcaguggcgcgaaaacagcucacugcaaccuccgccuccugagcucaagccauccucucauuucagcuuccugaguagcugagaguacaggcacacgucaccacaccuggcuaauuuuuguauuuuuuuugguagagaugggguuuugccauguugcccaggcuggucucaaguuccguggacucaugugaucugccugccucuuccuccaaagugacgggauuauagggauuuuuauuaguauuaaaaaaaaguuaucacugguuugguauauuucuuucuauuuuucuuuugugagacagaguguugcuguugcccaggcuggaaugcaguggcguaaucuuggcucacugcaaccucugccuccuggguucaagugauucucgugccucagccucccaaguagcugggucuacaggugcacaccaccaugccuggcuaauuuuuguauuuuugguagagaugggguuucacccuguuggccaggcuggucucgaacuucugaccucaagugauuugcccaccuuggccucccgaagagcugggauuacaggugugagccacugcgcccagcccugaauuuauuuuaaaagauuuugcuucaugguuucugauugaauaaaugauaacaaaaaucucgugucuuuuugccucuuaucucuuucucaguuuccuuaucuucuuuuuucaauacuuguuucaggcuaagcauacauaauuugaaaaagagugagaaguaaagagaaagacacaucagacuagaacuagucuccguguuauaagcucucauaacuuaauacacuuucccuuuauguauuaaacauuuauuauauuuugugauuauuugguuaaugucuguuuuccuagagaguacuagauaguaggccccucaaaagcaggaaagaugauugcuuuacuugccacuauauuccuggugccugacacauacuggguaaucaauaaaagcugaauaaugcacacacauucguuuucuuuuucuguuuuuuaauuuuuaauuuuuuuuuuuuuuuuugagaugaagucucgcucugucgcccaggcuggagagcaguggugugaucuuggcucacugaaaccucugccuccuggguucaagugauucuccugccucagccuccccaguagcugagacuuacaggcaccugccaccaugcccagcuaauuuuuuguauuuuuaguagagaugggguuucaccauguggcccggcuggucuugaacuccugacucaggugauccgcccgccuuggucucccaaagugcugggauuacaggcguaagccacugcgccuggcccauacauucauuuucaucuguucacuuauuuugguccuaagaggaugguuuaagauaacuuuaagauaacuaccugaugaaaaaacugccuuucuauauaagacaucuuuacaagggauaacuauauauuccuaaauauccacacaccuauccuuccuaugaguauuucaugaagacauaaaaaucacaaaaaaugaaauuaacagcuuggaaaaaugucucagaucaaaauuaaauaaauaacuuucaguuuauugaaaacaagggauaacguuguuuuuaagcaauacaacacugaagacccuuaagauauuuaucuuaccuuauauuuuucauuugcaaauaaaacugaggcucugugaaauuugcauagaggguucuugggaucaaugacaauggcuuuguuuaggguauccaaagccuucucugauuuuuucagugcauguugaaccuguaagaaauaaagaucauguuaauacucccucuugauauuuaugaagaaaggugagaaccaacgugacucaaaaccaacauaaucaaauuauuagagauaagguuguagggucuaacuggauuguccacugcauuaaguggauuuaguaauuaauuaccaaaugauuaauagauuaucucuaaaaucacuucuaauucuaguucaacugcuucacuaaagaugagaauacugaagucuagagaucuuaaauaauuugcucugugauaaaaaucuagguccucugguacauaccuaugaugauaaucaauagucuaucuuuagagcagauauuugguuaccuuuaagucuaaaaggcaagcaaaaccuugguguucuauucauaaaaaagaucuguacuauuuagccagauaauauucacauuucaucagguuuaugcggucuuucaaauauuagacuucucaaaacuguguuaacacuccuguuuacaaaccuuguuucacucagaacaauuauauuuucaauauuuuaggaauuuauuugaaaaaugauuuuacuggccaggugcggugacucaggccuguaaucugagcacguugggaggccaaggcagguggaucacgaggucaggagaucgagaccauccuggcuaacacggugaaaccccaucucuacuaaaaauacaaaaaauuagccgggcguggugucacacgccuguaguccgagcuacuugggaggcugaggcaggagaauugcuugaaccuggaggcagagguugcagugagccaagaucgcgccacugcacuccagccugggcgacagagcgagacuccgucucaaaaaauaaaaauaaaaauaaaaaaagagaaaaaaaagaaaaaugauuuuacuguuuuacauaauugaaaaucacugaucucuaauacugggaagcaaauaacuuaagauauuuuaaauaacuuaaaauuuaaaagauuuaaaaaguaccaaaccucacuauucauucauauguguauacuaauauucugcuaugcuccuccuuggacaaauuauauguuauaaaguggggugggcugggcccgguggcucacgccuguaaucccagcacuuugggaggccaacguggguggaucaccugaggucaagaguucgagaccagccuggccaacaugaugaaacccccgucucuacuaaaaauacaaaaaauuagccaggcguggugucgggcaccuguaaucccagcuacucaggaggcugaggcaggagaaucacuugaaccugggagguggagguugugguaagcugagauugugccacugcacuccagccugggcaacaagagcgaaacuccaucucaaaaaaaaaaaaaauuaaauuaaaaaaguggggugaaugaauguaugaauguggcugcagaacuuuaacaaauaucauggucauaagaaugugagaauagguagugccaacgucugcuugcuaaacucaucuacgcaaugaucuaaugguggccaaauauucugcccacaggacugagacccuaaauacuaguucccgaaaagagaaaagcuuacucucuuaccugacaauuucuucaaauaaaccacucaaaaauuuaaaacaaccuguucuacaauaaguucagaagaauuccuauuuuuaaaaaaguguucaacuucaccaaaaggugucaagagauuuaauuuugaauugaauaaauaaggugaugacaacaaaaaauaauuuuaaguagacacauuaucucuccauuuuuuccguaguagcuaacuauaaaagaaguuacugucaacuuuuuuuucuugcccugucuuacggugcuggacuauguccauuuuuaagaaaauuaucauggucaaugucauuauagucaauagagaauuagaauucuacucuccccaagauagugacauuucaaacuaacaauuuccucacauuguaugaccauucccacaaaagcuaaacuugcuagggggaaaaaaagagagaagcugaggggagggagaaggggaaagggaugagaggaugagaacaagaacuuaagguaccguacuuacacagaagcuaauaaaugcgauuuuaaaaagcaaacaaacauaauguacauaucuuuucuccuguuaaaguaaaauuuauuuauuuucuuuuaagagauggagucucauucuguugcccaggcuggagugcaguaucaccuucuuagcucacagcagccuugcacuccugggcucaagugauccuugugcuucagccucccaaguagccaggaccacaggugugcaccaccaugccaggcuaauuuuuaaauuuuuuuuguagagauggggucucgcuauguugcccaggcuggucuccaacuccugaccuuaagugauucaccugccucggccuccuaaagcgcuggcauuacaggcaugagccacugcaacuggccaggagauaucuuacuugagucacagaacaacccuaugagguaagcaaguaguacaugacauucauaaaauaaaagcucagagcaaugaagugacuugugcaagggauaagggcaauucugugauuuuuuaugcuaagccaaauggguaguauuuuuggguguaauaggcuccagaauacuguuucaacacaaaaaaggaccaauuuuuaucacagcaauuaaaucaauaacaaacauauuucaaaagggagauuaauagaguauuaauguuuagaaagcuacuuacuacuccaauguggcaaaguaaaacugaacuuugaggguugauaucaagcgcuuuuuggaaaugcauuucugcaaggcugaauuuuucuugcuuguaauaaaucauuccuaaaccauaccugaaaguauaaaacaaaguauaauuuuaaaaauauaaaguuuagguugcuaauuuaguucaauuaguaaaagaacaaguauagaaucuggcauuuuaauaauccaguggaauacugguggucuuagaggagaggcaaaaaauaccaguuaugauaaaaaucauuaaagcauuuuauuuacuuauuuuuaaauaaaaaaauuuuuuuuugaauuagggucucacucugucacccaggcuggagugcagugggccaaucauagcucacugcauccuugaacuuccggguucaaagaauccuccagccucagccuccagaguagcugagacuacaggcaugaaccacaaugccuagccauuaaagcaguuuauuauuauuauuauuauuauuauuauuauuauuauuauauuuuaaagauagcaccucacucuguugccuaggcuggagugcaguggcucaaucacggcucacugcagccuugaccucccaggcucaagugaucaauccucccaccucagcauccugaguagcugcaacuacaggugcacgccaccaggcauggcuaauuuuuguauuuuuuguagagaugggguuuugccauguugcccaggcgcauauauauauauauauauauauauauauauauauauauauacacacacacacacacacacacacacauacauauacacacacacacacacacacacaaacacacacacacaaauauacauauauauauauauauauauauauauauauaauauauauguauuuuuuugagacagaguuuugcucuuguugcccaggcuggagugcaauggugcaaucucggcucaccacaaccuccacccacagguucaagcaauucuccugccucagccucccgaguagcuggggauuacaggcaugcaccaucacgcccggcuaauuuuguauuuuuagcagagacgggguuucuccauguuggucaggcuggucuugaacuccugaccucaggugauccgcccgccuuggccucccaaagugcugggacuacaggugugagucauggugccaagcuguuuuuuuguuuuuuuuuugagacggaguuucgcucuuguugcccaggcuguagugcaauggcaugaucacagcucaccacaaccuccgccucccagguucaagcguuucuccugccucagccuuccgaguagcugggauuacaggcaugcgccaccacacccagcuaauuuuguauuuuuaguaaagacaggguuucuccauguuggucaggcuggucucgaacucccgacucaggugauccgcccgccucggccucggccucccaaaguggugggauuacaggcaugagccaccacaccuggccuacauauauuuuuuuucuuuuuugagacagucuugcuuuuugucacccagguuggagugcaguggugcaaucucagcucacugcaaccucugccuccuggguucaagcgauuuucgugccucagccucccaaguagcugggauuacaggcaugugucaccacgcccagcuaauuuucuuguauuuuuaguagagacgagguuuccccauguuggccaggcuggucuugaacuccuggccuuaagugaucugcuugucccagccuaccaaagugccgggauugcaggugugagcuaccacccccagccuucuuauauuaacauauuuuuaauuuuuuguggagacgaggucucacuauguugaccaagcugguuucaaacucuuagccucaaacaauccucccaccuuggccucccaaacgcuaggauuacaggcaugagccaccaugcccagaccauuaaaacauuuuaaagagucacuuuuacaagcaaaaacaaucaaaucaaaucaaaucaaacuaugauaauaaggaaaaaagaaaccacaccccuaaacccauauagauuuuuuuuuuuuuuuuaauucaacgucuugcucugucgcccgggcuggagugcaauggcgugaucauagcucacugcagguaaccuugaacucuuaggcucacgcaauccucccaccucagccuccugaguaguuaggacuacaggcauacaccaccaugccuaauuguuuuuuuuuuguuuuguuuuguuuuguuuuguuuuugagauggagucucacucuguugccaugcuggagugcaguggcacaaccuccaccucccagguucaagugguuuuccugccucagucucccaagcagcugggacuacaggcacgcaucaccacacccagcuaauuuuuguauuuuuaguagaggcgggguuucaccauguuggccaggauggucuugaucucuugaccucaugauucgcccaucucagccucccaaagugcugggauuacaggcgugagccaccgugcccggccuuaauuguuuucuuuuuuuuuuuuuuuuuuuguuagggaaggggucuugcuauguugaccaggcuggucucaaacuccuggucucaaguaaucuuccagcuucagcuuccuaaagugcugggcuuauagguaugagccaccauaccugucauauucuagauuuaacagcuaauuuuuacugaguaguuauuacaugugugccaagaccauugcuaaauuaucucauuuaaucccuagaggaaucauagguaccauuaucauccuuauuucgaauaaggaaacugaaacuuagagaaguuaaauaacuugcuuaaaguuauacagcuaauaaagauucuaaccagguucuuccuuaaugauucuaaaggcugaacuccuaacaaugcuauucccacauuucuguuuuauauuauuauaauuauagcauacauagugucauguuuggcuuccuugucccccacuuacuguuaucaaaagcaugcuccuauacuuauagaccucaaaauuacaauuucuaaaggcuauguaauaguguauuagguuaauaugcagguauuucuccugaauuuucaaaaugucaaaugaauauaguguggaugguuuauauuacggagacuucucauggccauaacuagaugaugaugaugaugaugaugaugaugaugaugaugaugauggggaauaagcaucaaaugaauaagaaaaaagcacaacauaucugcuuuauuugaguggcuuuauauaucauuauacuuguguuauagaugaagaaaagguauuaaacacuaugcuaaugauagugaaagugaaaacaaaagaaaggcuaucuauuuuguacuuagaauaaaguugcucaguauuuaguuaccuaaauacgucagcauuuaaacuccuccuaguaaaagcuugccaaucugaauaauccuccuuuaaacacaauuuuugauaugguuaaguuuuuuaagaaugcaacuccugcaaaauagcugaacagacaauacacauuuaaaaaaaaaacaacacaaggaucaaccagacuugggaaaaaaucaaaaacaacacaagucuuauuaagaacugaguuccuggccggguaugguggcucaugccuguaaucccagcacugggaggccaaaguggguggaucaugaggucaggagauugagaccauccuggcuaacauggugaaaucccgucucuacuaaaaauacaaaaaaaauuagccgggcaugguggcaggcaccuguagucccagcuacucgggaggcugaggcaggagaauggcgugaaccugggaggcggagcauacagugagccaagauggcgccacugcacuccaaccugggugacagagcgagacucugccucaaaaaacaaacaaacaaacaaaaaaaaaacugaguucuuaaaauauuacagagaacauagcuaucggaagagacagcagcauuggcaaguugauuguuacauuggucagcaaaagcuagcacuauuuuuuuggccaucuuucaggcaauguaacuacuacugcaaaaugagacauaauccauuaacaacauauucacaaaucaaaaaauguuuuaguaauauaaugcuucagauuuagaagcaaauagaaugauacaacucaacugcuauaauaaccccaaagauaaccguaucugacaaaaaaacuaccacagaguuauggcuucagaauuauaccuuaucuugauauuuaaacuauuaagucaguccagaaaaauacaauaaaugucaacaguaaguaugguguugaggcagaaauaggaccaaacuuuuucauaucuuauucaguugauaacaauaugaccuagguaguaauuuccuaugugucuacuuauacacaaguacaaaaaaguaaaauagagauacugcuaaauaaaaggguacacuaaguucuuaauaguaacucaauaaaccagaacacugucaaaaagcagcaacuaguaaauuuuuucaauuuuuuuuccuauuauccaauaagugaauuaugcuauuccuuuccaauuucccaagcacuuuucaucccaaucaccauuucgguguucgaagaaaaagcaacaaaguaacaaaacuaaacaaacaaaaaacaacuacaguaucugcaaaaguuugguagaaggcugaaacuguugaguauaaggaucugguauucuauuaucauuaguuaauuuaagaguuuguuaaagacguacauuucauaagaaaacauuuuaguuagaaguuauugaccaguauguaccaucccuaaguauaaguaaccaaauucaugauaauaaagagcuaucuaacaagaaaaauuaguaaguaccagcaccaucaauacgacuuugucuuuguacuucauuaccacuuaccaugcauuauaaugucuaggauugacucugauagcauuucgaaaacaagcuaaugcuuuguccaauucuucaguuaagacaaacucaugcccuaauagaguauaggcauaagcguaauuuggaucaacuuggauagcucucuggaagaauuuaauugcaauaucauguucccguugcagacugaaacaguucccugcagcacaccaggccuuaaaaaaaugggaacaaaaaccaaacagaauuaaaauuuuacuuuuucuaaaaccaaaucuaugacuaaaaucaagccucaacuuagaacagaaagacaaaaauggaggagcuucaguagauacucaauucuaauuauucacagauuccauauuugugaauuugucugauugcuaaaauuuauuuguaaaaccaaaaucaauacuugcagugcuuucauagucaucaaaagguauguucucauuugagguugaauaaugugacucuaccuucuuguuuuagcucucaugcagagaugaccagggacagaaacucugugggcuaguuuaguguagugcaagaagcuuuggcucuggggacaguuggacagaauuugaaucccacugcuggcacuuuuaaguaggauggcuucaggcaagucaccucugaaccucauucucucucuuuuuuuuuuuuugagaucuggucuuguucuguuguccgggcuggagggcaguggugugaucuuggcucaaugcaaccuccgccaccuaggcucaagugauccuccugucucagccucccgagcagcugggaccacagaugccagccaccauaccuggcuaauuuuuguauuuuuuguggagaaggguuuugccauguugccgaggcuggucuuggaacuccugagcucaaggaauccgccugccucagccucccgaagugcugggauuauaggugugagccaccacacccagcagcauucucucuuuuguaaagaaaauaggaucuaccaggaugaguuauuuuuaggauucaagauuauaauccacaaucuaucucuguuucaaacucuccaucacucccaggaacauugguucaguagcacuaauucaguguucauguugacuacagaauuaccgcaaauaaugggaguugacuguguuuaauucuaagcuuagauauguuacaaaaguaucauuaaauauuuuugagaugcaaugaaauacaaucuuacaagauuagagcauguacauuaauugcaccuaugucuuacaaugacaauacuaauuuauuuuaauuuaaaauuauuaauuuuuucaaucuauguaacuucugcucaacgaacccuaaucuuggugacaacagcaaauuuaacguagucaaaucucgauaaauccugaaugaaauagcugcuuugugauuuuucuauuugugaaucugcaccacacauucuaggacuuucucuuccucucugagucccugacuagagagagaggaaaaaaaagaaauaagcgugggugacacuaaauaguguuugaauugcuugguucaucucuaucuguugagggugaucaaaaagguaacuauauaagcaaaguauuuugguuaacauaccucuggcgaauuuuuauccaugucuguuaagucuuuugacagaacugaaagagcaacaucuuuuugaagaugccaaaguguuguagaguagaucuccaugccuucaacucuauaauucucaauccuucuaaccucugagaauauucuuucagccugaaauaaaaaaaacuaguaagagaaaacaaguugauacaauuuauauauauacacagggaaagcccuggucauuaucuucacaggaucuaaaugcugccuuguauuaugguuuuuaugugaaugaguauuaacacaaggacaaauucagcaaucuacuauggcaggucaaauagugauguaaccauauugacagucaaccuaguauuuauauacaagccaugguaagaacaugaacucugaaaaggaaauuugaguuucuaccaaaaagaccgaagagaaaucuauacaaagcuacaauucaaaagaaaagucaauauuuccuucucaaaaaccucauuuccaaguuuuaauaauggcauuacagaauaacucuuuuuuuuuuuuuuuuuugagauggagucucacucugucgcccaggcuggagugcaguggcgcaaucucggcucacugcaagcuccgccucccgaguucacgcccuucuccugccucagccucccaagcagcugggacuacaggcgccugccaccacaccuggcuaauuuuuuguauuuuuuaguagagacaggguuucaccauguuagccaggauggucucgaucuccugaccuugugauccacccgccucggccucccaaagugcugggauuacaggcaugagccaccacaccuggccagaauaacucuuuuaggaaagaugauggaagaaugauuucuguaacauaaaaucuauuuuugaacaauuuuuaccgagagguugugccagaaaauuuagagggaagaaacagguuaagcuggcuaucaauccuaugguuauaaauccuauugagcccugaauauacacaccaauauugugucugcuaggaaucauaggcccuaccuauuaauuauccuuuccuuugcagcacucucuugacuucagggucucuccucagcugccucaucaauuuuuuuccucaucacauucacagcucccagaacuguguuucucucccucuaaaguuugaggauuuagguuauauaaaaucaguuuccuaguuuaucaauuuaccaaguucaaaauucucagcugccagaaaaggucuagguaauaaaaaaaaaaagaaaggaaaagaaauuuucacaguuuaguuuauaauaaggaauaucuggacuauucuuaaugaaaugaguaugacagaaaauaagagcauuuuaaaacugagugcuuaauuccaagaaguggucauaugauauauaggaauagcuuaacgauuuguaacuuccuugcaaucucuuaaaaguuauaaagguaagugugcagccuugaccugcagggcucaagugauccuuccacuucagccucccaaguagcugggaccacaggugagugccaccacacccagcuaauuuuuucauuuuuuuguagagacagggucucaccacauuggccagguuggucuccaacuccugagcucaagugaucccccuuccuuggccucccaaagugcugguauuauaggcaugagccaccacaccuggccaaguuuuucauucaggcaugguaacaagauaaaagaccuaccagccaaauauagguagguaccuuuugguuucaaaguuuucagaaucuguugcuuccucugaaaaaugauuauggcauagacaaaaagaaaaaugggaaaaaaacucagaaauuaaguugaaacagaggcuuucuuuaauuaaauauuugggucaccacuauaacuaggggaaacaauaaaauucauuuauguuaaaguagcugugaaacaauaaauuagaaauaauuuuuuaaauggcuuuuccgaacacagcucuugccugucuguguauaugcuacauaccaguaaaggaccauaaucgaaacauggguuuuguagcaaugaauaagacuuucugucuucaacucucuguucuguacuauucaaaauuaaauuauaugaauagguauccucuguauguauucccugugggaaagaacaccuuuccccuagaucuuugcauggaucaugaagggaagaguaaccuucccucugaguacauaaaaacaaaaacaccauacuucauugucucccaguuuccucaccaugcuucauuuuucuucaugacuuauugcuaccuguucuuauacauuuauuggcuuauaaucugucuguugcuagaauguaagcuccacagaggcaagaaauugucugacuagcuguaauacagagucuagaagagaguccaggauaucauaugcacagagauauauauugaauaaaugaacugaaagcaaauuaagcaaaaaacgaaucauaucaacuuuaauccauauuagagauauuuuauuaauauauagguuucuaaaagguuucuuuuuuuaaguuggggguggagaaaaugcuuugggaagaacuaagggguaauauaaauugggaauuagaauuuucuuuggcuuuagguuaaucauucucuccuuuucugguauagacagauaacuuaagcaacaaauuuaauuaaaauccaaagaguaaaaagccuuguauuaaagacauuguguccucaauucagcacaauuuucuuuauagcauucuucaagcuuauaaaacauauucgaugucaaaaauucaccccaguaauuaacucuguauauugcagaaaaauaaauaaauccuauuacaugguaaauauaaauauguauuuucagacacaacugaauaggacacacucuacguaagaaugucuggaugacuugggucucuauaaaccuauuccgagaaguugcaaagaauuuaaauuacuccuuaacacaagaaagaacuauaucuauaaauuauaaauacugacaaaauaaauauauagacauuacauaauaaauacugaucuuuuagaucuagccuucuuaagcaugggcauuuauuuuaaugaaauugaaauuaucucuagaaaggcauauauaaccauuuucuauacuuacuugcauguacucugaaaguucaaaauaggcccuuccaauuuggcacaguacccaaccaguauuguaguggugagaagguagauggcucaaaauauuuauagcuucuuugcaguuguaugaacacaaagcuaaauaaccuuuccccauuucacgaagaaggcucaucaaaccuucuaggagaaaacaacauaguaaacaaaggaaaaaacgcaauaaacuagucugcuucucuagaaaagguaauuacaaacuaaucuauuaaaaauuccaacaucuauauaaaaaacaaugaagguacuguaaugaacauaaagaaauuuacuuaaaauaaguacauaauaaaauacaaagauaauauuaagcauuuaaaacagaccugcugcugcuuuuuguagauuaaaggccugaaucugaggugugauuguggauauuuucccuucugaaaugauggaagaguccaauuuuguaauuuccaggcuaucauuuauguuagguugaguuauuccuccuuuauuaguuuuacuuuuuguuuuucuguuugggauuuuagguggaaacuucauuuuuaauuuuuugcuauucuccuguaaaagggaagaaauuucacaccuguuauacucauguauuuuagauuucuccucagcccuuucuccaguauuagauauaaaauaaauguacaaucuugauuaauucuauauuuuuuucagaagagaguuuauaaaaacaaaggucuucaaagucauuuaauuuuaaacacaguaauucugaacauaaauuacauuaacuaauagugacuaaggugugucagcauuaaguguagcccucuugugaaaguauaucaaacucucauuuauuauuuaaaaguaagaaaauaaguagauguaauucucagcucaccgcaacccaaccucugccucccggguucaagcgauucuccugcuucagccucccgcguaacugagauuacaggcaugagccaccacgcccgguuaauuuuuauuuuggaagagacuggauuucuccacguuggucaggcuggucucgaacuccugaccuuaggugaucugccugccuuggccucccaaagugcugggauuacaggcaugagccaccgugcccggccuuuguuuuguuuuugggacaggaucuuauucuguugcccgugcuggaguguaaugauguaaucagagcucaccacagccuugaccuccccaggcucaagugauucucccaccacagccucccaagcagcugggaucaaagaguacuaccaucccagcuaauuuuuuuuuucagagauggggucuugcuauguugaccaggcuggucucaaacuccuaagcucaagugaucggcccaccuuggccucccaaagugcuaggauuacaggcgugagccacugcguccgccgggucuccaguuuuuuuuaacuuuuauuuucaaauaauuuuagacucacucuucugcaaaugauaacaugugacauaaccauaguauaucaucauacccaggaaacugaaauuaguacaauauuaucagcuaaagaccuuacauggauuucaucaguuuuuauauaaacccguguguguguaugugugugcauaguucuauaaaauuuuaucacgugaauggaucuguguaaucaaccaccacaaucaggauacaggacuguuguaccaccacaaugcaauucuuuugugccaugauuuaauaguaacauccucccuagaggccuaacuccuaauaaucacugaucuguuguccauuccuauaauuuugccauuucaagauuauuccuaugucauuuuuaacuugagaaaaaaaauuuuuuaauuaaaaaagaauauuauauaauauuuaccaaaggacuaauuaacuucacaaaaaucauagauggcccucuaaauuaaaacauuuuaaaauucgaaauagucucuuuguuaacuuauuaggaauggagucaucaaugaacagaaauguuagcaggcgaagcauuaaguaaaugugacauacagaaaucuuuaaauuaccuugguuguggagcugucacuaguaaagagucgugaacuucuucgaggcagugcguuugggggagauguaauaguggggcucaauaccugagguguuguacuaaaaaaaaauuauaaaggaagacauuaauauuuuacuugauuuaugaccauuaaccauuguuucaauuuggguauauuuuaaaaauauacauuaauuauauaaguacucuaaaguugaugaauuugaucaguucuuuucgugguuucucuaugaaaacacaguauuuaaaaaugagggacucggacuggcuuuccugcuucucagcuugcagauggccucuugugggacuucaccuugugaucauaagucaauaauccuuaauaaacuuuccuucauauaaaaaaauaaaaauaaaaugacucguuacuacaaaauaguaaagauuauagcauagaucuucacucucucugaaauucuuaauuugaacuaaaaauaauccucauaaaacucuggaucgacaaaugauaagcacaucuauaaaucaauuauuuuuacccuucauuugcaacuacaacaaguuagagaaaaaagaaaagacaguugggcaaagauagucuaaaugugggguauuuguuaacaaguaaauaccacuagaacuacuaauauuugagaaguuauuucccuguaaauucaaacagcuauaucaaaggcuuauucucuuuagagcgaaaggagccucuguacauuuuuacuuuaaaggcaaacccugagauaugagaauuucaaucuuagcaagcaaacuuaaaaucugaaacaaucuagaauugacaguggguaaacuuguggacuaaacuaucuaaacuuuauaauuuaugggaaauccuacuagcuaccugagucugggucaaagaauuucagaaaauaaaaagauauauauuuucaucuuuuacgauauguacauauguaauauguacagauaccucuguauaugcauguguguguauaucacacacacacacacacacacauaaauccuuuuaaucugcaucugauaaacuaggaguuugauaacgaaaggcuuccaaaguucagaauuagacuucacuucauauggagcaaaugacacacaaccuuucuuggaugauuuagcuaaaaguacuaugccauucuaaucaucucuaaaaaaacuuucuaaauagaaagaacagacuuccgcuagucaugacagaguaaaauggaauaaauuuauucucccauuucagauaacuacaaacugaaccaaauauauggaacaaugguuuucagacacuggacaauaggcaaaacauuuccgaggacaguucuagggccaccuugcaggaaaaaagaaugcaaaauagagcucaguggucccacuguguugaaaagaaaauguugagaauuugagaaagccaaagcagccagaauuugcaaggcagagcaccagagagaagagagcuacaaagaggagaccuacaaagaucugcagagggcuucccuagagucuucaguugaaaauugaucaguguagguguuugaguguuauauaauaaagaauuugucugguccacgucccaggcuccugagaucuacuaaguccuuggaauuccucaagugacagggaugucuuuguuauucauuaugagcuccugggaccgugccugaauuuaugcuaaugaaguaacuccuagauacuuucuggaugggugcuggcugugcuguaaaggucaaccauguggccgggcaugguggcucacacauguaaucccagcacuuuggcaggccaaggcaggcggaucacgaggucaagagaucgagaucauccuggccaacaugguggaaccccaucucuacuaaaaauacaaaaauuagcugggcaugauggcgggugccuguaaucccagccacucgcggguucaaguguaaucacuugaacccgggagguggagguugcagugagccaagaucgugccauugcauugcagccugggcgacaacagcgaaacucugucucaaaaaaaaaaaagucaaccaugugauuagagggcuggggcuuugagccagcaacaccagccugagcuccucugggaaggaaauugaguucaaucauguggccaaugauuccaucaaucacaccuacauaauuuaaaaacccuaauaaaaauuuugaacaccaaaacuuggcucaaauuccugguuuguaaacauacugaugcauugggagggugagcccagaaagaagacaugaaagcucuguaucaggacccucccauaucuaauccuauggaucuccuaauuaugucaucuacaauaaaacuguaaucauuaaguauagcacuuuccuggacucugugaggugcucuagcaaauuacugaauguaagaggguaguaggaauccuuaaauuuguagccaguuggucagaaauguggguggccuggggaacccagaaccuacaacugggcaguucagacaguucuuguuggggacugugaucuuaaccuguggugucugugcuaaguuuggguaguuagcaucagaauuacauuauaguacuauagugaagaaacuacccaaagcuggggaaaguauuacugaaaagaagcagacagaauaauuacuggaucucacuccaagcugggaauagcucauacuuucaauaggcagagugaagaaaccucauacuaaacagguuuuugaggagaguacucaaaggguacuuccucaauggugggacaagauuaguccagacuaaggcuacuuuugucuggacaaaauuuaaaagguaagaccugaagggaucaagcuguuuccaagcaacuuuacugcaucucagaauaaaacuuuaaaauaccuaaaggaaugcaaaaauauccaguaaucaacaauguaaaauuuauagccaggcacaguggcucacaccuguaaucccaacaacucgggugggugaggugggaggauugcuugaggccaggaguuugagaacagccugagcaacacagcaagaccccaucucugcaaaacuaaaaaaaaauuagccauauguggcacgugccuauaguuccagcuacccaggagccugaagugggaggacuucuugagcccaggaguuugaggcugcacugagcuauaaucacaccacuguacucuagccugggcaucagaguaaaagacccugucucaaagaaaaaaaguaaaauuuauaauaacugacauccaauuaaaaaacacuaggcagccgggcgcgguggcucacgccuguaaucccagcacuuugggaggccgagacgggcggaucacgaggucaggagaucgagaccauccuggcuaacacggugaaaccccgucucuacuaaaaauacaaaaauuagcugggcaugguggcgcgcgccuguagucccagcuacacgggaggcugaggcaggagaauggcgugaacccgggaggcggagcuugcagugagucgagaucgcgccacugcacuccagccugggcgacagagcgaaacuccgucucaaaaacaaacaaacaaacaaacaaacaaacaaaaaaaaaaacacuaggcauagaaaacagcaggaaaauauaaucuacaaugaagaggaaaaguaauauaagaaacacuuagaaauaacaaaguaacagacuuaguaggcaaaaacauuaaaaaaauacaaauacauccuauacguucaaaaacauagaagagacuggaugagguggcucaugccugucggcccagcacuuugggaggccaagccaggacugcuucaggcccggaggucaagaucugccuggacaacauagcaagaccuugucucauagagaccuuguccuugucucuacaaaaaaauaaaaaauaaaaauaaucagccacaugugguggcaugugccuguagucccagcuacucaggaggcuaacgcaagagaaucgcuugagccaaggaguuugaggcuacagugagccauaguagcaucacugcacuccagccugggugacagugagacccugucucaaaaaaaaaaaaaaaaaaaaggcugggcgcgguggcucacaccuguaaucccagcacuuucggaggccaaggugggcggaucacgagucaggaguuugagaucagccugaccaacauggugaaaccccaucucuacuaaaaauacaaaaauuagcagggcgcaguggcacaugccuguaaucccagcuacucaggaggcugaggcaggagaaucgcuugaacccaggaggggcggagggugcagugagccagauugugccacugcacuccagccugggcaacagagcgagacucuaucucaaaaaaaaaaaaaaagaaagaaagaaaaccaaaucaaucuagagaugaaagacaaaugucugcaauaaaaaaacaaaacaaaacaaaaaacccaacaacacugggugugguuaauaacaggucugacacugcugaagaaacauuaauuugaagacauagcaauaaacacuauccaaaaugaaacacggagaggagaaagauuggaaacaaaaaugaagaauuagugagcuguggggcaacuucaagcaaucuaauauacaaguaccuggagucccagagggagaggguaagacauggacauaauauuugaagaaauaaugcccccaauuuagccaacuauuaugaaaacuauaaacccacagauccaagaagcucaauaaauccaaaggccgagaaacaacaaagcuacacuagagcacaucauaaucgaauugcuuaaaaucagcaauuaaaaacaaaaccuugaaacagagaaaagacauauuacuacauauagaggaacaaaaaugagauugacagcagauuucuugucagaaacaauauaagccaaaaaaccaguaaagcaacaucccuaaaaaaauugucaauuagaaauucuuggccaggcguaguggcucaugccuguaaucucagcacuuugggaggccaagaugggcgaucaccugaggucaggaauucaagacuagccuggccaacauggugaaagccaaucucuacuaaaaaugcaaaaauuagcugagcaugauagcacaugccuguaaucccagcuacucgggaggccguggcaggagaauugcuugaacucgggaagcagagguugcagggagccaagauugugccauugcacuccagcccaggcaacaagcaagacucugucucaaaaaaaaaaaaaaaaaaagaaaaagaaagaaauucuugccuaguaaaaauauuguucaaaaauaaagaugaaauaagaacuuuuuuucugauccacaaaagcugaaaaaauucauuaccagcugacucguacuauaagaaaugauaaaaaggccaggugcgguggggcucaugacuguaaucccagcacuucgggaggccaaggcaggaggaucacaaggucaagagaucgggaccauccuggccaacauggugaaaccccguuucuacuaaaaauacaaaaauuagcugggugugguggugcacaccuguagucccagcuacucgggaggcugaggcaggagaaucgcuuuaacccagguggcagaaguugcagugagccgagaucgugccacugcacuucagccuggugacagagugagacucugucuuaaaaaaaaaaaaaaaaaaaaagaaauguuaaaaagaaguccuucaagguggaggaaaaugauaucagaucgcaaucuggaucuauagaaggaaagggcaccagaaauuguaguuauguguguaaauauaaaauagacuucuuuuucucauuuaaaaaaauuucagcugggcaugguagcucaugccuguaaucccagcacuuugggaggcugaggcggguggaucauuugaggucaggaguuugacgcuagccuggccaacaucgugaaacccugucucuacuaaaaauacaaaaauuagccgggcgugguggcacaugccuguaaucccagcuacaugggaggcugaggcaguagcauugcuugaacuggggagguggagguugcagugagccgagauugcaccauugcacuacagccuggguaacagagcgaaacuccgucuaaaacaaaaacaaaaacaaaaacaaaacucuauaaaaagacaacugacuguuuaaggcagaaaccacaaccacaauaaugcacugugggguuuauaacauauauagaaauuaaauauauuacagccaucccucccauaaagacuaagagaggagcacgaaaguauacuauuguaagguucugugcuauacaugaaauugucuauuacuugaaggcaaaccuugauaaguuaaaauguuuacuacaaacuccaaacaaccuuuaaaaagacaaaauaaagagcaauugcuaauaaggcaauauugaauuguaccuccccaaaagauauguugaagcccuaagccccaguacaugucaaugugauuuuauucagaaauuugguuuuugcagaugucauugaguuaagcugaggauaucuggguugacccuaauccaauauaacuguugucuuuacaagagggaaauuuagauacagaaacacacauggaagaugaccaugugaagacagaggaagauacugaguuauacugucacaugcuaaagaacaccugggguuaucagaagcuggaggaggcaaggaaaaauccuccucuaaagauuuuggaaggggaacaacccugccaacaccuugauuuuggacuuauggcuuuacaacuguaagagaauaaguaucuguuguuuuaagacacuaaguugugguacuuuguuauggcagcccuagaaaacuaauauaggcaauuaaggagauaaaauggaaucaacaauacaaagaacacaaaauuauuaagagugaauguuggccaggcacgguggcucaugccuguaaucccagcacuuugggaggcugaggcaggcggaucaccugagguugggaguucgagaccagccugaccaacauggagaaacccugucuuuacuaaaaauacaaaauuagcuggguguggugacacaugccuauaaucccagcuacucaggaagcugaggcaggagaaucacuugaacccgggaggcggagguuguggugggccgagaucacaccacugcacuccagcuugggcaacaagagugaaacuccaucuccauaaaaaaaagagcugauguuuauuaguguuagucuauuuguuugacucuaaagugaaauguacaaaucggaaauuauuuuuacauauaauguugcuuugcaggaggucucaaguuccuucucacaacagagccucaggcaaucacugcaagcuggcacucaagaggauuagacuuaccauucugggagcauuacaggaacauagaggucuuuuagauagucaaggagguauaugcacaccuguguguaugucuguuuuaaaauuuagguacauguucacaguuuuagaaaggagaaagaaaauuguaucuuccuuuuaaaauguuagcuauaaucuauugaguccuugaagaggaaaagaaaauccuaucuaacaccauuucuguguggaaauagauucauuauuugaaguuuauuugucuguuauuuuuauaaucuguuuauagacaugcauaauguggggaaggggaguaugaaaccuaucuguaccuaaacuauagaaagggucaugugcauaagaagaaaauuacaaauccaugaggcaaucagaguaaacuaaaaugcugcuuuaguuaacuauugucuucugugcauuacaaaacucaacucaaaauuacauuaguguuguaaguuagagguuucaaauuuuacaucuucaaaauuuacaguaguuauucuagaauccacgagagucacuaucugccuaaauuaaagaaauguaaagaaucaaguuuuaugccaagaaaaguugaauaauuacaaugauaaauaccuuguuuguggaccagaacuuuguguuugugcaagaauuggaguuaccucucggcuauuuccacucugugagaagacagacuuuguuccaguuuggccgauucuggcaacagacuguaaaacacgaaaagucuaagguuugugaauuaugggcugcacuguaaaugauaaaagacaacacaacgcucccaucuacauuuucucaauacaagcagccauaauauacugucaccuuaaagauaaacuauuuauaucauauuguuaauuauuguuguauuaguaugaacaucagucuauuucccuguuuuaaucucacaguauuuuuaccucuauaaugucuuuucaucuuucgcuuuuuguuucaaagacuaaaaauccccagaagcuauucuuuucaucucauugugaccauccuccauuuauuacauaccuucucuauuugggguuaaguacuaaaaaauuuuaagacagcuaaauucucaagauuuaugauuuaucucauuauacacagaaaaaaauaauaauacgauaagauuuuauacuccuuuggcacuugguaacaguucuaaaggaguucagaggaguagauuuuaaaaaaacaaccaucugauuacuuuccaaaaccuaaggauauuguucuuuagaguuaauauugcuuaguuuuucuaaucuucauuaauugguuucuguucccuuggagaaaaaaaaaucuuugcuuggcucuucagucuucucuaauuuauucccuuauuucuauucauuuccaccaucuagcuucuuuaaaugaucuaugacuauuguaucagugcacuguuuuuccccuuuggcuaccagagaauuuucuucaaaacuuacuguuacccugauguccuguacacaauccucaaacugcauauuauaaauaaucacuaauaaucacugucucaucagauauuaaaaccuuauuuuagccuuuccugcauucaacaucacugaucaugcccuacuuuuugaaacuuuguguuacuuccaaaacauuacauuauuuguccugccacuucauuugcuggcccuuuauccuucuacuauuuuuaaauuagguuuacucuguucuccuuagcuacucuuucuuucccuaggagagccuggucauuuuaauaguuucaauuauuauuucuaucagcaggucacauuuuuuccucuaugacuaacuuucuacugaauauuuucaucuaauguaccaccacuucaaaauaaaacuucauaagccuuccuccgccuuuuccaaauugggaucacuacauucauccaagggacaaaagucaacucuggcuuuuccuuauuuaucaaagaacuauguacacugcacucaauaccugguuugauauuuucaguugacacugcaugcagaccuacaugcgugacuuuucugggaaugucuuguaauaagguaagaggagaacagaggcagaagaggaugagagagcaaucuuaucugggcacuaaaaucaugugccugcccacugucuuaacuugcucugguuauuaugguuauuauggcucuucuaguuuuggccuacuucaccuggcaugcuaacuaccauuuuguuuugccuucuucauaacuguaauguuuaaaacaauccauacacaaacuauuuugcagucccuuuuaaguauucuuggaguuccuauuaucacucacuaaggaguuauuauagaaaaaucuuuugcagauucuaaggauguucaggaguaaaauaguaaaaaaacaacuauaagaagaaacauguuucuauuaagguaaagagaguauaacuguuauucacauauuaguaugacuuguuuagcuuccauuucuugaauauuuaugaagcauggcaauagguauuuuauauauagaaccuaauuuaauucucacagaaguuaccuugugccacagauaugcuuuuuaaaaaugguauuuuggccucuauuuccauauaccuauaaaagggaacauuauaaaacaagagccucagcagggcagugacucauguuuauaauccuagcacuuugagaggccaaggcaggaggauugcuugagcccaggaguuugagaccaucccuggcaacacagugagauccugucucuacaaaaauaaaaguuaaaaaaauuagcuggguguggugguguacaccuauaguccuagguacuugggaggcuaagguggaaggaucacuugagccugggagguagaggcuacagugagucauggucacaccacugcacuccagccugggcaggagagcgagacccugucucaaaaaaaaaaaaaaaaagccucaugaaacuugccgcaauauuuacuauaaguauacuaccaaauauuuuucauuuucauguuaaaacuauacauccaugaucuaccaaaaaucuuauuaucagaaauaucuggcuuuaccugagcaaauuuuuuuucauauaauuauuaguguuauuaaaaaaacauauauacacagugguagggacaaguaaaaacuauggcagacauaauuucuguuauuuauagucaaguaauauaaacaauauuaauuuuguuuuuuaaaaaggaaauuaaaaaguaaaaauaugauuauguuuauuuaacuauaugcugaaauaaacuaaauuugugagauacaaucuuacuuggccaaaagaguaagaagucugucuccuacuguaaccaagaggcuacaacaauaaugacauucuuuuauauuuagaucacccucuaccugcuggguucaaauauaaggcaaaagcaauuacauaaaguaagauuuucccugagauuaccuuuaaaagauugaaauaaacaaguugcuuuaaucaauucccaaacugcauuuuacauggaaaauaccuuuuuugaaggggcuccgguggauggcacaucaauuacaggagguguauuaguguaguuuuguaaauaggauccaucuccaggacuugggguuucuaauggcaaaaucccaaaacugagaagagguugaaaucaaggugucaaaaagucaucaaggcauauauaaagcagcaguauacuuaaauuagaaggucuaaaaggaagagaauggcaaaucagucuuagggacagugaggaucugaggggcagauuaaaaauaagcugugaauguagacuauuccacccaccauaacuaaaauuuuaaaaagcuaucaaacaaggaacuaaacugagcaacaauuacugaucucaggagauuuauuagaaauaaagaagaguagcuuuauaaaucuaagauccaaaugaugagauuacuucaaauucuuggaauuuaugggauuuagacacaacuacagagaaaaugucucuagagaccauuagauaacuauaacucuccagaguuguaaucucauggucaugcuauuuuaguaguuccccggccucaggaccugauucauagaauuucuucuagcauauauguauauauuuuuuugagacagagucucgcucuguugcccaggcuggagugcaguggcaugaucucagcucacugcaaccuccaccugcuggguucaaaugauucuugugccucaacccccaaaguaccugggauuacacguaugugucaccaugccgggcuaauuuuuguaauuuuaguagagauaggguuucaccauguuggccagacuggucuugagcuccuggucucaagugaucugcccaccucagccucccaaagugcugggauuacaggcaugagcccccaugcccaacccauucuagcacauaauuuuucauuuugauacuuuuggauauguauccucugggcugaguuccuguauuuauacauacauauacuucuaauaauuuugauaaaauauuuuauauuaauaggugugacagcuagguucaguggcucacgguaauccuagcacuuugggaggccacagcaggaggaucacuagaggccaggaguuccagaucagcuugggcaacacagcaagaccccaucucuacaaaaacacuuaaaaaauuagccaggugugguggcaugugccugcagucccagcuacucaggagucugaggugggaggaucgcuugagcccaagaauuugaggcugcagugagcuaugauugugccacugcacucuaaccugggugacagagugagauccugucucaaacaaaaaaagguaggugucaaauuuccuccauguuuuggaaaaaggcacuuuaacaguaaccaguggugcccugauuauaacauuucaugaggcucaccgcuauccauuaaugcacagccauaaagacaguauuuuuuaauguguuuacuaccuaauuaaggaauauuucagaguuuuaaauuuuccuccaauuuuuuuuuugagauggagucuugcccugucucccaggcuggagugcagugacaccaucucggcucacugcaaccucugucucccggguucaagugauucucuugccucagccucccgaguagcuggaucuacaggcgcgugccaccacacccggcuaguuuuuuguauuuuuaguagagacgggguuucgccauguuggccaggauggucucgaucuccugaccucgugaucugcccaccuuggucucccaaagugcugggauuacaggcgugagccacugcgccuggccaguccaauauucaauaucaauuuuuuuugaguuggagucuuggucugucgcccaggauggaguguaguggcuccaucucggcucacuacaaccuccgccucccggguucaagcaauucuccugucucagccuccugaguagcugggauuacaggcgcccgccaccaugcccagcuaauuuuuguauuuuuaguagagacaggguuucaccauguuggccaggcuguucuugaacuccugaccucaggugaucugccugccuuggccucccaaggugcugggauuacaggcaugagccaccgcaccuggcaacaucacuauuugccaguuuuuacuucauuuucugaaaacagaaugccccuguuuccacagugauuuagaaguugcuguuguaauaaucugcauuacuaacaauaugaguuaucauaagaucauuugguauuauagcacauuugaaaguaucuuguuugacuuaccuugggguuaauggacuaagagcugcugguccuccuaauaaacuucgaccaguuuuugguuuauuuugaaccuguuuagauaauauggaaguuccuguucccagugggacaguaucaggugaaauuacagcugaaucaauauaagacacugaggaaucuguauucaaggaguacuuugaauuggaagauucuaaauucaaucuguuuaauuccugaaacagaaaauuucuaccaagucauucacaauauauuauuuaguucagaucauucuuuguaguuuucauaauauuuugaacacuagaauauaagacacuuacaauuguguccugggguguuuccguaagaacugucucaggcugucugugagauaaacuaugauuagguacuuguguugugcaagaguugggcagacaguugcuaaaguucuguaaagaugugaauuuaaauguuuggucaggaucuggcuuuucaccugugaagacaaaaaaaaaaaaaguuugucucugaggaagugaggaauacauguuuuucaaguaugcauaaaucaguggaaacaggaaauaggccuuauccaaacuuuaaaaaucuccuguccacuucugcuaaucaaauuuacccccaaaaaacccaucuaucaauauaucauaaaaguuuaccaguaagauaaagcuguaaaugaaaauaaacuacaagaacacuaauuuuaaacauaacaaaucgcagaaaaaugcagauuucuguguuuguuuuaaagcugaaaauaacuagaucucauuuuucucaaaguaggagaugagguugaagaguuaaaacccaucauauuuuacaguaaagguugaagcccuucuauauauacauagaugcaacaaugcugaaaaaugguccuuuauguauccuaggccaaauauacugagaaauucucucccuguacuguucaggucuuguaaguuucaggcauuuauuaauugcauuagaaauuuuauuaauuuucuuauucagaaagcaauuuugcuaguguuaaacacacaauauaacccauucuagaggacaccagauacuugaaaauagauugguucaacagaagaaucuacuggauuuaaucuuuguguaauuuucaguuauaugauucuugaaacauaccgaagauucuaacuuauuuuuuauucucaauuuuaacuuugaaaaauauuuuucuuggggguagaugaucuguauugcucuccaaaaauuaaguagcaggaaaaaaagaagaggagaugggaacccacccaccucucaaccccacccaccuaccuauuucacauaaugauucaaagggagaccagaggaaaggauuuaaacuaaggcucuuuugguaacauucugauccuuuggcaagccgaucugucuugcuguggagagaaacaaguagauuaaauaagcuacaaaccccaaaaccuguaucauaaacuuuuaguauaaaaaauuagguaaaaguuacagaaguucagagagcacucuuugugaugcuucucuaaguuaccaauuucucccaucugcuaaucuccaaaucaagugaaagcgcacagaacaugaaucaaaagaaaugcuuacaaaacaaacuaucguugccuucuugaauauuacuauuacuuuaaacuuccugucagauacuagaguuauugagggagaugugaaaaacauccaaauccuucaguauuauucuuaauuuuuuuuuuuuuuuuuggacaaggucuggcucuaucauacaggcugaagugcaguggcaugaucuuggcucacugcaaccccuacuuccuacgcuaaagccauccuccuaccucagccuccugaacagcugagacuauaggugcgcaccaccauauccggcuaauuuuugcauauuuuguagagaccaggcuucaccauugaugcccaggcgggucuugaacucaugagcucuggugauuuaccugucuuggccuuccaaaaugcugggauuacaggugugagccaccgcaccuggccuuuuuguauuuucgucgagaugggguuuugccauauugcccaggcaggucucgaacucaugagcucaagugaucugcccaccacagccucccaaaaugcuggaauuacaggcgugauccaccacgcuuggccuuaauuuuuaauacaacauucccagugguaauucugaaagugauuuaaaugcuuuaaauauagcauaaaugaccagguuuuuauuuguuguuguuuuuuuuccaggcuuaauucacuuuauuuuucuuguguaaaaacccuauguuguagccacagcuggagcccggguccucuguacggagacucuagugugggucuugacgagguggucagugaauucccgauagggagacuuggugaauacagucuccuuccagagguccggggucagguaguuguaggucuuagagauggcaucaaagguggccuuggugaaguugcccaggguggcagugcagccccuggcugagguguagcagucaucgauaccagucaucaugagcagcuucuugggcacacgugccaagacgaugcccgugcuccugggggugcgacgaggcgcaccagcacagagccgcaguggccugucaccuugcaagggacggcguagggcuugccaaucuuguucccccaguagccucugcgcacggggacaaucgagaguuuggccaggauguugauggcccugcagauggcaguggccaccuccuuggagcauuuaacacccagaccgacguggccauuguaguccucgauggcaacaaacgccucgaaccuggugcccuggcuggcacgggucugcuucugcaccggcauaaucuucaaaaccuugugcuugagagaggcccccaggaaaaagucaaugaucucagauucccugaugggcagggagaagagauagaucuccuccagggacuugaucuucauguccuugaccaggagccccagcuuggugaugggaaucuacuccuuauccuuggccuugccuccacgagcuccguggccucggucccggccccauccacggcugcgaccccagcccuggaugccacugcugaaaccucugcuucuuuuuuuuuuuuuucaaacaaacuagaggugguaggucuuuuuccuccccucuccccucaagaucuguuuguggaggaucugcuuccuuaaugaaaaggaaaauuuauguuucuuucuaaaucagguguauaaacgcuuacauauggaaucuggacaauaucccugggaacauauauacuuggaaaaaucuggggauuaucagaacagcauugcugccucucuagcuuuuuuuuuuuuuuuuuuuccugagagucuggcccuguugcccaggcuggagugcaguggcaugaucucggcucacugcaaccuccaccuucuggauucaagugauucucaugccucagccucccgaguagcugggauuacaggugcacaccaccaugccagcuaauuuuuauauuuuaguagagauaggguuucaccagguuggccaggcuguuuuugaacuccuggacucaagugauccacccgcuucagccucccaaaguguugggauuacaggcgugagccacagcaccuggucgccuccuccuuagcuuuuaaauaggaggauggaagggguuaguggcuagugagaccaauuaaagcauucagguaaaaaauacaacuuaccuggucugaaguucaaaugcuucaauaucaaauggaaaaaaauucagaacagcaauucuuccaaaauucuaagguuuuauauauaaaggaccagaagaaaucuaaccgagauccucaacugaaacuaucagguaaaauguauacaucaucuguuuaugugcggaaugucaguauaaccucagagaacuaugaagaagguacccuuggggaaccagauauuaguuugccucacugccaaauuuucaagugaguaaaaacuagaaauaagugauaugacaaagaaaguacuaccaguugaaggauaucuagcuucccacacuuguguaauuuaagccaauaaacaaauggacaaaguaggaagcagaaguaggaugcagacuuuuggaaaacauaaauaaguuuuaucaaagucuguaucuaagaucauuuagaucaaaaauuucuuucuuuuuuuuuuuuuuaaagggauaggauccugcuauguugcccaggcuggacuccuggccuuaagugauucuccugccucagccucccaaguagcugggacuacaagugcaugcuaccauggcuggcuaauuaaaaaaaaaaaaaaaaguuagcgguguuuugcuauguugcccaggcuggucucaaaccugggauuacaggugugagccaccacaacuggccugaaauuucuuaaauauaauugucauaagacugacauaaucacccaccagggauagagugguaauuuagaaauaggaaaugaagaaagggcauacaaaaaaacauuugcugaaaguaauaggguggaacguggcaaaucagugcuugggagcuuuuaacauaaggcuaagcaaaagaaaauacacagccaggcacgguggcucaugccuguaaucucagcacuuugggaggccaaggcagguggaucacuugaggucaggaguucgagaccagccuggccaacacggugaaaacucgucucuacuaaaaacauaaaauuagccaggugugguggugggcaccuguaaucccagcuaccugggaggcugaggcaggagaacugcuugcauccuggagguggagguuacagugagucgagaucaugccauugcacuccagccugggugacagagcgagacucugucucaaauaaauaaauaaaaacaaaauacagugaaaucucauuguuugaggauuauccuaagcuucaaauaggucaaugaccauuucuucauuuuuuuuuuuuuucuucuuguaguuccuaaguaaagccauucccucaggccucagucccuucuuuagaaaaucucugucuggugagaaucccuucuacagagaugacaacuaaaucuacuucuaacuucaaccuuaccuuuccuuugccugaugggcaauuucaucuagguuuuacuuccuuaucuaaagcuuaguaaauucaaagucaaguucaucuuuucuccccaaaaucuguucuuucucuuucuuucuguguguguuuuaaggacaccacuauuuuuacaaguuuacagacucaaaaauccuacuuagagauagcacugacuccuucuucuucuccucugaccuucacagccaaucagcaacgaagccauaauucauguacuuucauuuuauuucuggcuuaaguucccucuuuauuuucacuguuaggauccuuauugcuucucaucuaaaccaucaauagauuccuaauuaaugucuugccucuucaucccuucaauucaucuaucuaggccccuucugucucauaauacuaaccauagucugccuauuuaucuuuucaagcauucucucuugcaagugauuauaagcucucugagaauggagaauuagucuuugccauuuuuauacuaccuguuuccuguuuucaaguagccccguccccuugcuuugccagcagaaugugauauaaaacagacauuuuuauuaauaauuuuaaaaguugcauuagugaacuguaugaauuauuuacauggccagaaaggaaguagacaaacauugauuaagcaaagacaaaauaaucuguuacgggaaaaauauucuggaaaaguaagaggggugauccuuugugcugaaaagucucauuuccaguauuacuuaaauuaaaauuguauuauuuuuauauuaggaaaagaaaaaaucaaacuugguuaaguuggcaaggcugauuuuuauaaugaguaauuauuucaugaauagaccacaaaacagaagaaauuuaaaucaaaauucaugucuguuaagagauuagauacacauauggauagauauauguauaaaucacauaagagcuaacuagggaagaagucagguguggaauuauaauaaucuagccuggaagauaaaaccucuaauuauucaauagagagauaaaaggggacaaagauuuaagaaaaguaaagugcugggguacucuaaauuuagaucgaaguuuuuauuaaaauugagugauacacacaaaacccagccagaaguuuccuaaagaacuggcauaaaaaauauuauuuaagugguauugggaagaaauaggauaauuuaggaaucagacuuaguaucaguuguguccuaaacauagaagucucaugugcuguaauagacaaaaagacaaaaaaaagucuauacuggagauagaaaagaaaaccuaacacaccuuagcuacaaaaccacauguauguaucuagauuacuaggugcaauucugguauauaauggcuaaaaugaaaagccaggauugggguaggguuguuccacuuucaauacucaaucuuuuaaucuugaugaugaauaaaaauaacccuuggcugggugcuguggcucaugccuguaaucccagcacuuugggaggcugaggugccaggacugcuugagcccaggagcuuaagaccagccugggcaacauagggagaccccauaucuaccaaaaccaaaaaaauauaaaagaacccauccauauuccucugaagaaggagaaaaaagaacuuccuuguuuacauauauguauacauacacacacauaccuuucugaggaacugauuuaacugcaucuuuaaaaaaacuuuaaugauuuuaucugaauaguucagugccacaugacauucuguuacaacagaucacauguaugacaauagucucauaagauuauuuguuucuuuugcuuuuuuugagauggaguuucacucuugcugcccaggcuggaguacaauggcacgaucucagcucacugcaaccucugccuccuggauucaagugauucuccuguuucagccuccccaguagcuggauuacaggcucgugucaccacgcccagcugauuuuuguauuuuuaguugaggugggguuucaccguguuggccaggcuagucucgaacucuugaccucaggugaucugcccgccucggccucccaaaaugcugggauuauaggugugagccacccugccuggcccccauaagauuauaaugccauauuucuacuguaucuuuucuuuguuuagauacacaaauauuuaccauacuguuauaacugccuacaguauucaguaagguaacaugcuguacagguuuguggcccaggagcaauagguuauacaauauagccuagguguguaguaggcuacaccaucuagguuugugcauaugcacuuuaugauguucacaaaugacaaaaucaccuaaggacacauuucucagaacaaauccccaucauaaagugacacaugacuguauaacauauuugugauuuuaacuuaauuuuuuuaaacuuuacuuuggaauaauuuuagacuuacauagaacuugcaaaaacaguacacaguucccauguacccuacacccagcuucccccaauaauaucugacauaaccauaguacaguuaucaaaacuaggaaauugacauuaguacaaaacuguaaacuacgcuggacacgguggcucaugacuguaaucccagcacuucgggaggccgaggcagguggaucaugugagguugggaauuugagaccagccuggccaauauggugaaaccccgucucuacuaaaaauacaaaaauuagcugggcaugguggcgcucacauguaaucccagcuacuccggaggcugaggcacgagaacugcuugaaccugggagguggagacugcagugagcugagauugugcaacuguacuccagccugagcgacagagcgcaagauuccauuucaaacaacaacaacaacaacaacuguaaacuaaaccacagagcuuauuugaauuuuagcaguuuuuacacguuuauauagagaauauuaucacauuuacaaauuucuauaaccacuacuacaaucaggauauaaaacuguuuuaauaucccaaagaaaccccuaaauaguuacauccucacccuaacccaaccugagaaccacugaucuguucuccuucacuauaauucugucagauuaauguuauauaaauggaauuauagaaacuucugaaauuggcuuuuuucacuugccauaauaaccuuguaaucuaucuaaguuacuauacauaucaauauaguaguuuguuucucuuuauugcuaaguaguccaucauauggacuaguuuaucuauuuacuuacugaauuuuggguuguuuccaguuuugggcuuuuaugaauaaaguugcuaugaacuccuguguaaaauaucaccuuacauucccaccagcaguguacgaggaauccugcugcacugcauccucucaccagcacuugguauugucaguaguuuuuauuuuuagccauuguaucuaauggugguuuuuaaucacuuuccuuaauggcuaacgauuuagaacaucuuuucaccugcuuauuuaccauccauauacucucuuuggugaaauguccauucaauuguuuuacuuauuuucuaauugaacugauuuuucuuuuauuacugagagaguucuuuauauagucuagauacaaucuguguuguuuaugggauuugcaaauauuuucucccaggcugugacuuguguguauuuucauuaaugucuuuugccaagcaaagaguuuuaauuuugauaaaauuuaucaacuuuuuauuuuauguacugucauuuggguguuauguuuaagaagucuuugccuaacccuagcucauaaagauuuuuuucuaaaaguuuaauaguuuuauguuuuacauuuagauccaugauucauuugaguuaaauuuuuaauaagguaugggguuuaagucaaugcucauuucucugccuauggauauccaauugcacuggcaccauuauuugcuaaaaaggauaucauuccuccauuaaauuguuuuucaccuucuucaaaagucaacugaccauccaagauccuguuuuuaauuauuuuguguauguucccacaaguggaauuacuggcucaaauaguaauucuaguuucaauuuucugagaaauaguauuauuuuuauauaucacugauacaucugauuuccuaauuuuuuuugaagauuuuuguguauacauguauucuuaaggaauaguggccuauaguuuuccuuuuuagaacaguauuucauuuuggaaucaaggaaauguggccucaugaguagaggaguauuucuucuuguucuguuuucuggaagagauuauguagcauuagggaagacuuuuaacuacaaauuaaaguuucuuucauaauuuuaggauuauucagauuucuauuucuuaggugaguuuugguaguguggcuuauuaagaaauuggcccauuucaucuaaguuguuaaauucaugugcauagaguuguuuuaaguuuucagcauacacauccuuucacuguccucaggguagguagugauauuccuucuuucauuccugauauaaguaaugguguucucucucuuucuuuuuuggggucacuuucggcaguuuuaccaaucuuuccaaggaccagcuuugguuucuaugauuuucucuauuguuuuucuguuugcaauuucacugauuucuacuuuuuauuauuuccuucuuucuguuugcuuggauuuacugugcucuucuuuuucuaguuucuuacagugaaagcuuagauagcagaguugaaacuguucuuuuauaacaaacauuuagugcuauaaauuucgcuguaagacuuuagcaacaucauaguuuuuaauaugucauauuuauuaucccuuucauucaguucaauauauuuuuaaaaucuccugugagacuuccucuucaacccaugaauuauuuauuuauuuaauuuuuuugagauggagucucacucugucacccagguuggagugcaauggugugaucucgacucacuguaaccucugccucccagguucaagcaauucucgugccucagacucccaaguagcugagauuacagacgugcaccaccaugcccggcuaacuuuuuuauuuuuaguagagacaagguuucaccauguuggccuggcuggucucaaauuccccaccucaggugauccacccaccuuggccucccaaagggcugggauuacaggcgugagccacugugcccagacccauuaauuauuuagaaguaugugguuucauuuccaaauguuuugagauuuucuuauccaugugugacuuuuuauuaucuaaugcaacuuuuuucaacagaguaauauuuauaauacuucauuuuaguuaauuuucuaaaaauaaaagaauaugaugcucuuuaggauuauuucuccaacauuccuuauuaaaauuuugccaacuucuuucauaaauugucuacccuccaguguuuguacaucacuccucucaaauaauuuguagucuuugaacaucuauuuuccucuggaagucacucuauagauaugagauguugucaaauuuuacuuuuucuaucaaguuuuuccuaguuaucacaaccccucuucuuaaccaggcaggacuaauuauucucucauuugaacaauauaaugcucaaauuuuaugacagaacguuuaaugugauaauaaaaacgaacuuugaguguggaaaaagcaacauuuuguuuuuuccuauucucucuuaacaguaacaaucaucaauacagaagacuucugugaccaaaugucuggguuuucuaauucccccuaaacacaccaagcaucaaacgccagcugaauguccgcuaauucaauucugauaccaucuaccuguagacagccucaggucccacagguuaagggcucagucuucaagacugcccugccccaccuucagaaaccagucacaagucugggccuaaggaacuucugaucaacuagcuauaaauugggauucccacaaugcucuauucagguuugaugaauuugcuagagcaguugacuuauaaaggauaucacaaaggauacagaugaagagugcauagggcgaggcauggggaaagagaggugcggagcuuccauggccucuccaggcaagccaccugccaggaaccuccauguguucaguuuucuggaagcuuucugaacccuguccuuuugaguuuuuacggaggcuucacuacauaggcauuacugauuaaaccauuggcuguuggugauaaucuuaucaccaauuuaauggugaaacuuaaucuucagcuccucucaccuccugggagguugcgggguggggaugaaaagucccaauccucuaauccugccuuggucuuuugcugccaguccccauccugaagcuaccuaggggaugccagcuaccagucaauucguuugcauacaaaaagauaucacuuuggaguuucuaaguguauacgaggaaaugaggucaaagaccaaauauauauauuucacuauaucacacuuacaaacuuuuguuuacuguuucucuucuccuacucuauuauaaaccuuugaggguggggacugugaguuauuuaucuuuauauucaagccaaguaugacugugaguuauuuaucuuuauauucaagccaaguguguuuagcuauaauggaaaugaaucucaaaguuucuugacuaaaugacaagaagaaucauaguuucaugaacuaaauuuauuauucucaguccuuaagguaaaugaauauauugauauuaugucuuugcuuacucauguucgcaagagugguguuaauggauaaacauaccaccguuacaccugaaaacgggcccccaaacuuagucaaauaauguauucuguucagaaauacauuuucaagguuuugaaaaauaaccaauauucaaacuagccucaauuuaucuuaaaacagaugcuauccuaguucuuuagacaagcaguccccagucacuucucccacgggggagaagugacaacagauaacauuuacacaugugaagcauucccaugggcagaguuacuuguucuuuuucuuuuuuuuuuucuuuuuuuuuuuuuggaaacagggucucgcucuguuacccaggcuggagugcaguggcacaaucacagcucacagcagcuccaaccuccugggcucaagagauccuccaccucagucuccugaguagcuggaacuacagguaugugccaccacacccagcuaauuuuuuauuuuuuuguagagauggggucuugguaugcugcccaggcuagucuucaacuccuggccucaagugauccucccaccuccaccucccgaaguguugagauuacaggcgugagacaaugcaccuggcuaucuuuucuucuaucuccucaguggaucacauaaagauacucuuuucacccaagguaaaauaaacuaacauggggccggguacgguggcucacaccuguaaucccagcacuuugggaggcugaggcaggugaaucaccuugaggucaggaguuugagaccagccuggccaacaugguaaaacccugucuaccaaaaauacaaaaauuagcugggcguggugucgggcaccugaaaucccagcuacuugggaggcugaggcaggagaauugcuugaacccuggagguggagguugcagugaacugagaucacaccauugcacuccagccugggugacaagagugaaacuccaucucaaaaaaaaaaaaaaaaaauagaaacaaacaaaaaaaccuaacauguaugaucaauuguuaggcagggcagcuguagcuauuaucaguaaggauaaguggagaguucaaacuuagauuagcaucucugcuauuuuaauaaggucauagaaucagacuauguacuacucagccaaguaauauuugauaaacacugaucaacauagguuuuuuaaacuauaaaacauacuuguauggaaaugcuuuucugacaguuugaaucauucuuacuuaccaauauacaugucccaacaaugaaagaguaaagcaagcugaaucaccaaacucaguaacaauaucaucauggcuuuucugcuuauuaaacacuccaccagauaagauuuguuccccuucugcaagccuuuaaaauacaaauuuaaagauuuuuaaaaaccaauauaaaaagcaguucauguaaacauauucuucauuaccaaagugcaucuaacuauggagacacaaauuuuuucucucucucucuuuccuuuuccuuccuuccuucaucccucccucucucugucuuccuuucuuuaaagagauagggucuugcuuuguuacccaggcuagagugcaguaguacaaucauaguucacauggccucaaauuccuggacucaggugagccucuugcaucagccuugugaguagcugggacuacaggugcacaccaccacacccagcuaauuuuuaauuuuuuuguagagacagggucucacuauguugaccaggcugguuucaaacuccugggcucaugcaauccucucaucucaugggaucacaagcaugagacacugcaccuggccaauuuguuuuuuguaaaaaaaauuuuuuuuaauuacaauaguggcaaacacuuauuuagaaucauuugagaggcuggaaauuuaugaucuuaaaauuucacuuuuaccuuuaaaaacagaaucaauuacauuuagucucuguauguacaaauccagucugagcaacauauucauuacucaugucagaaggaacagaagaugauuacuauacugggggagaaaauauaaaugguucuucauuaacaaacauggugguccuuuuuacuuccuuaaaauagaaauguauaugcaaauuaaacaagacuaacauaguuuaauuaaaaauugcauacuuaugcccggcacaguggcucaagccuauaaccccagcauugugggaggccaaggugggaggacagcuugaacccaagaguucaaaaccagccugggcaacauagugagaccccaucuauacaaaaaauaagaaaauuagccagguguagugacacgugucugcagcuccagcuacgugggaggcugagaugggaggaucgcuuaggcccagauggggacugcagugagccaucaucaccccacugcacuccagccugagcaacacagcaggacccuuucucuaaaaaaaggaaaaaagaaaaaggaacuggcaaauuacauaagaaagauuuuuaagaauuccacauuaggaucuuugaaauuuaaaaguaauucaacaacaaaugucucagaaauuucagauauuuuagcuagcuuuaauuaaaaagccaucaauuagucacuggacagauaauauaguuauugaucagucuauggugagacuuacuuguaucuuccccuuguaaaccuacaagccaauuauacauacaggcuuuuacaaauaucuaacaccguuuacacaugugaccguuuagucccuuuuaccauuauuccaucucuuacaguacagaaaagaauugaauagaaccuaacuaucuguaucucuaaaugccuccaaauuugguauagggacagcugacuugguuuaacuguaaugugcaaaagaaguacucaauaaaaugaucuugaaaggaaacuauacaaucaccuaaacacaagggagccuuaaucucaagugagcugguggguuuucaggcuuacucaaauuggucuaacacugaaagcaaagaaaacgaaauauuugugaucauuuaagaaaccaauaagaaucgguuauaacuuaaguuucuccagaguuaaacucuauuauuuauuaccauaacaaugaaaucuccauaauauaaauaaugccauaggcaacaguguaaacauuucgaauguuacugaaauagauggaaaacagggaagaaagggaaucagaguuuaaucugaaaggaauuuuauccaaaauucaacaguguaaguaaaacaaaauagcuagaaaauauuuuaaaacuuacuugcugagaucaacacaacauuuugcaagcagguauuugcauugcgguguaguacaacuguguccuuucaagagucuauaugcuuuauaugccuuuccugagcgguaauaacagguugccaguaaaaacaaggcuucuucugaguguacuaaaaacagacauuuuuuaaaaaggcuauuguucaguauauugaaugauaaucaguuuaucaugcaauaaacaaguuuagcaaaaaaaaaaauuaggcuugcuauuuuaacacaaaacaaucacuuauuaauucaaauuugaauuauggagaaacgguuugcuuauagcaaagucaguuccuuagaucuugauuacuuuucucuacaagaaaccaaggaaauaauacaaugaagacaaucaugguauucucuguaaauauuuaagaaaagcauacacacacagaaacaccccugccuuuaaacagacuaccaguaaaggaucuuguuuuuagguaauauuuuucuaauaaaucuuucgggaggauagaagucaaauuucauuagcaagagaaaccugaguguaaauaaaucuaacuaccaauaugaaauaauuucuauauuuuaaaaagaccagauugaaaaaaauccacuuguuuugcuuuaacaucaaauauacauuaaauuauauuuaagauaaauuauaaauugugaaugcucacaccauuuuaacauucaguugacagacuauaguaacaauaauuaaauuacauuacaauagcaagagcugaguuaucuaucaaucugucccuccuuuuuacauuaggaaaugcccccugccuucuuaaugcaaguggcauuuuucacccuuauuuagucuaugucucuacuaaacugaucaucacuucacuucuauccccacaauccagggucuacagaggcaacaacaaagaggauggaaagagagggaaaaccacaaaacugugcuucuaaaaauggguuaugcaauaauaccagugagcugaaggaucuucuaagccagugguucucaaagugugguccuuguaccaguaucagcauaacuuggaaacuugcuagaaaugaaaauuuuugugucccaucucauacccacuaaauuaguaauucugggaguaggaaccaguaaucuacgugguuaacaaacucugcaagugauucuguggcauucucaaguuugagaaccacuguuguaaaguacaagacaaacuugccacaucuuuuuaaauaguuaacaucauucuaagaguuuggauaaaaaaguaauuugaaauuuuauuucuaaguuuuuugucacagauaugugcaagcaaaaaccaacagaacccuucuucucugguccaucuuaugguuuuuuaugaaaccacaguguaaaaaauaauaaauaguaaaugauaagaaauuuuggcagauguguuuuaaugagauguauaguaguauuagugcugcagcuacaaaaaaaaaaaaagaauggggcgcucacugcaguaggaauaaacuauuaauuuuacugagcuacaacuucuaauuuacauaaguuagaaaguuugauuuccucuagauuuuacaauggucugguuucuuuucaccuuauaaguuuuuaaaaacuauugauuauaccaauaaacaauggcucccacaaacuaauuuaacucccagucacaguaaugcugucucaauuguuuacaaauauuugauuauguguagguccacuuucacugcaauaaaauugccuaauaaagacaccaacuauucuuuuuguguguacaugugcguguguaauuuuaguguaauacugcaauuagcuuuuugaagcauaguaacuuaaaaauuauauguucaaaugggaauacggauuggugauuuaggcaaaacuuaaaaauaaugaaacuggccaggcgugguggcucaugccuguaauccuagcacuuugggaggcugaggcaggcagaucaccugaggucaggaauucaagcccagccuggccaacauggcgaaaccccgucuucuacuaaaaauacaaaaauuagccaggcgcgguggcgcaagccuguaaucccagcuacuccggaggcugaggcaggagaaucgccuggacccaggaggcagagacugcagugagccgagaucgugccaccgcauuccagccugggugacagagugagauucuguuuaaauaaauaaauaaauauaaugaaacugucagauaaggaagcaaauccagagcaaucugaaguguugugacacgggugguuucuuaggcuccucacaaguaacuuggcagcagaaaaagauaacaguaccccaaacacaacuaaagaagcagugguaagcagccauaaaucuaaaaagcacagaauauguuuacuggauaggauugacaaagauuucaucuagaacaguaacuccaacuuacggauaauggcugucugaaaugccauguucagaaaacuucuugaggcugaucauggccuagcuaccaagaguagugaucaaaauaacaggauccagaaacaguuauagauguuugcaugucacuuauuuaccauccuuuauuuacagacuuaauuaaaauaugggauuagaauuauaagguccauaauauauugcauaaucaugaaugaaguuagcauugacuccauuaagucacucuuaaaguaauauugagaaaucaaucguguacuaguuaaauuaugcuauguccaugugaugaaaaauacagacauagaaagauuuccagaauguacugcuaaagugaaaaaacaaacaaauuaagccuguaaucccagcacuuugggaggccgaggcagguggaucaccugaggucaagaguucaaggccagccuggccaacauggugaaaccccaucucuacuaaaaauacaaaaaucagccgggugugguggcgugcaccugugaucccagcuacucgggaggcugaggcagaacaaucacuuaaacccgggaggcagugguugcagugagccgagaucaugccacugcacuccagccugggcaacagcgaaacucggucgaaacaggacuaucgaaacaggacaggacaggacaggacaggaaaggaaaggagagagagaaagaaagaaagagagaaagagagagagaggaaggaaggaaggaaggaaggaaggaaggaaggaaggaaggaaggaaggaaggaaguaaguuguagcagcacuacugaaguuccucuucuuacaaacagguuuggcuucaaaauuggaaaggucuuuugaguguaaguccaaaauaauuaagagggguuuaaccuugcauccuccagauacauuuacaucaaacagaaagguaaauuagucuuucaaagcuuuuaaaccagauagacgccucuucuucacgcugauuuauaaucuaaauaagcagccuuucuaaaauggaccaauuuugacaaauuuaaaauuuguugaggugacuguucuuuaccuagccuugauaaacuauacaaauaucagagaagcccucagagguuagaguacucuguggcuacccugucaugaacucugauguugugugaauuuaagggcauagaaccuauggaacuuuuuaugauuugugacacauguuucaaauugauuaucugggccaggcacaguggcucaugccuguaaucucagcacucugggaggccaaggugggcagaucacuugaguccacgagcuggagaccagccuggccaacauggcgaaaccccaucucuacuaaaaauacaaaaauuaaucaggcauaguggugcaugucuguaauuccagcuucuugggagguagagguacaagaaucgcuugaaccugggaggcagagguugcaguaagcugagaucacgccacugcacuccagccugggcaacagagcgagacucugucucaaaagaaaaaaaauaaaacaaaucgauuaucuguuaaguuuuuuaaucaacuauaaguaguaugacauguggauuaaaguaccgacucugaagcuagacugcuuggguucagauucuggcacuucaaccuacuagcuaugacuuagggcagaguuacuuaacuucucugacccucauuuuuuuuucauccgguaaggacuaugauaccuaccuuuaaagguugcuguuaggauuaaaugacuuaauacaugcacagcaauuaggauaguaucugacacauagugaaggcuguaugugcuauuauuuuaauuauuggccuucucuuaaauuuacaauaccugaauagauauuugauauuaaugcaggggguacauaagugucccugagccacaugcucaaguaauucuauuucaucaacuuuuuuuuuuucuguuuucaauuguauggaggcuauacuuuucuuauauuucauuauucauucuguuguucagagucauuucuacuguugaacauuucaucuacauaugcaaauuuagcauaugaauacuauucucaauguuuaucuuuucuacauuuauuuacauccugcauuucaauaccaacugguuuuauaccuguuguuaaugaugggguuaauagugcucuuaaguauuuuaaaaccacgcuuagaguaaaaagaccacaaauaaaagagggcuggaagaaguuuuaaaaggcuccuuaguguuugaggcagaaaauggcaauauaugaggagaaaaaagauggccaaauugugcagggcuuuguaaacuguguaaagauuuaggaacagauccuuacaacaauuagauacuucugaaggguuuuaagaaggaacauaaauuugggaggggaaaaggaacaggcagggaacgggagauaaggaaaauucaguuagugguaucuuagguuagauuugaauauauugaguuugaugugucugugaaacauccaaguuaauucaaugaaaauaggugagucuuggaucaauaaaggccucaaaaugauacauuauuccacaucuuuaguagaauucuggauauucuuuaauacugaucuuaacacaaucugguaaauaaguuuuuuuuuauauguugccauuuguacgcauauauuucugugaguuugggcucucaguauccugguuaauagaaaagaaacagaugcugaacguuuuacucugguucaguucucucccacugagccuaauuuacuaaaauugauacacccgaugcaaucuauacaucuuacccacuaaucacuaagacagguagaaaauuggugaacgauuuuacggucauuuaaaaugcauucaaguagggcgcagcagcacaugccuguauuccuagcuaccugggaggaucgcuugagcccaaguguuugaggccagcaugggcaacauagggagaucuugacuuaaaaaaaaauguuuaaaaaguacuaauauuaaaaaauaaagaccggauacaguggcucccgccuguauucccagcacuuugggaggccgagguggacagaucacuugaggcuaggaguuugaguccagcuuagccaacauggugaaacuccaucucuacuaaaaauacaaaaauuaggugggcguggccgcaggcgcuuauaaucccagcuacucaggaggcugaugcaggagaauugccugaaccugggaggcagucagccgagauugggccacugcacugcagccugggugacagagggagacccuaucugaaacaaacaaacaaaaacauuuugcagugugggauguaaaacccacauuaauuuaagauaaaacaguagaccuuaagcaauuuugaacucugggcuaggacccucaaaauaaccuaggaauacauguugacacaagguuuucagcuguuucucuuucuuuuccuuucacuaguuacaauccucuuagucucauagaguuccauagguagcaauuacuuaugaaaaaaaugcacacaaaacuuaugucugguugauuuucugaacauaacucuuauuuuauauguguguguacacacacacacacacacacacauaucuccaaagagcuaucauaguaguugcauuaauguauuuuuuuccucauagucuaacacuauuucuauuuguuguauagcacuuauuucuauucauucuuaacaguuaauuaacaaaagagaaaaaccuuggucaaggggaucagguauugguggugggaaagaaaaauacaugcuuacaaugggggaagggaauuuauuggagggagaugguaaaauuaggacaguuuuuccaaaacagcaaaucucaacucacuaguggacugugaugucaauuuagugguuaucagccuacguuaaaacaacaacaacaaaaccacucaauggaaaauauuagaguguaucauaucuaauaaggguaaaaaaaaucuggccaggccacaguggcucacgucuguaaucccagcacuuugggagacggaggugggaggacugcuugagaccaggaguuuaagacuggccugggcaacauugugagaucucguguucucaaaaauacaaaaauuagcugggcaugguagcaugugccuguagucucaucuaguagggagguugaggugggaggauuguuugggccugggaggucaaggcugaagugagaaaagaucacaugacugcacuccaaccugggugacaggcuaucucaaaaauaaauaaauaaauaaaaauaagaaaaaaaaaaaaaaacccugaaaagucacuguauuaggauauguuaggggagagggaaccuguaaaggacuuucuaugugccagaaacuacagcagacucuuuacauauuuuacuguauuuaguccuuaaaacuaucuuguuaaacagauauuucucuucuauuuuaaagauaaggaaaauaaggcucagaaugacuuuuggcuuaagaucaaauggcaaaugaguaucugaauucagauucucuuuccuuuuuccguuuuuuuuuugagacggagucucgcucuguugcccaggcuggagugcagugguguaaucucggcucaccgcaaccuccgccucccggguucaagcaauucuccugccucagccuccuggguggcugggauuacaggcaugugccacuacaccggcuaauuuuguauuuuuuaguagagaugggguuucuccauguuggucaggcuggucucaaauucccaaccucaggugaucugcccaccucagccucccagauucucucuuauaucauucugcuguuccuucuuucugaucccacagucucaggccgacuauaaaucucgagagaaagacaaaugggcgacaaagaacuagugaaacugagaaauuauuucaagaauuugacuuacagaagauccuacugaucaacugcuuuagccucaugccuuguuggaugucuuucuccaaauauagaaacugcuacuagugacauaggaggccccugagcaaacagguuacaucuagcauaucaacugauauuguccaccaagaaaacuguugccaagaauucugagguugguucagugggaaugaguacuguaauggauuagugaugccuacuaugguugcaaaucagagaagugguaauugcuacucuugggaaagcggaaucagacagauuacuaguuaccgccuguggacauuagucucaguucuucauccagaaaauggcaauagcaaugucuauuugauaggauuauugaagauuaaauuaguaacuaauauuaaauacuuagaguaccuaguauacaguaagaaaucaauaagugauagaauuauuguuauuauuacugagccaggauaguaucugcucuuacuacacuuaauucuaaaaucuuuccucauauaaauaugguuaaaccgaauggugagguucuauauugaaagaaacuaacauuuacugagcaacuuuccaagugccaagcauuguaucagguacauaaauaacguggauuaaacagcuuuauguggacuaaucugggaaucuugccaccaauucuaugggaaaaucuaauugaauucuaaaccaugaauuuacaauuuuuaagagccuaacuauaauaaacuagaaacugccuauucuuuaauaauaaacaaaaacaaaaaggaaauacuagaaauagaagacaguggccgaguacaguggcucacaucuguaacuccagcucuuugggaggcugaggcaggaggaucacuucaguccaggaguucaaggcugcagugagcuaugauugugccacuguacucuagccugggcgacagagugagauucugacucaacaaaaauuuuuaaaaauacagcaaaauauggggccugccuagguaucaaugaaaauauuuuuaaauagauuauucacaauaaacaucacuuuugcauaagugaauggaguagauuaaucuauuguauaaucuucuuucuaagccuuccauuccuucucaccuuucuaaucuuuucauugggaccuuaaacuccugcugcccagaucuuccucacuuuucucacugaauucccauucuccaccgaggagacagcucucucacauggacaguaaucaccuuacaucccacuaucucagagucaagguaaggcugguuuccacuuaacuucucaaaacuacuuccaagcauugcucuuuguccuuuugugaaauuuccugccccugagguuuaggccuuguucucacaacucucagcuacuaaacccauacuguuugacuuguaaauuccauuuaaaaguacauaacccaaggaaaugacucaaaaaaaaaaaaaagcuguacacaaugaucuauaucagcaucuuagaaagggaauuauaauaaugacagaaacaaaacauacauuaucagugguguuuauuaagcauugauuaccaagccagauggcugugcuaagggcuuuaaauaaaccaucucauugaauuuuuaauucuaaggggcaaugauuauuuuauagaugaaauaucugaauuuucagauauuaaaguaacucguccaagguuauaaaacuguacauuuaagugacagguuaggauuuguuccaaggcuauagagucuaaauccauguucuucaccauagaauacagacucuuuucuuaaaaaaaaaaaaaaaaaaaaaaaauacauggcaugguggcccaugaguauaaucccagcacuuugggaggccaaggcagguggaucaccuaagcucaggaauuugagaccagccugggcaacauagcaaaacccuaucucuaccaaaaaaaaaaaaaaaauuagccaggcguggugguccgugccugcggucccagcuacuugggaggcugaugugggaggaucgcuugagccugggagguagagguugcagugagcugagauggucccacuguacuccaacaugggugacagagugagacccuguuucaaaaaaaaaaaaaaaaaaaaaaaaaaaaaaaacccaaaacaacaaaaacccugggggaaaaaaaaaccuaaagauugaaaaaugauuaaguaaaucauagcauauaaaccugaaucaauucuacauaguuauuaaaaguaguauguaagggaacuacacagaaaaaaaguaaagauuuuaugaacuagugucaaucagaaaaacaacaagaugaugauagcuagaaucuuguuacagugauaaaaaguuauggaauuucauauauguuauucauuuaucauucuacagcaaugaauagauuucaaaccuucugcauaaaggcguucugcgaggaaaaccgcaucucgguaagcauagugguuuagugcuugccauauagcagccugcaaauggaggaaaaagaacauaaauauacauacauacagacuuucaagguaacuacuagcacacagccuuacaucaaauacugaaauuaauaucccuaauuuaagugauaaaaccccaaugcccacagagcaaacuccagagugugccgggcaaggcucuucacaguauggcuccuaacauaucugaauuuccucacucaacucucuauggacuuuuaggcuucugugccuuuguacacccuuuuccuccauugggcaaugugggcuccccucaccagucuccccuuauaaacugcucgucccuaaagauccagcuuaaauaacaucugccccauaaagcuuuccuggcugaugucaagccauuucuuuuuuaagauaccucuucuaguagagcacucauaacaugguuauuuguuaacaggacugccaacccuacuaaacuacagacuuuuagcagcagugguucucaaccacuuuaugugauauacaugacagagauauuaaaauguaugucauccucccacaaaaacuucccuaucuauuaccuuuaaugccacucaauucucauccacuccaggaagcauauuggaaugcaaaugaguaaaguuaucauaggaauaacuuuuaauuuuuugaauauauguuuucucuuuuagaauuacaaaacauauaaccuaaaguauauaugagauagaaggacauuuuaaguaacaauaaccaaagacauuuaggcccauguacucaccacccagcuuaagaaauaaaauaucucugaaacucccuguguguuccuuguugauaccaaaaccucucccugccccaaagaggaaaccaccacacugaauuuucuugaccuuucucuugguuuucuucacaauuuuauacauuuguacauaucaucucuaagcaguauaacauuuacuuuuuccuguuuuugaacuuuaaauaaauacaaucauauuguauacauucugcuacgauuugcuuuugaaauccaauguuuugaaaauucauucuugauguguguagcuagaguucauuuguuuucauugcugaauaaauaauauuuccauuguauaaacauaucaaaauccaaaauguauuuuaucuauuuuacagcauguggacauuuggguuauuucuaggguguuuuuuuguuuuguuuuguuuuuccaauuauaacaaugcugcaacagucuuagauucaucuccugggguauauauuuaagaaucucuccagccuaucacgguggugugagccuuuagucccagcgacucagaaggcugagcugggaagacugcuugaguccaggaguucaaggcuaugaucauaccugugaauagcugcuggagugcaauaggagcaagacucccaucaaaaaaacacaaaaaagaaucucuccaaauuaggauauauauuuaggaauaaaauuacuggguuguugaauaugcauauguucaucuuuacuagguaaugucaaaucauuuuuaguaauaaacuacuuuugagauaucucacaccugaucaugauacaagcguuauuuuuuauuuuuagcacauacaccagcuuauaauuuguugaaugauuuaaaaagguuacaacggaaaccaguaaaaucugguuacugaucacuagcuaacauuguaccaguacaucuaaauuauauuaagugauuaauaugccuuagauacaguaaaggcucaacaaauuuuguugaacaaacaaguaaauguuuaauaauucugcaaugaguauauuaauuauaauuuuaaaaauaaaaguaguaaaugacuuagcccuuucuauuuccucaagaaagaacaguaaugaacuuaguuugggaucuccagagccucuuguuuaaccuuuguuuauauagcuuaaauuuuauaaagucucaaagaugucuaauuuuaccauuccuaucuagauacaaggaaaaagaugagauuaggcaccauuauuauacacucuaauugcaccaaguaccuuuccuuuguaauacuucccacugcuauaauucuguauuaauuuaggagaguauuugagugauguuuuccuuacuauauuacaaacuccacaagguaggggcuacgucuguuuuugcucauuauuauacucccaguauccauuaugugcuuuuaaagcaggugcuuauauguugaaugaauaagcaaaugaucuuuaauuucuagcagucuuccacuguugacacucuuguacguuagucuuagcauuaaguuucuuuguauuccuagauguauaucuaauaauaaagaaucucugggagucucuauugaaagaaacucugugauaaauagaagaauuauuuuauuaugcaaauaauuaccaccaaauuacuccuuuaugaaaucugggauuuccuaagaaccuacauguuuaauuuugcuguaagugaaagaaaauggugaguagaaugaagauaccaaagauuugauguuuggagacgugcucaaauuugugugccagcacuuccaguagugggacuuugugggaaauacucaacuuuucucagccucaaucucuucaucugauaaauggaguuuauuuauuggaguuguuuuguggauuaaaugaaaugauccauuuauaaugcuccuaguauacuaucauacauuaagcacuuggaaaaccuuuuccuugccaaucucuuaauauaaagaaauucaauaaauauguaguuucuguugcauaacaucuccccagcauaccugcuacaacugcuuauuuugcaauauauaagccacaaaagacucaaaugauuuaccagcuauuuuacuacuauggaccacuaggaaaauuucacacacauauacuaaagucaaaaaguccuagagcuuugaaauuuuuucuguccuuuuaaaauuaaagaaauaagaggcaagggcggggggaaaaaagaaggaaaaaagguaucauauucaagaguuguauccauuucugacuuaaaaucaagcuuugcucagaacaucauucccuuaucaccaguucuuaagagcaucagaaaaaacuugccaucucgagaaucucacauacugcuuccaucccgcuuugcucaaucaauucuaaguuccugacuaacagugucucuugugccgggauuggggggaagaacagauuauucucuaaggcacuacagauuaguagcugaugaugaacagggcuaaaaucagcaccucugcccaacugauggugugggccuucccuuaaaagaacacccagugcauuaccgcuagaguucuacaaauuaaagccagaugaacgaaaugcugcuaaaagaaaguuaugaagccaaaaagaacaacgcuccucucccucuccccuaaaaaauguuuaagagaaaucugacugauuaauggguuaguccccaggugcacuaauuuaaaagauaaauaaaccaacagcuuaaaguugcaaaauuccuuaccagcuagcuauucuuaaauauaaaauauuauuuaaaauauaaacaaaccucuauaaguuguacuuagacuuaaauguaaucacuauaaauuuuucucuuuuuuuuugagacagagucucacucugucacccaggcuggagugcaguggcgcgaucucggcucacugcaagcuccaccuccuggguucacgccauucuccugccucagccuccugaguagcugggacuacaggugccugccaccaugcccggcuaauuuuuuuuguauuuuuaguagagaaggaaugguuucacccuguuggccaggauggucucgaucuccugaccucgugauccgccugccucagccccccaaagugcugggauuacaggcgugaggcaccgcgcccggccuguaaucauuauaaauuuuuuguuagagaaagcuuauuacaaaaaauuuguuuacuuguuuuuguuaaauuuuuuauacauuuuguguucuuguuuuugucaaaaaagcugucuuuauuuuauuuuauuuguuggucuugaacuccuuggcucaagugaucugucugccucagccucugaaagugcugggauuacaagcgugagccacugugcccagucagcugcccuuuuuuaaaaaccauaaaauaaauggauaauaaaggcuucagacaauguaagaagauacaaagaaaaaaaucacuguugaaauuucauauuauacauuauaauugaauuucuaggauacugauuuaguuuagaugcacgucagugguucuuacucugggcaauuuugccuucuuacucccaauuaaugccccaacauuuagcaaugucuagaggguauuuuugguugucacaaauggaggggucauccagugguuagaagccagggaugcuacaaaacauucuacaaugcacagcuuccaacaaaguauuagcuugccccaaaugucaauagugcucagauuaagcagcccuggucuacaugaucaugcaguuggauuauucuacuagucuguaugucuaacucuugucucuuccucccuuuccaacagcaccagauaaauauucccaaaguggugcuuuuauuacauaauuccucugcucaaaaacucuucugcucauauaaugguuauucauuaccaaugcacauuaaaucuaaauuucucauugaguagccaaaauauguuacucuuugaauccauguuagaugcugucccugaacauuuuauccccagccaagaguacuccuucaccaucuaaugaucucuaaaacaguaucauguauauaguacccaauugcuauauugcuuauuaaauuaauuuucgaaaggcuuauuuacaacuucauccaacacuucugugaagucuuaccccuaggaauaauugcuaaaucuauauaaaaucucuuugcuucuuuuuuaaaaaccaauuucaccaggugacuuuuauaaauauucaaaaagcucucacugaagucacuuaggcuagugugucuuuccaaauaguuaccauuaaaaauaaaagaacugacagaaauucugccucauaugugagacuuuuguaaggacucaaauauaaaguaauacucuucugagagguaguaauuugagacggaguuuuaauuuaggcauauaugguauaucggacuggccauucuacauuaaaacuuuaaagaaaaaaaaaugcagaaaacaguucuucauauuuucugugaacuuuuuccuaugccuaguaauaccaucaacucugaggcauuccaagaaagaacaauuuuccaacuuacucucauugcuuuccaaauacacgcaaucugucaucauaguuuuuuuuuuaauaaagacaguaucuuauauaucuguccuauuuuuauucucuuccuaauucuuucccauuugcagcacuaucccugaucauugaucuuuaucauuguagccaaaguugcuuguucuucucacuguuccaaauccauucuugaauggcuucuuauacuauacaaccaaaauuuucaccuagucauauccuaaaacuuucuaccacuaucucaaaaaucuaauggacaaugcugcuaugaaaaagaagcaaauuugacauuuaagccuuaaaaauaucaaaguguauuacugcucagaguacuuuaaggacaaacaggaaaccugauggguacuaucuagaaacaggcuacauauuccuuuucuuuuccaugcuuuuauuuuuuauuuauuuauuuauuuugagauggagucucacucugucgcccaggcuggagugcagcgggaccaugucggcucacugcaaacuccaucuccuggguucaggcaauucuccugccucagccucccaaguagcugggauuacaggcgcccaccaccacgccuggcuaauuuuuuauauuuuuaguagagacaggguuucacuguguuggccaggcaggucucgaacuccugaccucaggugauccacccgccucagccucccaaagugcugggauuucagguguaagccaccacgcccggccuuccaugcuuuuauaaagucugaaauuauuauuaaauggugguuauagucuaucaaugcaacuaguuuaucacuuuagaagacuucuggggccagagaaggcaaaaaaaaaaaaaucauuaacuauuaaaacaaaauuauaagaauaugcaacagaaauuaaauaacuugaguaaucugcuuaucuauuuaaguucauguuaggccuuaaaaaauuauauauauauaauuaccucaucuacagccagaauaaaaaaaaaucuuaaaagaaacuauacugguaaaaagaauuuggauggaaauagcucuagaaaaacuaauacaacuuacagacagguaaauuucauaagauauaaucuuacguuuuauuaauucaaacacuaauagcugcuauauguaaacagcuggagaaaaaaaccaaacuagaagaaaugaguauuucaugcuguuuagaaaaaugaaauaaauaugaaaguagugauauauuaaaauauuuacuguuugauaccucaagccuuuuaagggcaauaugaaggaauuucuaaaaaucaguuugcuuuauaacuucaaaauaaaguccaugacucaaugacagcaguugauagaggucaauucugaucaaguuaaagaucauauagugggaugaagucucccagaccugguccauuaccaaggcacaaaagauacaguuucuccagaugucaggggggaaaaugacuuggcaccgcaucacacacuuaaaauccaauaggguuccuuuaaugcaacacagcacugugcgucaaagcauacccugguguaaaggcagugaaauggacagaaacaccauuauuuguguuucauuuccugaaugccuuauaaacaugcacaacaaaaugcuccugauccccaucagagaggaugaaaacaacccaaaugugcccuuuccaccuccuccccugguauuggugcuugcgccucagcacugaggcuuggaguugucuucucaaaccaucauuguccggugggaaauucaccgagaaaggaaacgugggauaggaagucuguuaccaaaauagaaauuaguauuaaaaagaccgauccuacgcucccuccacccucucauacaagacaaaauaaaaaaaaccuccguaaacuugcccuaccgucacgaagaucacacaagcuccgaucaaaugugcuucucgaucaucuuuuaggcaagagagcgcuuggggugcauuuucggccccucaucucccacccccagucaagccaggccccuggacugacaggaaaggcuggccggacguuggcucggacgggaaaggcgguuauuuucgccgaagccgcucacgcuaagggugaaguaauguagggccagagguaacacggcuuaggcugugggcaaggccuccgaacugacuaaagauaggcaggacacggcagcaggggaggcgggagaagcagccgggccuaggccgcaccaggccgcggaguggcccuacgcugcugcuucccgaccgaggcugccagccaagccccagagaagaagguuaucauuaccuggacggguuccugcagcaccgucauccucgaggcucaggcccacuuucugcagugccucaggcccccccuguagcggcuccggcccggccagccccugcucauuuaaacucaccagcgaccguuaccgggggaugggggaggccgagcgauu
